United States Patent 6,812,339 (POLYMORPHISMS IN KNOWN GENES ASSOCIATED WITH HUMAN DISEASE, METHODS OF DETECTION AND USES THEREOF) - sequence listing, part 51

SEQ ID NO: 15080 - DNA, 12032 bp, Human
agggaaccaggggttgggggaaaggggtttgggcagagccgggacaggtaattagttaaagtcacacataattgcagaggttgtgtgtgctgctagaatcacagccgtcacaaagaaggtgtggtgccaaggtgctggccgaggactcctgtgtgtcccctggtttggattagcgctgaccaaaagtgcccgagtcagctttcacgtttccaagtgggtgaggcaggatggtgaggggtatttgcttggtaccgcgaactctgtccagacactgaaaacatctacaacagaagatgaggaactctacaagtttcctggaatttttgctggttagaaaaggaatatgtgtttggttatgtccgtgtgctacataatgctatatttaaacatgtttaaactgttattacaataaagtttcatctagttagactcatactttctgatctgaaagtaaccaaaaaggtaagtaaaaattaacttttaacaataaagagcaactctagagacatggcaataaatgactgcaaggagcagggagggctttaaagactcactgcaattggtcagtttaccatgaagtgccctgcttactggcaaagttcagcaaatgctggcctgtggacaaaagctactcaagtgtacttcacctaagcatacagtactcttaatttttttaagtattggcacttgaaaggtgagcatttgcccacctgaaaatctctctctagaatagcacagggtggtagtgatccagggctttaccctggcaggtagtggcaggtagaggccgatttgaaacctgctgtcagagtccagggatgaaatgtggggggttggtccaggtcctgagagtgaagctaggaggagacatctccaagtgtaaatttttggaacacagtttctcagcttgggtggaaagccaccctagtaagtggagtattgttcatgatgcaggctcagacacttcaggttcctccaatgatggccaattggtagaaaaagaagaacctggtttttggtgactctggctgagtcagaaggatgataatgatttgggtttgagacaagttgggtttgaggaggcagtaggcccatctcctggaggtggcctaccagcaggtagctggatgggctctccagggtagggccagggaatgaagaaaggtccataaacaaaaaaggaagagattagtagaacttactagaggatggtgcctacaaatctgaacgtggcctgggctggttcctgagctatcagctttgtgccaccacatcagtgcaactagactagactagcttcatgcacattctgtttatatcagcccttctgcagagtaatcttacaaacaaattgacttaggtgtatacaaattatttcttatcctctggaagtttaaacaggtgtgataagcaactaatgttatgccaacaatgagtgatgaggaagagcccgtggtttgagtaagtgtgggtgatttttgtttatggaccagtaaaaacacttgaacacactgagggagggaggtttttgtttgttgttgttgttgttgttgttgttgtttttctctttggtcaatggagcttcacactgacctgaaatagataatactggatccgtggaaagaactctccttaccagagggaaagtgtgctccactggccatcagtgcttgactcctcaccctctgagaagccaaaagtgtagacttgtatgcagatggccctctcacatggagaactgtgttccatgagcaccatttaaaggaacgtgttgattgtgggtagttgattctgaagcggtcagggaggaaaagcattgttttcaaatggctaatgcaagaaaactgttcctcttctctccacagccaatccgggggacccaggacatgccccagctatagtgatgcagattacctttctgctcctgaatcgcacctgtgcctcagactttctcccctcagcttgagactgcatgtaaactgggatgtgtgaaagcaggaagcaaagctagtgacagctgagaggtccatgtctgggtagaaccaggcccacgatgctgcctctcccgtggtctggagttcagctgcagggactctgctgatgtgcccagcaccatcgttctgtttgtgcttaaatggcacagcatttggtcagcacatctgaaaaggaaggtgtgagaagcaaagcccatggccacgttcccctgccagttatgtggcaagacgttcctcaccctggagaagttcacgattcacaattattcccactccagggagcggccgtacaagtgtgtgcagcctgactgtggcaaagcctttgtttccagatataaattgatgaggtgagaggctttggcaaaggtatgcacttttagaagtacgtttaaatggcttttctagccctcagaccacacgatgcaaggggaaagggacacaggatatggatgcattttagcctttgagggattcttgaaatctgcatccagtgattcctgtggttttatgtgacagtcttgttgtgcagtgtcagttcattctttcaacagagattttttatgcacctacaatataccaggcctctccccatggctggagaaataggaaaagacaattaaaatgcaacctcactgctttgacagagctatacaggtggtagaagttgttcttcactgcctgatgaaacctgggacggcttctcagatggggacaatctttaagctgtgacacaatgaaagaggaggaggcagagaggaggttctgggaaagccataagtcttggccttaaagcacccatgtgcagagggtactatccgaggaggagcagatgaggctaaaagtgcaggcaggaaggaagccacgtatagcaggccttacctctgtctgagagggtttgtctcattcaggtgtataagtagtgaagaaatatgattcgtttagtatcctagaaagaggactcagataataatttgaagaagtggcaggaaggctgatttgaaacctgctctcagagtccagggatgaaatgtgggggctgatccaggtcctgagagtaaagctaggaggagacatctccaagtttaaatgtttggaacacagtttctcaacttgggtggaaagccaccctagtaagtggagttcaggtgggtatgcagatgagcagcatgtgcatttgatcagttttaaaggcacccatgacacaccaaaggataaaaagcactgttttagcagatgagtctttttaaaaaattacatttagtctaagttatttattgagtgcctgttaggtacctacttccatgagggaaatgaatacattagatatcgtttctgccgccagtggatctttttaatatcacaggaaagactccaggtacatgcagtggctgtgctgcacggtactgggactggtaatgagcatggtgtgtgttgtgtctgtgcacactcagagccacacacatagtgcgtccactcacacgtgctgcttttgatacttgattaagggaaatgcaccatttgcccttaatttcatgaaataaactttgaagtttcaactttgactgttcacatacaaacgcctggagagagccaggctttagcaagtgagattttccatctgactggtattaccatagaccacattatgaaatcttggagtgaccctggaggaaggcacttgaaagaattgaaaagatggaaattatgctcctggcccttaagaataccactgttatacataatgtaatgtaataagttggttttaaaaattagcctgcaaatgcttacatattttaaaattcaaatgtcttctatacatgggcctccctctagctgtcacgagtagaagtattgaatgctgatcacgtgcatgagtttgttgcagaggctccctgttttgcatgaagcttcttgcgtgtgcggagggtaagcgtccttacccaaacatgagagcagcgctggctgcaactgagtcacagtgaggacactaaaactgcagataaagactgagacacatagaagagatcaatgtttagaaaagaagaattagtggagtagaactattgggattacagttgacccttgaacaacatgagtttgagctgcgcgggtccgcttatacacaaatatttttcaaccagatgcagattgaaagtacagtatttgcagggtgtgaaacctgtgtataccgaaggctgacttttcatacacatgtggtccacagggtggaccgcaggacctgagtatatgtgtatttgggtatgacaggggtagaatcagtaccctgcatgttccgagaaataatttactatggtaaactgcgctgaaaaagaagtcttaagtcatgtttagaaggtagttgttcttagcaaggaaaatggcttgttcagttaagggtgtaaagagaggcaaaaagggaagctgtcagtgtactttatgcaagaaccgccttccctgcctcagcccccagcatttcttgcctctcgcctctcttgcctgaagcagtgatatagtaaaggactggaagagtgtgagatggcaggatgctttcggttttgcttttaaaaaaaagatgatgcctgtaatcccagcactttgggaggccgaggtgggtggatcatgaggtcaacagatcgagataatcctggccaccatggtgaaaccccgtctctactaaaaatacaaaaaattagctgggcgtggtggtacacgcctgtaatcccagctactcgggaggctgaggtaggaggatcgcttgaacccgggaggcagaggttgcagtgagctgacatcgagccactgcacttcagcctggtgacagggtgggactgcatctcaaaaaaaggatgatgaggcaacagaggttgaaggaaaaaataactgacttgcttaaccagaaaacagaatgtgggtcccagtacagcatataatgaaaccagttagagacaacaacaggcaagaaaagatgatttggcaaggttggaggtcctaatgtgagcaatcaacctctaaataattctaaaatcactgacatgatccagatgatacccaaagatggtggcattgggtactgactctaggacatactaaagctgttttcatgggttataaggtaagatgaaaaactgagggaaagaaacaagtcgttgaagtaatttcagctataggatgagaatgttctagatcaggattgttgagtaagtaagggataaattaaaagggaaagaagtagatgccaggcaagggaaagagtcaagaaattcagaaatgtgggagctagtgaagtctggaaggcagtggtcttgctcaagtactactggggtgtcagactgtgccccacttacaggtagtacaggtgtaggacaggaaagagtgggtaggaaataaccaggtgcagtcgttaacctggtattgatctacccatgggtgataaatgaaatcaaatcagatgaaagtcctctataatgaaagaaaagagagaggcacaaactgacccaagagctatgggatcctgttcaccagtactgggccagaaaaaaaaaaaaaggtttaaatactgagtgtgtaagccagctccccccttcatatgtattcctgcgatatatatatatacatatggatatcctgcagaacaacatggctatttgccctctaacatgctctaaaaaccctttctccaacctgtgcatttatttagatagacctagaacgtggaaacaccagcacaatctggtttctcagatgcccatcgtattggttcctgtccctgccttacggtacccatcatgttatcatttatgtgcaaacaagctgtggtgtactggagggaagggaagggatgcacacagcaggccttttttgtttttgtttgtttgttttgtgacagaggaaggaggtatgaggttgtactttatttttaagaaaatgacagttcgattcagattagctttatattttttgaactggcttccagttggcctctaggtgggggcctccactcaacggctgctattgtagacccctccccaattctggctccacaaaaggggcaggaataaacagtatagggcagatgttggctgaaaggtgtaattaagtatacttttgacttaaacatactgtcttaaagagatcctatctcttttacggaatgagttgttagaaaatcttctgtatctaacgtgaaagctcacagggtacaactgcacttaaattgtcagttaggacaagctttaacctctcgtgacaaaacccctaaaggaggtatctgccctgagggatatgaagctacaagttgtaatgaaggattctgtttcataggacatgctaacatgtaatgctctgcattttagttattaaaatgaacctttttaaagcttaaggatgacaaactcagggtttccttataccactgagtttttaaaagccagtggtgagtttagatgttagcaattcagtggaactatgaaaaagatggaattgtgatggctttccataactaatttctgcttcacaaatataaaagagctattttgaaattccaaattgactagacagactacggcttgtccctgaagccattgttgaagacaaacttacaactcttattagaagtagcagcttcatatttaaagaagaaagtctttttgaattttgccaattaaattaccagtgacctttaagaagtaagtcaaaggtgtcttagagggaaaatttgaagtaacagagacaggcagcagcatcagagataagagctgatagtcaagcattgaatgaaggaaatcaagacagtggtgagatctcacggcaggcagaggctgaggctgaaagcaaggcagtgggctgatgttcagggtcctattagacacttttctgaggttaaggatggactttttaagaggctcctaagagttacatgtccatggcttgaactttttgtctcaaacaacagaaacataggaactaggaacaataacctaaaactggggctttatgtggttctgggtagcagacaaattgagtcacttgaatttccagagtacaaaagacccctttaaccccttcctgaaaaagatttttcatggtcaggtatttttaaatacttgcatactttgttcagaaatctgtatacattaaaaaaacatgttctctttaagaatattctggccaggcacggtgactcttgtctgtaatcccaacacttttggaggccaaggcgggaggatcacttgagcccaggagtttgagaccagcgtgggtatagtgagaccttgtctcaaaaaaaaaaaaaaaaaaaaaaaaaaaattagccaggcctggtggtgtgtgcctgtagttcagctatttgagaggctaaggtgggaagattgcttgagcccaggacgttgaggctgcagtgagccatgatcgtgccactgcactccagcctgggcaaaagagtcagatcctgtctcaaaaaacgttttataggtgtgaaaaatgtattatggctttagtattgcttgcttttcttaattataaaagtttatatatttggaaaatatatgaaagaattttgaaaattataccaagacccagagaaaactattaacattttgatataatattgttgctacacctttcttcagctcttaaaacaactctctattgtgaaatttctccttctgctcctaggcatatggctacccattctccccagaaatctcaccagtgtgctcactgtgagaagacgttcaaccggaaagaccacctgaaaaaccacctccagacccacgaccccaacaaaatggcctttgggtgtgaggagtgtgggaagaagtacaacaccatgctgggctataagaggcacctggccctccatgcggccagcagtggggacctcacctgtggggtctgtgccctggagctagggagcaccgaggtgctactggaccacctcaaagcccatgcggaagagaagccccctagcggaaccaaggaaaagaagcaccagtgcgaccactgtgaaagatgcttctacacccggaaggatgtgcgacgccacctggtggtccacacaggatgcaaggacttcctgtgccagttctgtgcccagagatttgggcgcaaggatcacctcacccggcataccaagaagacccactcacaggagctgatgaaagagagcttgcagaccggagaccttctgagcaccttccacaccatctcgccttcattccaactgaaggctgctgccttgcctcctttccctttaggagcttctgcccagaacgggcttgcaagtagcttgccagctgaggtccatagcctcaccctcagtcccccagaacaagccgcccagcctatgcagccgctgccagagtccctggcctccctccacccctcggtatcccctggctctcctccgccaccccttcccaatcacaagtacaacaccacttctacctcatactccccacttgcaagcctgcccctcaaagcagatactaaaggtttttgcaatatcagtttgtttgaggacttgcctctgcaagagcctcagtcacctcaaaagctcaacccaggttttgatctggctaagggaaatgctggtaaagtaaacctgcccaaggagctgcctgcagatgctgtgaacctaacaatacctgcctctctggacctgtcccccctgttgggcttctggcagctgccccctcctgctacccaaaatacctttgggaatagcactcttgccctggggcctggggaatctttgccccacaggttaagctgtctggggcagcagcagcaagaacccccacttgccatgggcactgtgagcctgggccagctccccctgccccccatccctcatgtgttctcagctggcactggctctgccatcctgcctcatttccatcatgcattcagataattgatttttaaagtgtatttttcgtattctggaagatgttttaagaagcattttaaatgtcagttacaatatgagaaagatttggaaaacgagactgggactatggcttattcagtgatgactggcttgagatgataagagaattctcgaactgcatgtattgtgccaatctgtcctgagtgttcatgctttgtaccaaatttaatgaacgcgtgttctgtaatcaaactgcaaatattgtcataaccaacatccaaaatgacggctgctatatataagtgtttgtcatatggaatttaatcgtaagccatgatcataatgttaactaaataactttatgtggcactgcctagtaagggaactatggaaaggtttggatttctccaaatctgggagaattttcaaaataagaaaataacctttatatgatatactatgactaggctgtgtatttcttttcagggatttttctaccttcagggttggatgtagtttagttactattaccatagccaacctgtagttttacatatacattttcttgtggagcaatagagttctccattttacagaagcattttaaatgtagtttgaatattttccacaagatgctgcaatgtgagttatcacttcatttatcttaaagaaagactaaactggttgtcagttacatctgacagaaaaaaaaaaaaaatcactgtgtaaccaggttaagtggtaaaataatccaggcgtcagtcaaaggcattttgctgactttaatattgattatatttttaacaggaatttaagaaaatattactggaattaaaaatatatatatattaaacaagaattttctttgctctgtctagcttaaactactactcaagctgcttaagttcttaagtattgtttgtaatcaccaataaataagtgcatttgtaattcatcagtcattattagcttttattaaaagaagattacgttttacaatgtaactataatctcttgaatttggtatcttattaatgagttttaaagatgtaaaacctaaccttttttaaagctccattgtcttatgtttttagaggcttttccgtaaacatatatcttacatataataaacttttcaaatcttgcaatttggcttgattaatttttcatacagctccacctgtgtcaacaacatgaactacatacactcagatcaagacagaaaacacttccggctccacctggctccctcatgccccctcctggtcattacttcccccacagaaaccactgttttgacctctactgagcatctattagaaacttcactttttttgagtaaaataattatgacttaagatggaagcttgtatgcgtccattaaattcacagcactaagagcttattatttctaaaaatgcaatatttaaatcattctataatgtgacataatttatttctaatgtatagatcagaatactatccaccagagtttagtctaacctgggctaccatgatccacttttacaacggtgtttaccattaatttctagccaaattagaaataaatgtacttatttcttattgggattttctcaaggtattatgccccttaaatctgacaggcctatttctgtttgttttactgctaaatagggtggggataggtagagaaagggaagacgagtttgtctgtctatccaagaagcccactggtcaaatgtgagaaaacctgacccactcacagtccttaacaatgatgctgattgatgaccacttaaggggcaaacagctacccaggattggaactgagaaggaaatttaatctatgagacccagctgccagacagacctgggtctttaaactacaatgaaacccgcggggaggaaatgagacaaagtgatgtaagttattccgttagtaggagtccactgcttggggacgtttaagtcagttcccatatcccctctttgttctcagagggaaagcaatctcccagagcaaaaggggaaagctaaaacctcctgatatccatttatagaagcttccacagatacttttacatggcttactactgtctcctgtgagttccacaacacatacttgattttcctgaacacagaacataacatttggagtttagtccccaaaatacagatcataagaatttcagatattccgcattacaagtcagggtaggctgggattctcctacttaaatttggacagaaagaaatggtttaattgttctaattaaaattttacgaggttaagaaaaagttcttggatttaaaattatgaattaagtataactgactctacaaaaagaggtctattgacccttaagattgcaaagaggctgggcacagtggctcatgccagtaatcccagcactttgggaggccaaggcaggcagatggcttgagctcaagagttcaagactagcctggccaacagtgaaaccccatctccacaaaaaatataaaaaattagccggttgtggtggcgcaagcctgtggtcccagctacccgggaggctgaggtgggaggtactgcttgagccaagatcgcaccactgcagcctgggtgacagagtgagatcttgtgtccaaaaaaaaaaaaaaaaaaagactgcaaagagaagagtcacttctcaacagagctctgtataaatcagtgctaaagaaatgattagatagcttctgatttggccatgataaataaatggcttgaggccactgagaacattcttcccacaggatggaagattttggtaatcttttctcttccacttcagtgtttcctcccagatacggtctgtgtgattggtatgtgtcagacacttctacacagtatatacataaacatttaaaacaaatataatagctataatttaatacttactagataccaatatcaaaactgagatttcacagctagtatataaaatgaagccagttaaagaaagattttcctagtaagtaaataatgttagtattccaattactagtctactaaaaaggttctaatatcaaagcaacattgtctttaaaaacccatcaaatgtccaattaaacttcaagtgaatttgaatcatgcattatacaggttgatgtgtttaatgcttttgttttgaaaacttcaaagg

SEQ ID NO: 15081 - DNA, 12032 bp, Human; identical to SEQ ID NO: 15080

SEQ ID NO: 15082 - DNA, 10614 bp, Human
attaaaaaaaaaagaaattgtcatgtttgtagacttcccaaatttgccatcctaggcaaacagtgctcttgtttttaaacaaatagttgtatacataattttccccctcactattcaaaacatgtcataaatggtaagtccaagaaaaatacaggtattcccccccaaagaaaactgtaaaatcgacttttttctatctgtactgttttttattggtttttaaattggttttccaagtgagtaaatcagaatctatctgtaatggattttaaatttagtgtttctctgtgatgtagtaaacaagaaactagaggcaaaaatagccctgtcccttgctaaacttctaaggcacttttctagtacaactcaacactaacatttcaggcctttagtgccttatatgagtttttaaaagggggaaaagggagggagcaagagtgtcttaactcatacatttaggcataacaattattctcatattttagttattgagagggctggtagaaaaactaggtaaataatattaataattatagcgcttattaaacactacagaacacttactatgtaccaggcattgtgggaggctctctcttgtgcattatctcatttcattaggtccatggagagtattgcattttcttagtttaggcatggcctccacaataaagattatcaaaagcctaaaaatatgtaaaagaaacctagaagttatttgttgtgctccttggggaagctaggcaaatcctttcaactgaaaaccatggtgacttccaagatctctgcccctccccatcgccatggtccacttcctcttctcactgttcctcttagaaaagatctgtggactccaccaccacgaaatggcggcaccttatttatggtcactttagagggtaggttttcttaatgggtctgcctgtcatgtttaacgtccttggctgggtccaaggcagatgcagtccaaactctcactaaaattgccgagccctttgtcttccagtgtctaaaatattaatgtcaatggaatcaggccagagtttgaattctagtctcttagcctttgtttcccctgtccataaaatgaatgggggtaattctttcctcctacagtttatttatatattcactaattcattcattcatccatccattcgttcattcggtttactgagtacctactatgtgccagcccctgttctagggtggaaactaagagaatgatgtacctagagggcgctggaagctctaaagccctagcagttactgcttttactattagtggtcgtttttttctcccccccgccccccgacaaatcaacagaacaaagaaaattacctaaacagcaaggacatagggaggaacttcttggcacagaactttccaaacactttttcctgaagggatacaagaagcaagaaaggtactctttcactaggaccttctctgagctgtcctcaggatgcttttgggactatttttcttacccagagaatggagaaaccctgcagggaattcccaagctgtagttataaacagaagttctccttctgctaggtagcattcaaagatcttaatcttctgggtttccgttttctcgaatgaaaaatgcaggtccgagcagttaactggcgggggcaccattagcaagtcacttagcatctctggggccagtctgcaaagcgagggggcagccttaatgtgcctccagcctgaagtcctagaatgagcgcccggtgtcccaagctggggcgcgcaccccagatcggagggcgccgatgtacagacagcaaactcacccagtctagtgcatgccttcttaaacatcacgagactctaagaaaaggaaactgaaaacgggaaagtccctctctctaacctggcactgcgtcgctggcttggagacaggtgacggtccctgcgggccttgtcctgattggctgggcacgcgtttaatataagtggaggcgtcgcgctggcgggcattcctgaagctgacagcattcgggccgagatgtctcgctccgtggccttagctgtgctcgcgctactctctctttctggcctggaggctatccagcgtgagtctctcctaccctcccgctctggtccttcctctcccgctctgcaccctctgtggccctcgctgtgctctctcgctccgtgacttcccttctccaagttctccttggtggcccgccgtggggctagtccagggctggatctcggggaagcggcggggtggcctgggagtggggaagggggtgcgcacccgggacgcgcgctacttgcccctttcggcggggagcaggggagacctttggcctacggcgacgggagggtcgggacaaagtttagggcgtcgataagcgtcagagcgccgaggttgggggagggtttctcttccgctctttcgcggggcctctggctcccccagcgcagctggagtgggggacgggtaggctcgtcccaaaggcgcggcgctgaggtttgtgaacgcgtggaggggcgcttggggtctgggggaggcgtcgcccgggtaagcctgtctgctgcggctctgcttcccttagactggagagctgtggacttcgtctaggcgcccgctaagttcgcatgtcctagcacctctgggtctatgtggggccacaccgtggggaggaaacagcacgcgacgtttgtagaatgcttggctgtgatacaaagcggtttcgaataattaacttatttgttcccatcacatgtcacttttaaaaaattataagaactacccgttattgacatctttctgtgtgccaaggactttatgtgctttgcgtcatttaattttgaaaacagttatcttccgccatagataactactatggttatcttctgcctctcacagatgaagaaactaaggcaccgagattttaagaaacttaattacacaggggataaatggcagcaatcgagattgaagtcaagcctaaccagggcttttgcgggagcgcatgccttttggctgtaattcgtgcatttttttttaagaaaaacgcctgccttctgcgtgagattctccagagcaaactgggcggcatgggccctgtggtcttttcgtacagagggcttcctctttggctctttgcctggttgtttccaagatgtactgtgcctcttactttcggttttgaaaacatgagggggttgggcgtggtagcttacgcctgtaatcccagcacttagggaggccgaggcgggaggatggcttgaggtccgtagttgagaccagcctggccaacatggtgaagcctggtctctacaaaaaataataacaaaaattagccgggtgtggtggctcgtgcctgtggtcccagctgctccggtggctgaggcgggaggatctcttgagcttaggcttttgagctatcatggcgccagtgcactccagcgtgggcaacagagcgagaccctgtctctcaaaaaagaaaaaaaaaaaaaaagaaagagaaaagaaaagaaagaaagaagtgaaggtttgtcagtcaggggagttgtaaaaccattaataaagataatccaagatggttaccaagactgttgaggacgccagagatcttgagcactttctaagtacctggcaatacactaagcgcgctcaccttttcctctggcaaaacatgatcgaaagcagaatgttttgatcatgagaaaattgcatttaatttgaatacaatttatttacaacataaaggataatgtatatatcaccaccattactggtatttgctggttatgttagatgtcattttaaaaaataacaatctgatatttaaaaaaaaatcttattttgaaaatttccaaagtaatacatgccatgcatagaccatttctggaagataccacaagaaacatgtaatgatgattgcctctgaaggtctattttcctcctctgacctgtgtgtgggttttgtttttgttttactgtgggcataaattaatttttcagttaagttttggaagcttaaataactctccaaaagtcataaagccagtaactggttgagcccaaattcaaacccagcctgtctgatacttgtcctcttcttagaaaagattacagtgatgctctcacaaaatcttgccgccttccctcaaacagagagttccaggcaggatgaatctgtgctctgatccctgaggcatttaatatgttcttattattagaagctcagatgcaaagagctctcttagcttttaatgttatgaaaaaaatcaggtcttcattagattccccaatccacctcttgatggggctagtagcctttccttaatgatagggtgtttctagagagatatatctggtcaaggtggcctggtactcctccttctccccacagcctcccagacaaggaggagtagctgccttttagtgatcatgtaccctgaatataagtgtatttaaaagaattttatacacatatatttagtgtcaatctgtatatttagtagcactaacacttctcttcattttcaatgaaaaatatagagtttataatattttcttcccacttccccatggatggtctagtcatgcctctcattttggaaagtactgtttctgaaacattaggcaatatattcccaacctggctagtttacagcaatcacctgtggatgctaattaaaacgcaaatcccactgtcacatgcattactccatttgatcataatggaaagtatgttctgtcccatttgccatagtcctcacctatccctgttgtattttatcgggtccaactcaaccatttaaggtatttgccagctcttgtatgcatttaggttttgtttctttgttttttagctcatgaaattaggtacaaagtcagagaggggtctggcatataaaacctcagcagaaataaagaggttttgttgtttggtaagaacataccttgggttggttgggcacggtggctcgtgcctgtaatcccaacactttgggaggccaaggcaggctgatcacttgaagttgggagttcaagaccagcctggccaacatggtgaaatcccgtctctactgaaaatacaaaaattaaccaggcatggtggtgtgtgcctgtagtcccaggaatcacttgaacccaggaggcggaggttgcagtgagctgagatctcaccactgcacactgcactccagcctgggcaatggaatgagattccatcccaaaaaataaaaaaataaaaaaataaagaacataccttgggttgatccacttaggaacctcagataataacatctgccacgtatagagcaattgctatgtcccaggcactctactagacacttcatacagtttagaaaatcagatgggtgtagatcaaggcaggagcaggaaccaaaaagaaaggcataaacataagaaaaaaaatggaaggggtggaaacagagtacaataacatgagtaatttgatgggggctattatgaactgagaaatgaactttgaaaagtatcttggggccaaatcatgtagactcttgagtgatgtgttaaggaatgctatgagtgctgagagggcatcagaagtccttgagagcctccagagaaaggctcttaaaaatgcagcgcaatctccagtgacagaagatactgctagaaatctgctagaaaaaaaacaaaaaaggcatgtatagaggaattatgagggaaagataccaagtcacggtttattcttcaaaatggaggtggcttgttgggaaggtggaagctcatttggccagagtggaaatggaattgggagaaatcgatgaccaaatgtaaacacttggtgcctgatatagcttgacaccaagttagccccaagtgaaataccctggcaatattaatgtgtcttttcccgatattcctcaggtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtggggtaagtcttacattcttttgtaagctgctgaaagttgtgtatgagtagtcatatcataaagctgctttgatataaaaaaggtctatggccatactaccctgaatgagtcccatcccatctgatataaacaatctgcatattgggattgtcagggaatgttcttaaagatcagattagtggcacctgctgagatactgatgcacagcatggtttctgaaccagtagtttccctgcagttgagcagggagcagcagcagcacttgcacaaatacatatacactcttaacacttcttacctactggcttcctctagcttttgtggcagcttcaggtatatttagcactgaacgaacatctcaagaaggtataggcctttgtttgtaagtcctgctgtcctagcatcctataatcctggacttctccagtactttctggctggattggtatctgaggctagtaggaagggcttgttcctgctgggtagctctaaacaatgtattcatgggtaggaacagcagcctattctgccagccttatttctaaccattttagacatttgttagtacatggtattttaaaagtaaaacttaatgtcttccttttttttctccactgtctttttcatagatcgagacatgtaagcagcatcatggaggtaagtttttgaccttgagaaaatgtttttgtttcactgtcctgaggactatttatagacagctctaacatgataaccctcactatgtggagaacattgacagagtaacattttagcagggaaagaagaatcctacagggtcatgttcccttctcctgtggagtggcatgaagaaggtgtatggccccaggtatggccatattactgaccctctacagagagggcaaaggaactgccagtatggtattgcaggataaaggcaggtggttacccacattacctgcaaggctttgatctttcttctgccatttccacattggacatctctgctgaggagagaaaatgaaccactcttttcctttgtataatgttgttttattcttcagacagaagagaggagttatacagctctgcagacatcccattcctgtatggggactgtgtttgcctcttagaggttcccaggccactagaggagataaagggaaacagattgttataacttgatataatgatactataatagatgtaactacaaggagctccagaagcaagagagagggaggaacttggacttctctgcatctttagttggagtccaaaggcttttcaatgaaattctactgcccagggtacattgatgctgaaaccccattcaaatctcctgttatattctagaacagggaattgatttgggagagcatcaggaaggtggatgatctgcccagtcacactgttagtaaattgtagagccaggacctgaactctaatatagtcatgtgttacttaatgacggggacatgttctgagaaatgcttacacaaacctaggtgttgtagcctactacacgcataggctacatggtatagcctattgctcctagactacaaacctgtacagcctgttactgtactgaatactgtgggcagttgtaacacaatggtaagtatttgtgtatctaaacatagaagttgcagtaaaaatatgctattttaatcttatgagaccactgtcatatatacagtccatcattgaccaaaacatcatatcagcattttttcttctaagattttgggagcaccaaagggatacactaacaggatatactctttataatgggtttggagaactgtctgcagctacttcttttaaaaaggtgatctacacagtagaaattagacaagtttggtaatgagatctgcaatccaaataaaataaattcattgctaacctttttcttttcttttcaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccacaagttaaataaatcataaaacttgatgtgttatctcttatatctcactcccactattacccctttattttcaaacagggaaacagtcttcaagttccacttggtaaaaaatgtgaaccccttgtatatagagtttggctcacagtgtaaagggcctcagtgattcacattttccagattaggaatctgatgctcaaagaagttaaatggcatagttggggtgacacagctgtctagtgggaggccagccttctatattttagccagcgttctttcctgcgggccaggtcatgaggagtatgcagactctaagagggagcaaaagtatctgaaggatttaatattttagcaaggaatagatatacagtcatcccttggtctccctgggggattggtttcaggaccccttcttggacaccaaatctatggatatttaagtcccttctataaaatggtatagtatttgcatataacctatccacatcctcctgtatactttaaatcatttctagattacttgtaatacctaatacaatgtaaatgctatgcaaatagttgttattgtttaaggaataatgacaagaaaaaaaagtctgtacatgctcagtaaagacacaaccatccctttttttccccagtgtttttgatccatggtttgctgaatccacagatgtggagcccctggatacggaaggccagctgtactttgaatgacaaataacagatttaaaattttcaaggcatagttttatacctgatggccagctttgtttatttgaccaagaatctgagttagctagttctaggtactgacaggataaataaaacacaacactgctcccgatcttctcagtttagcagagggacagatatgcactcaaataattaaaatatatcctgataagaatatagcataggtacgcgcgaagaacttggcaatcgaaattttgttgttcaggctgggcgaggtgtctcatgtctgtaatcccagcactttgggaggccatggtaggatgatcgcttgagcccaggagtccgagaccagcctgggcaacataacaagaccctgtctcaattcaaagaattgaattaaaaaaaacaaaaaataatttttttaaaaaagaaatgttgttgttcaaggaacaacaacaaaaatctagggaggtgttagagaagccatttgcctgagctgagagtaagttgctagtggttctcttgattggtaggtggggcctgggtttccaggcatggtagccaggaaggacagccacatggcaggtttgggtaattccaaacagtggaggaagggtgtctgggggaagacttgtaggaactcagctgaaaaaattgggggatgatactctgaaagaaaaacaaagttttaaaatttctactcttacacttaacacataatgcttctgtgaccggatatttaggggttttccccccacactctgttaggagaaaaattttagacagattaaatttaacagagtttaactgagcaaaaatgattctcgaaccaggcagctgccggagccagaataggttcaaaatgactctgggggtgccacatggttggatgacatttagggacagaaaaaggaaagtgatgtgcagaaaatggaagtcaggggcagaagcagccagattggttgcagttcagcatttgcctcatttaaacagggtttgaagagttggccacctgtgattggctgagactctgtggtataagagtaagttacagtctgtttacacatccagttaggttacagttcactatgcagagagaaatctttagcctgaacttacacagggaggcagttttatttatttatttaattttttttttttgagacaaggtctcactctgtcacccgggctggagttcagtggtatgatcatggcttattgcagcctcgacttcctggcctcaagcaatccttccgcctcaggctctagagtagctgggactacaggcacatgtcagcatgcctggctaattttgttttttaatttttagtag

SEQ ID NO: 15083 - DNA, 50850 bp, Human
  misc_feature (1)...(50850): n = A,T,C or G
agatcaagggcctagagtcaggaagaaacttgtctgaagttgagtcaggttcaggggaacttctaaggctgccttggtcagtgccagatgacttaaaatttccggaatgccatctgctaatttgcactttcttgtttttgcacatgttggtttctctgtaaaatatcctctcctctttgttttcctgacagtttccttattttgtttcaataatctgttcaatctttacctcttctgtgaggtacactcctggttactccatatcagttgataaggcacattttgtaccacctttttgaagcataatgttgactttctttagaaagcatattctgatgctttcaaaaagacccagccacctctttttgatcactttgtaaaacataaaatgtctttttgttacaggacttttcattagttcagctcaagatgaggtccttatcacacagctacgaaaatttaggctagcggacgatttgaggagtgaaaaaaatggaaaaggggggaaacacagactctccacaaaggcagagtccctgctggtgcgcttcccgcctcgcagtttgaatcccaggttccacacaggaagaggaggggctaagctcctccctgctgcaaaacccacaggaacttcctgagtttccaccccagtgcccaaggccagctggagtttttatggggagtccttcccacttgtctgcctcatttttgtataggatttacataatttcattgtttatacatctctccttcactctatctctcacatctctctctcttttttttttttttcagttgagacagactctcactctgttgcccaggctggagtgcagtggcgcgatctcagctcactgcaatctctgtctcctgggttcaagcgattcttctgtctcaccctcccaaggaactgcaattacaggcgcatgctacgacacctggctaatttttgtttgttagtttgtttttgggacagagcctcagtctgtcgcccaggctggagtgcagtggcctgatctctgctcactgcaacctctgcctcccgggttcactccattctcctgcctcagcctcccgagtagctgggactacaggcgcctgccaccatgcccggctcattttttgtatttttagtagagacggggtttcaccatgttagccaggatggtctcgatctcctgacctcaagtaatctgcccacttcggcctcccaaagtgctgggattataggcgtgagccaccgctcccagcctctctcatatatatctatatatgaaactctatccccactcatgatgtaaagcttgaagctaagtaagcactcaaaaatactttaaattgaataattaaagcaattttcacattgtgttaaaattttaataatatgtctcttcattcttgtctctgagtaacttgagttcattcatcttgtgaaaaaggccctagcaccttgtctggcagctgcttactgattatttaatgaacaaatggatgagtaataataatttataaagcaaaattatttttccagaaaagtaacaattttgtatcaaaacttggaatgtcatattaaagtccttaaaaattaaatttacttaagaattaaaagcctcagattttatgtttaaaaggtaactatgtcttttttccttcaactattaattttgtttttcacaaatggccaactcttttttttaaatgactccttttctcctagaatcagaaattgtactttgaaaatatactctagatttaacaattcaaatagcccactaacactgacaattttgatgtaaaagaatgattttcttctgggaaattttatatttatgcatttaaatttctcttgactgtttttccatgtacttcagaaagctgtgaatttttttttcagccttccacttttgtgtgtagttatcaagttttagctcatcaaactgctgaatttaagctttatctgtctaattaatattcttcagcagttcacagtcttcatttctcatttcaggttagagtacaaaacatgttttccctgcagtctcacgaactgtgaacaaaaactgaagtgaaaactcatagtgcataactcgtcaatactcctgtgatcgtataaccatcagcaagaaaacaaatttgattgagcccccatccagtcctctttgcgtggaatcagacctcttttgcagtggaaaggagcaggtaaaacaaataagcagaggcacaaaatcatcaccaaaccagactcactgaaatgccaacactggcatgtgcgcagacattttctattctggacttacttctaaacagcaatgccaacaagcatgagaggtgaaaaaatgtggataaatacatgtttggtttattgaactaggtcttatcatatccaaattaaaaacaaaaggcacatctcaatttcaaaataaggttctgaattttaattctcagattcattgaatttctttttgattcaaaattcaaactcttctatcgaatatatcctttagataaattgtctcccaaactcagcagcagattctccctttttcttgtagccacatgaatctatatattttcccgaccagagtctccatatatattgttgatagaaacataactttctattaacaaaaattgtttatgcatatctactaatttcttacattgtatttccaccaaccaaacataaccaagatcacacatatattcaatcttacactgagaataccttaaaagctaatattttaaactttgtaattaattctgtttgtctctattttcatttaaaaaaaatctctctcgttagtacctaccataatttatacccagtctctctctctctgtcacacacacacacacacacacacaagcacacatacacacagtgagagggagagtgggagagactgttttgaatgttttggttaattaactataatgtatttttctcatttgtattttatttaaattttcatatttactttcattgaaatgaaatatttttccacatttatttttattgaaatgacaatacatgaggccaggcaaggtggctaacacctgtaataccagcactttgggagggcaaggcaggtagatcacttgaggtcaggatttcgagaccagcctgattaacatggtgaaaaccagctctactaaaaatacaaaattagctaggtgtggtggcacatacccgtaatcccagctactcgagaggctgaggcaggagaatcacttgaacctgggaggtggaggttgcagtgagccaagatcatgccattgcactccagcctgggtgacaagaatgaaactctgtctcaaaaaagaagaaaaaaaaaggaatgacaatatatgaagttttcctgaatggggagaaagtataatcagagagtaaaaatgtaacaattcttagtttgtaacttcaaatattaggatctagtggtaagctacctcagtctatttgggctgctataaccaagtctgtatcctcacatggtagcaaggaaggcctcacaagctccctcaggcctcttttacaaagacattaatcccattcatagggccacagcccataggacccaatcactcccaaaggccacacctcttaatattatcacattggggtttaagtttcaacatatgaattttgggggacacatacattcagaccatagcataagccaagtaaggattttgagtgatcttttaggaagtgggactattttttcccatccttcttttcccctttgtccaaactaaatgaaaattttgcagtgaaaaaaggggaaagtctgaggaggaaaccaaagggctagacactaatgagatctgggaaagcagttctttcgtctcaaaattagccacagtatggaacgatgaaaagaaaggatgtcaggaatcaaagaatagataagacttattgtgtgttcatacctgatcatctaggaaacctaaaaatctccccaaatctcctagggccaggaacatggatttggaacgtcctcacagataggtcccatgtgatttggtcagataagaggagcaatctcacatttccttaactggcagagagtggaagttaaggaacagaaagcaaacggctctgaggatgttttgtaattgtgattagaagaatctagagaataaattagattggaccataaagttagtgagcagaatggggtctgggataacaaaaagctctctgcctgaaagtgtggagaataggatcccagcagaggacagagcacatccacagggcaggggctttgctccttcctcactatatatagtggtcatacaacctcttagaaaagaaaattctagagagaagtgaaagagaaacttctcgagctccctaagtgtaaatttgaagtgacaaagaatactgaaataattgagtttaacttgaattgtttatgactatctaacatgaggtggaaaaggagcttttgtgatatgttaaatcatagaaaagtcaagaagttacatgcctaccaagctctatttaaaaaaaaaacttttaggttcaggggtacacgagcatgtttgctatataggtaaacatatgtcacaggagtttgttgtacagaatatttcttcgcccaggtattaagcctagtacccaatagttatttctcctaatcctcttcctcctcctttcctccatcctcaaggagaccccaatgtctattgttccctctttgtgtccatatgttctcatccttaagctccaacttataattgagaacatgcagtatttggttttctgtttctgtgttagtttgctaaggatgatggcctccagctccatccatgttcctgcaaaagacattatctctttcttttttatgcctgcacagtattccatggtgcacatgtacctcattttcttcatccagtttaccattgatggcatttaggttaattctgtgtctctactattgtgaatagcgctgcaatgaacataggtgttcttgtgtctttataggagaatgatttatattcctctggggtatacccagtaatatgatggctaggttgaacggtgcttctgtttttagctctttgaggagttgccacactgctttccacaatagttgaactaatttacattcccaccaacagtgttcccttttctctgcaacatcaccagcatctgttattttttgactttttaataatagccattctgactggtgtgagatggtatcttattgtgtttttgatttgcatttctctaatgatcagtcatattgagctttttttcatatgacaagtctatttttaagtatcattagtgaactaattatgaagtttattaccttatatttctctttgatataccagcattattatgatataatgcatatatcataaagtttgtagtttctcatttgctgataatttcagtatcagaaatctcaaagagttttaattttaatctctatttcctccatatttaccattttctttctttgtatttttatttctattttttaatgtataatcttattgttcaaaacacttgggtttttctagtgtcaattgcaatcataatcttaactgatacaaattttaacgctgatattgcagtttaattttctataaccaaaactcttctttttcaattcatcttattattttttcactatgagccacatgtctgttgtgatatttaaaagtaacatatcagagcttcatccccagagattctgactcagatctggggtttcccatcttccgcaggagatgctgatgcacggatggaattgaaaaccgctgttgtagttaacttttcagggtctgtcagtcttttgtctagtgagtctgttcatctgaaatgggaccttcaatttggcccacagctaacttttctgatattataattagatgcaaaaagataggttaaaagagatataaacaattctctagtcccttagaaagctgtgaactaaagcaaaattaatacttttagttcatattatattacctgaacggatagaaagaaaaatggatacacagatgatagatagatacataatcaatagagataaagacatagtacatattattgtaactgtgttcatatattataggcatcaaagctatgaagagcgtgagctgccagtgttataaattttttaccgaaataccctagttttacaattgaggagcccttgttttgaaaaccagttaacttccttagataagatctctctgttgtcagttctcaaataaaataaagttatataacaatagaagggtctacatataatacaggatatgtcattagaaatgcattgaattcttatcaaatttcaaggtaccttcccatgtgtaattcagaatttattgttagattaaaatatgtaaataagaaaaacaacataaactcaataagcccatgtatacacaggacacttttgggacactatgaggtttgggaccacagggaaccattctcagagatcttcatcaagttaaaatgttctattttaaagtaaacctactaccccattcgtagtgaacgtctagtaagatttttttgcttgtttattttgttttttgttttgcctttttctgctttctgatacagttgaggcttaggtatttaggaagcaatataaaaattatccatatttacgaaataggcaagttaatctggttgacttaatctatttagaagttttgattcaatagattcccagtgctgcagtcctaccatttactctttccttcaaatacttaacacagtatttcacttcattattcattcagcaattattgaaaaggctgtgtgtctctgtaaatagaaagatgtagacttctgagtcagcaatttggggtttgctcctggattacatgaattacttatttatgtgaaggcttagtttcttcatttgaaaaatgggcacttctccaacaagtttgcttacgagaattatgtttgcactggtagaaacataaaaagtatgcctcagatattaactaaatagagtgaccatataatttactgtccaatctggatacttttgagaacaaaaggaggtcaatattaataagtacactgggacaacagttacaaatcacaacagcccagggcaaaattgggattcaggtcaatctaataaataatggcattgtagaccttcaataacagcaattcagtctctttcattgtattcctctgagagtagatagtttaaatccagcaatcaacttgcattgcggaaattctgtctctataatatcaatgtaatttcgacttgaattcccaaataaaagtaaaaagtgaaagaagtttttgagcagttttctttaccatgtagaacaaagaaaagtgcctaattaagattttgaaaggtcaaaagttattattattaatttatcttaatttttactgaacgaaaataaatttgttacttatttgacattttttggaacaacattttacgaagtttactactttagcagaatataccatttcctaaattgacttcctttatgttctattaccactgtaaacttgccccctcactcctcccctgccctggcaactcattataactttaaaaagttattttattttattgataaaacattgcagttaaaaactacctatgtatttgttctaagttgctcccacttgtatttgaatggnnnnnnnnnnnnnnnnnnnnnnnnnnnnnnnnnnnnnnnnnnnnnnnnnnnnnnnnnnnnnnnnnnnnnnnnnnnnnnnnnnnnntaagctcatatcactaagtgctatcctaggaggaaaaaatgatttggagagtgatctcgttcagtttaaaagagcatttttatgccaatatagaacaataagaatttatcatctgtgataatattttaaatataatgagttcctcttattccagagaatgtgactttcctgaacaacaggagcaagaatcaatgccagattctcttctctaaaaataatcaatttgttactacaggtaaattaatttcacttttttcacttcttagtacaagggggttttaatttctatcacaataaaacacacattttaaatagatgccgtgctatacacattgacacttacttgttgcattatgtagagaaccagtaaaatctttactcacaatttgccaataatttccatagagctttctttctcaatgaaagaggtcactaattccttcacttcacatcctaaagctagaatgaattgtgtcaagctgttagccgtctaggccaccaaaaagagttacgcaaatgatgatgtattcatttataaacactcctagctattttctcagctatcatcaattttccattctatttttaaaaatcatattactttgatatatttctaaagattcttactgttgaatcctaagttattttactctttttcagttgtcaaagttcaaaaacatctgacttttatattgtgaaaaataaccttttataaacctaaacatctgtagtcagaccaggccatctctcccatttcatcaggtgatttctcaaccagaatttctataccaaaaactacagtattctttaaggttctcaaacagatcatatttcctttcctctgaatgtcttcatacatgctgctacctcatttctttacgtaccctattcgcctggctagttcctaagcatttcaaatttcagagtatttttttgttttctcagaaagcattttctgagcctcggattgaagcagttcctattccttatccaaatcacattttatactttttcatataagaaggatctcagaatagcaattaattagtgcctgccacaccacttgaataaggtattaaaacattatgacaaattgcaatgttaaaagccaggagtgaaagaagcaagtgatacaggttagggcaagtttttcagaaattaatgatatttcattgtttgtagtccaacaaaagtgtgttggcagctgcatggtctcatgacaataatagatattagagatgatgaaagattttcatgactgcagctgaagaatatggggaaatattccgactagctatatctgaaaagacattggggacaatagattatttgaagggtctctaaatacaaatgaacatttcagcatgtggatatggccacaaggaaaattctaagtggagataacaaataagaaggaagatttaaatattaaaaaaccaagaaatcttggggcggggcaagaagtctactaggtagcatgaattatgtggaagatataaaactacagaatttggggaagttaactaaggatggaacagagagaaatggaatgggaatgtgaaaattctgttcctaagtccagtaatgctaccctaaaccaaaatattagagaagtagatgagcaattgagaagacttgagagtgaagggatgcatggtggatttcttaaggttttatttgtagtatcatttttatgaaggaggaggaaaaacttctgtatatacaaaagtgctctatgtttctctccttttttaaatattcagactttgctcaggtttcataaaataatgttttcataaaatgtacagcaaaacaaagataaacttatactactcagatgaccttgttttaagagatgcttgtgccaaatatgaattacaagatgatcatgagatcatctgaatatcttgactggggctcaggataagaaaacaggggattgttggtgtaatgttttattagggctgccattacaatctccacaaattggtggcttaaaacaacagaatttcattctcccaaaatgttggagttgaagagtccaaaatccaggtgtcggcagggaaaagctccctctgaagagactctggggcagaattcttccttgaatctttgagtttttggtggctcaaggaattccttggcttgtggcagcattactgcagtctttgtctccatcattatatgggtctccacgtggccttctctattatgtgaccatgtcttctcaccttctcctttctgataaaggcacttgtcactagatttagggcacaccataatccaggaagatctcatatcaaggtccttaacttacttatctgcaaagagtctttctgcaaagagtctttcttccaaataagagtacattcacaggttcctggggttaggacatgggacatatctttttgggagccaccatccaatccaccacagatagtagcacttcttttttgatcatagtactcataaagatatactttcttttccatttccttttctaagagcccacatcaaaacactgtctaattcatgaagtactgatgtcggctaagaagagactttaattacctcctccagaaatcatctagaataaggaatagtcaaagttttattattctggttcgaatattctgaaaataggacagaaaaatgaatcatcaaacaactggatattttcccctttaatatttcaagtatagatttcactccaagccagcatttgcaaataaatgccatttttatttttaaacaatttagaaaatattttatcacatacctttgagtgtaaataataaatgggttttggcaattgttcattagaattgagagatgtaaaataatttataatatttcattttgagttacgttcatcaattgttcacatttcctaaaatcaggacctcatggaaaaaataaaatttacctacaaaagcttaaaaggcagatcagatttcacaaggatggattatccaaataaaagacacaatacacctttagatggaaagaaacaaacaagcctgaggctaccaagtttatagttaactggtggaaaaatagccattttctcacatgattatcagaaacacaagactgatcacaagtcagtgttgcaaattttatgaatacaatctttcctttttctccctctcttccttctaccctccctcccttcctctctccttccttcctttcctccctacctccctacctttctccatcctttctttcttccttccccgcttctttcccttttattgaggagtcagaaacatatataaagggtagattttatatagttaggggtatatttcaaggcacactgtttttgctattgtttttaatatctcagggtaaagtggttagttttcttccagggctgtgggaagtgaagtaagtgcatgatcacacctcatggtggcaaaacaagatactagttttgctttctcagtacctcctctggtcaaagatttgttcacatcagcttatttagctacttttagacttggtatcattaacatgaaggtttgcttatttagagttatttatgtagatataacatgagatattaatagacaaaaccgcaatgttaacatgatgacaggcatatgatattaaaacttgagggttaacatatgcctatagggtccataaagtccctaatgttataattaaaactacttgtgtgagtcagaattatttttacagcctttatctgcttttttatacagatcagaaaaaagagccacacacagtatttttctcagatttctttgaagcctctctgactttttttcatactaggatcttctattttgccaacattccttgcctatttaaaagtgatattaattatttagtgacattaattatgtattctagaagcacttaatagacatcacttcacatgtgaagtggggtcttcttgcttaaaacagggcttataagacctatttaagtaatatttgactttaaatgtgacattttcagcatggtcatgattatacattccatttatccaagtaaagccaaataaaaaaagacaaatctattgacctatgaaaatgattatgcattcataactagtaaagggaatcagtcaagccttttagcatggtgtataaccattgttttaagtggtgtcatactcaagaacaataaatgtatgccattagttagaaaatcatcattaagtttttatgattaagtttctatgttttaatctgtagaacaaacttttatatggttattatttataaattcagggggtcaattgagataaaattctatttaccatgaatttgatttccatttgtacaaataagcctgttaaattaaggattatagatggtataaaaaagaagaaatttcaaattatttaatttcattctggtccacctaataattcttgttatcttggtcttggggtaaaggtagcagtgtttttaaaaacggacctgcttctggattaaatgaatcatggaaatcctgatgcaatcacctgatgtgtctgataaatgtcaggttattgtggtgatgttgtctaatacagtgaagcctgtctccatgggttggttccctatatcaaatttaaaaatgctgtattaatttgtttttacactgctataaagaagtatgtgagactggctaatttataaaagaaacaggtttaattgactcacagcttcacatagctgggggaggcctcaagaaacttacaatgatggtggaaggggaagcaaggcatgtctcacatggcagcagggagcagggacagtgccacacttttaaccatcagatctcctgagaactcactcactgtcatgggaacagcatgggagaagttcacccccatgatcaaatcaccaccaggtccctctcctgacaaatgaggattgcaatttgagatgagattggggggacacagagccaaaccatatcactctacccctggcccctcacaaatctcatgtccttcttacatttcaaaaccaattataccttcccaatagtccctcaaagtcttaactcattccagcgtaactcaaaagtccaagttcaaatactcacctgtgataaaaaaaagtcccttttgcatatgagcctgcaaagtaaaaaagttagttactttcaagatacaaagggggtagaggaattgggtatatttttccattccaaaagggaaaaattggccaaaacaaagaggctacaggccccacgcaattccaaaacccataagggcagtcattaaatcttaaacctttgaaatgatctcctttgacttcatgtctcacatcaagggcatgctgatgtgaggggtgggatcccatggccttgggaagctccacccttgtggctctgtagggtacagtccccatgacggctttcatgagctggcattgagtgctgcagcttttccaagcgcatggtgaaagctgttgggggatctaccattctggggtctggaggatggtggccctcttcttactgcttcactaggcattgctccagtgggaactctttgtgggggctccaaccccacatttcccctctgcattgccttaatagaggttctccatgcaggcttcactcctgcagcagacttctgcctggacatcgggacatttccatacatcatttgaaatctacgtagaggctcccaaagttcaactcttgtcttctgcacacccacacgcccaataccatgtggaatctgccaaggcttagggcttgtcccctctgaagcaatggtcagagctgtatcttgaccccttttagccacagctggagctggagtggctgggatgcagagcaccatctcctgaggcttcacagagcagttgggccctgagtctggcccacaaaaccatttttccctcctaggcttccaggactgtgatgggaggggctgctgtgaggatctctgaaatgccctggagacattttccccattgccttggctattaacattcagcttctctttgcttatgcaaatttctgcagtgagtggcttgaatttctccccagaaaatgggtttttcttttctaccaaatggtcaggctgcaaattttccaaacttttacactctgcttcccttttaaaaataagttccaatttcagaccatctctttgtgagtgcatgactttacactttcagaaaaagccaggtcacatcttgagtactttgctgcttagaaatttcttctgtcagatactttaaatcatctctctcaagttcaaagttccacagatctctaggccaggagaaaaatgttgccagtcgctttgctaaagtatagcaagagtgacctttgctccagttcccaatcaattcctcacctccacctgaaaaccacctcagctgagtacttcattgtccataccactattagcatgttgatcaaacgcattcagcaagtattttggaagttccaaactttcccacatcttcctgtctttttctaagccctccaaactcttctatcctctccccattagtcagttccaaagtcactttcacattttcaagtatctttatatcagcacctcacttccagtagcaattctctgtattggtccattttcacactgctataaagaactacctgagactgagtaatttatttttaaaaagaggcttaattgatttatagttccacatagctttggaggcttcaggaaaatgacaactatggtggaaggcaaaggggaagcaagtaacatcttatatagcagcaggaaagagagagagcaagggaggatcatcgctttccatcaaccatcaggtctctgagaatccactatcatgagaacagtatgggggaaatccacccccatgatccaaccacctcccaccaggtccctcccctgacacatggggattacaattcaagatgaggtttggatggggacacaagagtcaaaccatattaaggaccttctttcgtcctgaattggtttgttattcttttgatatttcttccagaagagtcaacttctgatctttgacttgtagcatgagccttaccacaaatgtacaggaaaaaaaaaaaagaagtcgttcagtgattataaaacctaatagttttattataataatacacactcattttatgagaaattattcaatggttacattaaaagtaagcatgtcaatttattgtccataattgcccccatctttgtacaagaacacgaaggtgcttttacttatactgaaaggtataccactgaaacactgttatatagtaatgttttattgtctataaataattataaatacaattataaattatatgttgttaaatataaaattataattaacagttataaataatgtggaatcaaaaagtaatagcaaaactttgaaagattttgaaatataaaataccacatagaaatcatgagatacagctaaagttgaacttagaatgaaatgtgtataatggcctacattagaaaaaaaagaaatcacccatctcaagaagtaaacacattcatttcaagaaataaaaactaagaacaaaaatccgaataggaagaaaggaaagatagtttaaaaaaattaaattgtttttgtaaactaataaaatcagcactctgccatctcactccccaagctgttgatgtcctttcatttctttccatgcatgggtggaatattatttttttctctttgttttattttcatttcatattcaaaacatggttaggaaatgtcagcattctagtctccttatttgtatttttttttaattaaacttttctttagcttcagggatccacatgtaagtttgttgcataggcaaactgtgtgttatgggggtttgatgtaccgattattttgtcacccaggtagtacgcatagtaccttataggtagtttttcaatccttatccttctcccaccttccaccctcaagtaagccctcatgtctgttgttctatcctttgtgtccatgtgtactcgatgtttagctcccacttataagtgacaacatgcagtatttggttttctgtttctgtgttagtttgctaaggataatagcctccagctctgcctatgtgttctcaaaggtcataatctcattctttttaatggctgcatagtattccatggtgtatatgtaccacattttctttatctagtctgtcattgatgggtacttgagttgattctttgctattgtgaacagtgctgtgatgaatatacatgtacatgtgtttttatggtggaacaatttatattcctatgagtatatacccaataggattgctggattaagtggtagttttgcaaaactgctttccacaatgccagaattaatttacaatcccattagacctgtataagcattcccttttcttcacaaccttgccagcatctgttattattattattttactttttaataatacccatactgaacatagtatctcattgtggttttgatttgcatttatctaattagtattgttgaactgtttcatatgcttgtttatccacatgtatgttttcttttgaaaggtgtctgcttatgtcatttgaacacttttaaatgggttgtttgtttttacttgctaatctgcttaatttccatatagattctggatattagacctttgtcagatgcatagtttgcaaatattttctccccttctgtaggttgtcttaaaaatttactttgttgatagtttcttgtgctgtgcagaagtcttttgtttacataggtcccaattgtcaatttttgttgcaattgcttttggcatcttcatcatgaagtctttgtccattcttatgtctagaattgtgttttctaggttatcttccagggtttttacagttttaggttttacatttaagtaattagtttatctcgagttgatttttgtatatggtgtaaggaaggggaccagtttcaatattatgcatatgactagccagaattccagcaccatttattgaatagggagtcatttacctattgcttgtttttgccagctttgttgaagatcagatggttctacatgtgtggctttatttctgagtgctctgttccatttctttaatctatgtgtctgtttttgcaccagtaccatgccattttggttactgtagtcttgtagtatatttggaagtcaggtaatatgatgcctcagctttgttctttttgcttagaattgccttgactatttgagccttttttgattccatatgaatttttcaaaactttttttctaattatgtaaagaatgtcattggtagtttgattggaatagcactgaatctgaacattgctttgggtagtatgaccattttaagaatatcgattctttctctccatgagcacagaaagtttttccatctgtttgtgtcatttttgacttctttcagcagtgttatgtaattctcatggacaaaatcttttacctccctcattagctgtattactaggtattttatactttatacttttttggctattatgaatgggattatgttcttgatttggctttcagctaggacattgttgttgtatagaaatgctatagatttttgtactctgttttgtatcctgaaactttgcttaagtactgtattagatctaggagctttggggcagagactatgaggctttgtagttatagaattatattgtctgtaaagtgagataatttcacttcctttttcctatttagatgccctttatttctttcacttgcctgattgctctagctaggacttccagtaccttgttgaatgaaattggtgagagagggtatccttgtctttttctcattttcaaggggaatgcttccaggtttttcccattcactgtgatattggctatgggattttaaagatggcttttagtattttattgaggatttttgcatctatgttcatcaaggatattggcctgaagttttctttttttgtggtatatcttccaggttttggtatcaggaagatgctggcctcatagaatgagttagggtggagtctctcctcaagtttttggaatagtttcattagaaatggtaccagctcttcattacacatctggtagaatttgtctgtaattctttctggtcctgagctttttctggttggtaggctttttattactgattcaattttggaactcattattggtctgttcagggattccatttcttcctggttcagtcttgtgacattgaatgttttcagcagtttatccatttcttctaggttttctagcttgtgttcatagagatgtttttaatagtctctgagggtttttttgtatttctatggggccaatggtaatttccttttcatcatttctcattgggcttatttggatctctctctctctctcttttattagtctatctagcagtctattaatcatatttattttttcaaaaagccaactcctgctggatttgttgatctttttatggtttcatgaatgtgtcagtttcactcagttcagctctgatttttattatttcttgtcttctgctcgctttggggttggtttgctattattttcctagttcctctagataacatgttggttgtcaatttgagatctaacttttaggtgtgggcatctagcactaaaaacttttcccttaacactgctttagctgtgtccagagattctggtatgttgtatcatagttttcattagtttcaagtaatttcttaagttctgccttaatttcattgtttacccaaaagccattcagaaacaggttgtttaaatccctcgtaattgtatggttttgagcaatcttcttactattgatttctatttttattgtgttgtgataggagagtatagttggtatgatttagttgtttaattttctgagaattattttatggctgattgtatggtcaatattagagtgtgtgccatgtgcagataagaataatgtacactgtgttgtacttgggtagagagttctctagatgtctgttaggtccatttggtcatgtgccaagatcatgtcctgaataactttgttagttttctgcctctatggtctgtctaatactgtcaattggaggtgaagtttcccactgttattgtgtagttgtctaagtctcttcatatttttgtctgacagagctaatttggagaactagtctttgaactctgggattctttcctcagtttatctatcttgctattaatacatatgaccatattatgacattcttgaagtgagtgttccaggtgtatcagatcagtttagttatatcttaagatggacatttcatcttttacctcctgtatagtttgtttgtattccttagattccttgtcttgggcttgcactttcctaaatcttgatgatccatctaccttctgaattctgtatctgtcatttcagccatttcagcttggttaagaaccattgctgggaaactactgcaatcatctgaaggtaagaagacaatctggctttttgagttgacagagttctcatgctggttctttcttatctgtctgggctgaggatcctcccatctttgaagttgctggcctttggatggggtattttgcttttatcttctttgttgctcttgggagtctgattgtggcagaaggtgggttcagtccactgacttcacttccggaggattttaggagtccaaagctcagctcggcactcctgggatgagtgctctaactctgatcagctggtactgagccccccagcttgttttttggccccttgaggttatgaacctggtgcactggaagggctgaggttttcctggtacactagccacaacactccaatttccaggggctgccaaccaaagtgctttgttgggacagaggcagtgggatctgtgcttgctcacatgtgccagcagctgcagcagcatggtggggtgcatgcatgttggctgggcaagggcatctagagggggtagggttgtcagcctctctgctagcacttgtgctgatagtggcagtggtgatgggggcactggcagagctgaggttgttggcacctgtgcacaagtttgtaccagcagtggtgatggcactgtgggggtgagtttcctggcatctgtgtatgagttcacatcggcggtggcaaagcagcatcacaaggaaggggtggctgggtgagcttgtgctggcaaagtggtaagggggccgtgagtgagtgcatgctggaaaagctgcacggggagtcttcagcgaggggaaactgggtgggctggtgtgcattggtaaggattagtctgctggagctttccaacagtcaggcatggtcttctggcaaaggagctataacgtgagcccccaggaactgccctggttgggtaaccgaggctgcactgcaagtggatgtggtcaggctggggccccaggagatgccagtagatggaggggcactcagtcatgccctcatcccatgggcgtgactgctctgctctgtccaggtcctacagtcaccctgaggctaaagtctcctagagttcctagaggagcatggcaagttttgggggatgagcatcactggccatgctccgctgaagccattcccatgccaaatcttctgaactacacaggctagagccctgccgtgtcatttctctaagcagatctttctgccagctcaagtgtctgtgggggtcaggaggtcttcttctgctaggattccagaggtccatgataagtgtaggtcactcctcacctgtgtgaattaccccttcgccaggagtcactgggggccaggaatgagtcctggtgcttatctaccctgtgcagggttctcagctttctccccattcagcccagcatttgtgtcttccccgtgtccactctcaattccttccctctgaagatctacttgtaggatgccagtctgccccgtatcacagtctcttggtgggagatgttcctcctggctgcagctagtcagccatcctgaatcccgtcctatttctgtttctgaaccaccattatccttgcacttcctgtaaaaatgcatccatcagcatttaaaataattgaattaaagctattaatcctttccccctcactttcctgtccttttccctcaatttctcatctttattatagtcctttatatcactccccatatttgttaaaatccttgtctatggattattaacatttcctacatataaaccccaaatttttcttgagagtttaaaaaaacacagaataactgtggatgacttaaccaataacctatcttggatctattcaacttcaaaatttaaaaacttcagtatctcattctgtgaccatagcctttaataagtaacaaataagcaaacaaataaaataagtaaaagtattgattttaccaggattctcttttcaaacctcttcttttctttacatatccctccattgatttccccactccatgcccatgatttaaatatcatttatatgttcatgtctctcaatcccattctttataggtaagcaccagaatagaatgtttcacaacttagtggaagtctccagtgtgataaacccataggacttccaactaaagcattcaacactaatcttttcatctccctggcaaggttcccttcagacctggaatcctatatattgttagtggcataactaacaacctggtctcccagtataagcctaggaacttttgaattctctgacttctctactggacataagtaaattcatttttaccctatattgactatcctttctcttttccattctcctaactattgctatatgtaacttctaatgtgaatttctgaaaaaacttccacacacattgcttacaagtaatgatttaaagtgtataacttaaaagactataaacatagatttcataagctataaaaagtccttctagaattataaatcatacacacatgcatgtgtatatatacatacttgatgtggtttatctctgttcccacccaaatctgatgctgaattgcaatcttcagtgttgaaggaagggcctggtgggaagtgagtaattacatcatgggggcagacgtcccccttctgttcatgtgatagagttctcacgagatctgattgttggaaagtgtgtggcactttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattacaggtgtgagccgccatgcctggcccccatctttattatatcatgtcatttcagctgtcatttccattctgccattatataactttccctcattttcaaaatccaccttaaaataaaaatcctcacaatggatttcaaaatatgcccccaatttacccttaaatgcattatttgaaatacctctgtattgatcttaagatgatcattgcttcttcatttcctattagatcttgccattccctaaattcttatcatcagtccttttccctctcatttcctgtattgtctcaaatcccatatctttgtcatttatattttgaagatgccaaataatttttatcttcaaaccagacacatgtttgaatccaataattttatgtttaacactgtggtctctctccactgaagttttccaggtatactttattctcgttaaggctaaaattcgttcttatttttttctcaacatttctccaatctttcaatattccattccagcaaatgaccaccgaatctgtttaattatccataagccagaaacatgggcttatacatatttacaattccttttgccttcatattgaaacggttattgaaattgtaaggattcatgttccctttattttatcaagcttgttctgcctttcacttaacacctgagtcactgcattagccttttttacacacatctctgttccaggcttagtatccccaatctcaggcagtcagaagggtaagtaattaagattggatctgtagtggctgtaaaaactgagatgatcatccatctcaggtaggttacatatttatatttatgaatgaatgaatgggcttggattaaatgtaatcattttgctcctatgtctgtttatttttgaatgctctatttctagtatattctgaaattttcctcttatttgaaaacttttaaagtaaaaataagtcatttttataatcacttaatatatgacagtagagatgcattttctatttcattcatgtatgttttagatttctatcataaagattttaaatgaaaaaataaacagcagcaaataaaactaataaaatgtatgttagtaatagtattaaatgcattttttttcaaaatgtaatatcagagatatcttaaataacagagctaggttgtcttgcttatctggcaagcaactgctgttataaacatgaatccaagaacaaggtatgaaatcatatgacatatttttgagctgaatgtatcaaatatctggctcattgaatcatgaattgtctgatcaggaaaggagaagaaaacaacccctactcctgacctagaataattcatatcctgtggtattaggaagatttaaaaaagaagaagaagacatgaattaacaaaaacaaaaaccactagactcttttaatatttgaatataagagggtactctgacacacagttattatatagctggaaagaggattttgagagatcaatattgtagctttcatcagcttattattgctatcaacaaacaattgttctgctttatcgagatgtttaagcattcttaaattattaggggcaataaagacaagcaaacataaagctaaacagaaaaataaatactcaaaatttcagctgtataagatctcaaaatttgttatgcattgtaaactgtcctatttgtaattacacttaagatcccagatcaattttattctgcatgtactttttgaaaaaagatcaaatatgtatattaagtacaaagttgcaaaagctaaaggttaaacttagttcattataagcctttactaaccctttattttctacctttccatatacaatttccttggaaattaccaaaaggaggaagctttgacttcaggaattgtttattctaccataatctttattggtttccttgcttcaattttcaaatctgcaattgaaattagatatgattgcctagctgaacttcagtaagatgcattttgattatgataccctctacttagaaacattatgttctttcctattgtgctcaggacagactatatgttttagacgaggtcttaagacacataataatctagcctcatgctatatggccagttatctctaaaatagctttaccattctcttcattatccctttggtacttgaagtcatatctcttactgagacgctttcttccatctcctcctcatcgatatttggtatctcattccttaaaatgtgttccgtctgtcaacttaagcacatacctttcccattccatgaaattctttgcagctacagtgattgttccttcctcaacatctatacaaattccattcaataatcaatttaatttctttaatgtatatatacttgtgtttcagtttaattttttagtaaatattcattcaaaatttctagagataattttattcattgcagctgtggcatataagccctaactatgaaaaatgtccatatctatatcttcaaattcctgttttaaaaaaaggtgtgtgtgtgtgtgtgtctgtgtgtgtgtgtttgtgagagagagagaaaaaaaagagagagaataatgaataagagctatagaatcactccctttataccatggctttgtgctcagtatagtcagtgctttgcatataatcattgtggtggtaatattagtagtttggcaacagaaaacacttgttttttctggccattgtactaagcatgcttcatgtgttaactctgaattctcctaccgtctctgtaaacacagatggaaacactgctgcatacaggtcctaggtaattagcctaggatatcaggctgtagattacatacttatcacactatgcactctccataaatagatgattttattaattacttagttaagcttctataagcaaattttccaggaaataaaccgtatgattcctaaaagtcatgttccatacatgtaacatgatgctttgtaaatcagcatagtcaaatatgaaagactgatccacttttcagtgttggctgaagttatttttacctttctttgcgtgcatccaaacatgcaaataatacttaagccattttcttttataaatcaataacaatgaaacacacaggcaacaattgcttcatatatgacagctaaattagcacctgattaattgcatttatgcgataggaaaaccatggaccctctcaacatctggacaaacagttcaatgaaagaactttcctcagttcagttctgtgtattcttttgtgttatgaataccttcaaaatataggttaatcaacatttattgagtactcactctgtaatgagcttaatgctaaggattatattattgcaaatgatattgttttatttcactgcctcctgttactcttatctgggtaccttagattttatctcttcacccactgacctgtacccagttggataaaatatcccccaaattttaatggccaaattgattcctccttctgctttaagatatggtgttcctctgccctaaaacttaccatttcagggacaaactgtttataacttagttgttgcaccagtttctgtgtatctaggagtaagaaataaagaaatcctagtaagttcctactctgggtctgctctctgctttatctaaactaaaactcagagaaaagaaaatacctacactgaagattcaagcagccaattaatatttttaatagatagagggctgtttgggtacccacaacacttattttcttacactccttatgagttatttttggaatttttcagtctgtgtattataattaatatgaatctatctttctaaaaatataattagatcagaatgaatttaaattgacctgaatttaaattgacaaggtttaaaatgtgcgatatttgtttctgtataatattttgaaaaggcatttggtgatgatgcctggatctgattttatgagcttttgatcttacaagattcactgctcatggatcacagctttgccagtattctgagtatttggagattttctagtcatctttctgttatagtttaattgtattgtagtctgagaaaatattttgtatgatttagattcttttaaatttgttaagctagatccaggatgtgatctaccttagtaaatattctatataagcttaaatatgtgttttgctgtttttaaatagagtgttctataaacgtcaatttgataaaatggatcaatactgctcttcatttcaaccatatccttgttgattttttgcctgctccatgtcaattactgatgggggggtggggaattatccaactataatagcaaatttgtgtctttctcttttcagttctatcaggttttccctcaaatattttgatactgtgttgttaggtacataccagttaaggttgtgttcttcttggagaattgaccttttttatcattatgtagttacccttcttatccctgacaatttcccctttcctgatgtcttcttgtctgaaatatactttggctttctcttgattagtgatagtatactatcttcctccatccttttaatttgtcataatctttacatttaaaatgaatttcttgcagacagcatatagctggggcttgtaatttatctaggctaataattattgctattttaccgatgtcattagacatatttaaagtgattactcatatatttatgttaaaatgcaatatatttgtaacttttctttcattacgtttgttctttgttactagtctctacctcttgttctactttttttgttttaattattttatattattccattttatttggcacagtagttacacttcatttttacatatctgtaggtgaactaggttttataatatgcattgttaaataaagttagttcagcttcaaataacactatattttatttgtagcataggtaccttgtaacacagtgttccacattctcccttctgtcgcttctgatgttgctgtcatcattattttacttacttatattcttgaattacctaaatgtattattagtattgctttagataactaactgttagatcagttaaatacaagacaaataaaatatttcactttattccttttctgatgcccttttaaaaatgtagattcaagattctgacttatatcatttttcttcttccggaaaaactttttttaacatttcctgtatgacagttctgctgtcaatgtcattagttttggtttgagaatattacttctcctttatttttgaagaatgatttttgtggatgtagaattctaggttggcagggattttttttctccctcaatacattagagatttgataatcttcttgttttcattattttaggggcgaagtcagctataattctaaacttaattcttctgtaagtaaggtgccccttaccagcttccttcaagacctttttttttgtttgttttactgcaattgaaataaaatattcctactgtggtttgtgtgtatgagaaagactgtgtgtgtgtgtgtgtgtgtgtgtgtgtttgtgtgtttgtgtgtgtctgaatgaaatatttaccctgcttggtgttttctgagtttcttggtttgtggattagtggctgttattaattttgtaaagttcatggccattttagttctcatttactttttttctctagtgttttcttataaatttttaatatttctccacagttcctgaatattttgtttttaaaatcttttttcttctctttgtacttcaattggtaaatttctatcttcaagattgccgctagcttcgtttattattttcttaatagtgttgagtctactgataagttcattaaacacattcatttctgttactttaagaaagttttctgcattttattttttactttttcttaatgtagccatgtcaatgtgtcctgaagtagttggtgtaagattcagtttatacatttcttatgagattttatagaattcagtgtgaaaactacctggggctgcgttttctttgtaacaatgatttttacaatgaatccaataaaagactactcacattttctgtttattcttttgtgagtttgatgatgtgtttttaaaaataaacttatcatttcacctaagtattcataaaggtgttatgaagttgtttataatattttcttattaacattcaagtgtctatgtgatttatagtgataatctttctatccttgatattgataattttttgctcacttagtgttttctcgaataatatacctaggctactatcaattttcctggtgttggaaataataaactttggtctgttaatttttttcatcactttttagtatgaaatatttactaattttctttgtgattcttcctatcattatggattatttagaagttgtttaatctccaaattttaagtatcatatcttattattacttatgacaaatttaattattatcaaagtatattcactgtataatttcagttttttaaaaagtatttagatttgtttgattttttatgtggactttgtgtatgtatcatctgcagggagttttctgtattttttaggtatattgttctacaattctcaattaaatcattctggatgagaagggacctaagaatatttacatctttagtagttttttctctaattgctctatcaaatgctttgtgagacatgctaaaatttccacgcttgctgttttggacgcctctttgattctatcactatctttctcgtgcattttgaagctctgttattaagtgtaaacatatttgttaaacaaggtttacaggagggcattgttttgcactaacttcctgaactaggtctcatcaaaccaggccaaaccaaaatggtgtaacttatactatgtgcaaggaagtaggtagatccccaaatagaccagttttccctgaagacaggagattcatagcaaccaatcaaaaagagcccagtctacctgagtcagtgtgataagaactgtctcctttgcttcaaccttacaagaaaagtgacctgtagtaactttacgttaactgatctgctttctaaaattgttctgccttcttgctcctcccttacaaaaaccaaccattctggcatggcctgtggaatattcattctattttataaaatgaggtgtttcctgattccagaattaaaaataaaaaataattatatctttatgttaaatttgttgtaatattgtcttttgacacatttatgatggttattttttataaacttctcattatattgctagaaaatatccctttttacatacagtaatacattttactctgaagctcatcttatttgatattatgatatatttatctataatagatattattcattatatagttgatatattattgataatattaaatatgagagttctcttatatttcacctttagacagtgaaactttatgctgcaggtttagttaatgactcattataaggaagtaagaagtaagtctaaaattataatgacccacatagttacaatgactatcttgtgattctaatgcttttagtaatcatttcgtgctcattagtacaaatgagaaagattccataccaagctaaaaatttaaaaactaagttttagtttaaaagaaatatttaaaaatcatttctcgttattactacattagatacattccaaatttaaaacaaacatacctaagaaaaaaagatctaaaccatttcataataagaaataaaacaagaattagaaaaacattttttatcactggctttcaaataagttatatgctaacagcaattctttcttgttttaattatcatgatgaatttgggattactgtattaccatacagcctatccagtcagagcacacactttgcttaaaccttaccaactccataaagatttcactggcttcttcatctttccttcagacactttctgtctttaagaattatggtgaccttctccaattaagaattatatagtgttctgtattttttctttctattaattattatattttaagtggtgccatttttatagaaacattcatagcaagtagtatgtatgttgtaatagaaagacaaggaaagaaaataaaaataataatttgatatgtaaacttttaaagtaaatactgattaacttcatatgtaaaatttgcataaacttttaaagtaaatactgattattaacttcatatgtaaagtttgcatctgaaattatcaattcatgttttctatagctatcatgttaaaaagatttacagttagaggcctggtgcagtggctcatgcctgtaatcccagtactttgggaggccggggcgggcagatcatgaggtcaggaaatcaagaccatcctggctaacacggtgaaaccccgtctctactaaaaatacaaaaaaattagctgggcgtggtggggggcgcctgtagtcccagctactcgggaggctgaggcaggagaatggcgtgaacccgggaagcagagcttgcagtgagccgagatcgcgccactgcactccagcctgggcgacagagcgagactccgtcacaaaaaaaaaaaaaaaaagatttacagagtaggagtactttcaagacattgtgcatcagagtgactgtaactgatgacaatatattgtattcttggaaaatgctagagtggattttaagtgttttcaccacaaaaatgataactgtgttaggttatacatttgttaaatagctagatttaaccatcccacaacgtatatgtacttcaaaacatcatgctgtacacagtaaatacatacagttttatatgtcaatgaaaaaaataaatttgaaagaaaaaaaaactttgaattacttgattcaacatttgtttgtattaattaatcatgatttcctagtatagtgaagagcaatttagtgttgataattgagtcaagcacgaattatcaataaaataacatgaaaaattattagaatgctctaccaatgcaaaaatgaagctgttaccacccaaatccactgaaaaactttagcatctcagaaagtaagacaattagtgttttgtgcttcctgatgaaattcagtatgaagtacatgggacaatctatgaggtagtctcattaaaatacttggcctgaatctaatcaaaattctaagattaacttccatgtacatgggaaaacacataataaggaaaaaaaatataaatgcaactaaaaaatagacagacacattaggatatggtacattcaaatggatggctaacagggtgagggggacaaatctggactgtaagaaagttaagagacacatcaaatataaatgcaataggtggtctttatggatcctgattcacataaacacacggtgtaatttttatgatatcagacaaatttgattattgattatgtgtaaatttatataaaggaaacacttgataatttttcttgaaaaatactggctttaccattaagtaagactgtgtcctctgttcagagattcagtggtaaaatgacatgtggaatttgctttaaaggccttagcaaaaaaaagaatgaagggatgcatataaaccacatatagcaaaatcctgataagttgggaaataaagagattcactgtactttcctcactactttaaatatatattttaagttttattaaaattttgtatagtataatattttcactgacagaaacagaatgaaaaacttgaaggacaaatagtaaaggtttttttattttttttctgagatggaatcttgctctgtcacccaggctggagtgcagtggcacgatctcggctcactgcaacctctgcctcctgggttcaagcgattctcctgcctcagccttcgagtagctgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggggcagcacttctgcctccatggctctgctggtcatgggccgtacccccaaggatttatggggcctggtagctggcctgggttagtcaagatcatgtccctcactctttgagaccaaagaggcatccccaatgatctctgaattgcctttgggataattcttccattctcttgaagaatagcatatatttgtagcagaatggcaaaataattcagtcctaaaaatagaaatccaagagctttccttcatttcatcccatcactttccctttcagttcaaactggtagtgtgcctgctcatataatcctgtgtgtacgttttcctgcatatatcgcccatctaagcactttgtgtacatacttgtatagaaaatttaattgtgctagctttcatttgtatgagtttgctagtgcctcccttattaaaacttattgcagcttcacctctttctaagataattcaatagaaagccatggaacttctaacatttttgagtttgttttaaatcagaagcccacctctgaagttttgaaatagtgaatcaaaggggcttcaaactgttaatttatttttcttattttattctctcaacattctaattaaatgtatatgtaaacttgttcatctcaatcattgaggtaacaagatttttcttttattatctcttcattttattattattattactataaaagcagtagtggtggttacctgaattagctttggtacttggagtttctaagaaatgtgtctgaatacttcatttatatcctgtctaccctcttttgctattttccaaaatttgttaagttgctcacaaagtggctctcatatattgcttcatttaattcacatcctttaaaaatctgtaatatttcaaaatgtgctaatttccttcaaaagcttttgacccaccttaatggatttgatgatgaaaggggaaacactgcacatagcaagaaatggtatgaaaggaaaagcactggatatttcctgagtttggtaataactagtgcaatttatttgcaatccctatgtattaaaacagtttggctcatccaagaaggtactgcagttctctagaattaagtcctgtcatgaaaccgcttggactcatttaatgcttattgattttcataaacaaacactgaattgttgggtggttaagacaaaaacaatcgcacaaactgatatgctttctccagtatagatatggtttctccaatacagacacccactacttggaatgtcttcgtttcatggccttttcttctgatttaatactcacaaattatttcttcccagaataattttgctatcaaatacctaaaatcttaacagaaactgaattattttgttcattatactcgctttattatttatttgtcaattcctctataaaaccatgatttttccttcgtgtttctttctaagtacattgcaggtgtcagtacacttgcctttaaatacttcgtcatgaacaccatgagctagatctgaattttgtttagctttttcttttgagttaaaatatacatacaatgaattacactagacaaagtgtgcattcactgtcatttgacaattgcacacacctttataatccaaagacctatcaagcaggaggacttaagcaagtgcatcagtggccctctggaacagctctagcttactgtgtttcagactacatcggggaaggattaaggctctagcactgcagcaggaagttaaatgtctgcagtcacactgcccatgccaactgtggatcagatcttctggccgtggggtccaatgcattgcaaaggactggatcttgtgtacagtgtctctctccactttttgtacgtaagcactttagacttgaccttagtgtgcatgttttttgttttcagcaatcttgaatcatgtgctggtttcttctctgggtggcaattatctgcttttaactttggccacattcatgtcatgttctattctgcagcacattctgactatccagtgaatagggaaataagtagcataaataatcaactttgtacttctttataaagattattgtggatattcctaggtactttgaacattcatataaactttaaaatcagtttgccactttccgcccacacacacacacacacacacacacacacacacacagcttaatgtaatttagatcgtgtttgtcttatatctgtaagtcaattaggaaaacaaaattgccactatcatagattgtcttcaagtattagtaccttgaattttatgaaattcatttcctacatttaaactcacataaatcctctctacatcattgttgctattcgtgtttttgcataaggggattggttctagaaaaaaaaagaaagatgagaggatcttcaccctagaaaattcaacgttcacaaagactttccatcacatagtcagatctgtcattagaaaacttagtctcttattttccagtattggaaaaattaacatcatcttcttcttcatttttcttttatttatttattaaaattttttttattattatactttaagttctagggtacatgtgcacattgttgaagacagtgtggcaattcatcctcttcatttttcttcatcaccatcatcattgtcttctttataccattatatattttaaataaaattacagaaccaaaaacaaagtaaaaattaaaaaaaacttctacataggatgtcagaatcctaactactaaaatgaattaaaattgaacctattttcaatgtcttcacttaaaaaatatctttttttctgattataaattgaatttatatgtatttgaaaaaaatttttagaggaaggccttagaaagaaaatacaagtaacaattaaactcacaattccagggaaaaccaatgttaatatttgtgtgtacttcacagtaaactatataaaataaatgaataaaaatataggaatatttatagtaatgtacatacataaaagaatgctataccaacataattttttaaagttaaaattaggttagttatttttatcatgcttttacatttcaaaataaacaccaagtattttgatgtgtcagttaatatcctttgaaaatataatttatactaattacttttccatataaaaatgaaatatcattaatttatttacccaaagttgagaatctttacatatttttactattataaataatgctatgatatttttcccataaatatttgattaaattacttaatattactctggaataatttcttaaaaggaaactctggatcttgaccatattgccacattttctctgcagtgtggggcttgatttatcattctatattctgtattagaaggcacctgtctccacatcctcactgactgttaagtgacaccatgtttatattacaacaccttgataggtacaagaaaaaaaaaatatggaccctacattcctggaagaaaaattcacagaaagagaatatacacagattaaaagacaataggattagttattaagaagatgaatacaataaagaggatgaagtgggtggaataattgtctcccagaaatgttcctgtcctaatccctgaaaccgacaaagattccaatttacatggtaaagtgaattaaggttgcagatggaatcaaggttgtgaatcagatgaccctaaaatagggagatttccctgtattataccgtgagtccaatgcaattccaaaggttcttataagcgaaggagggaaacagaagaggcagagtcaaaatgaagtgatatgagaatgatttgacctgctacctcaaaccacccttgaaaattgaaggaataagtctatgagccattaatgtgggtggcttctagaagctggaaaggaatgagaaacaggtttttcccttttaacctccaaaaagaaactcagtcctgctgacactttcgttttggccaatgaaactcattttagcctccagaactacagaactataaggtaatacatttgtgttgctttaagacactgagattgtggtaattttttacagcagccataggaaactaatagaaaagctaaaagaaaaataaacatgctatggtagtattaaaatctatattgttgccaaaacattccatgaaaatccctttcatagtgttatcttacgatccattttatttctgtggcatctgtagtaatgttgcctctttcatttctgatattgagtcttctttttttctttatctagctaacatttatgaattttgtttgtctttattttaaaaactgcttaatagtctattttaagctgataagttcaatagcacacagaaactctagaataatctctgcagtcacacacaggagctctaacaccctaccccacactttattttattggtgctgcaatttacatccattcatatnnnnnnnnnnnnnnnnnnnntacaataacatatttgtaatgaataaaaaataatagtcatttatacaccactattgcagtaatgcaatatctgtatctgtccctatacttacctttattgtcaagtttcatactttcttatgctatggtgttgctgtttagtatcccatcatttcaacttgaagaactccttttagcattttttctaagacaggtaatatactattggtgatgatctctctcagattttgtttattttaagtagtttttaatctctcctccactattaaaggccaggtatagtgttcttggttggcagtttcttttcttttagaactttgaatgtatcatcccactccctctggcctgcaaggtttctgctgaaaattcagatagtttcatggacattttcttttatatgacaagttacttttctctttatctcaaaatacactttgtttttgactttttacaatgtgattacaatgtgtctcaatgttgatttgtttgagttcatcttatttgggaacttttgggcttcatggatctgaatgtctattgccttcctcagatttgggaagtgttcagccattatttctttaaataggctttctggccccttctctcttctcctctgatacttccttaatgcttatattggtgtccttgaagaggtcctatcagtttcttaagttttctccactcatttttgttctttttactctactgactgaatcatttccaatgatatgttttcaagttcactgattgtttcttctgcttcgcctagtccattgctgaagctctctattaaataatttaattcagttattgcgttcctcagcttcaagatttctgttttggtactttaaaaatattttctatggctttgttgaaattctaacttttttcctgcatttttctcttgacctccataaacatctttatatcatattttgcattctaaatgaagtaaatcatataatgatgtttcattagggttggtttctgaagatttatctcttctttctttgtttggaacatctttgcctgtttctacgttttccttagttatctgtgttgatatttgcacattagacacagaaggtcatctctcagtctttacagactagccttgtataggaggaaacctccaccaaccagcaaagccagagattctagtccttctaataactctctctctccatgaaaagaagcaggtgtgatttttgtctactcctctgtgctgacctggggtgggaaactattgtatcaaccagtccaaactaccatttctattaatcttttatcccaggtgtctagactgtaccagacccatcagagatccaagagtggcaagtctcttaccagttctttgtgtagtcctggagaggttgggtgctgggctcatgatcaattcttttcttctctagaagaaagctgacacttgggatattttttctgcttgctctgtgctgagcaggagggagtatctatggtgtccaccagcactagcttccatctattttcttccctggtggctagactgtgataggcctctcagagctctaagactggtcagtaagatgccagttctttggagagccctggagaaatttgggtgttggatgcaccagtcaagtcttccacacccttcccaatcccaggagaaagctgagagctggaattttttgtctgctctctatgtactgagaagtagggaagatctatgctgtctaccagctcaagccccatctccattctcccacaggtgtctagactgtgccagacccattcgagctctaaaactagttagatagatgctagatcttcaggcagccattgaaaagttggagtgtcagatacacagatcagcactcttcctccacagcaggaagctgaaagctgagatttcttatctgcttactgtatgccaagaagttgggttatgggggggcagggtctgtggcatccaccagatgaaaccaccatctccatcctctgcagaaagctagattgtggtagaccagtcagagctccaactgacagaagtaattcgtgtataaaggccctttaaaaattttggagtactggacacaaatcaatctcttccaatgactgggtgaagctgggaactaggggttctctttctgattgtatggcagtacactggggacagggactccactgagaggatgttctgaatctccctaccaactttggtaactctgatttttcattttcccaggatgtggtagtcattcaattagcttcagaatttcttacaaagataatttgttcaaattgttgttgaaatatgttctggggagtaggacggtgcagaacttcccactctgccgttttgctgatgtcactctgtaggagatgcttgatcctatttaaactttctattttagaagatagttgcctttctatgtttagagtatttatattctggtgtgcttttgtgggctgagttccaaaaatgtttaattttgatagctctttcaatattattatactttactttgcttttttaattctgaaggggtttcagctcaatcattgctggtgccatctggggcagaaggccctttctaggccattcaagtcattgggccactttgacgcctgaagatggaaggaacaaaaacaacgaggctttggtcttcctatgtcatttgatagagggctaggaaatatcaagtttgatggataatacttctgtggctcattcaggctgcatttcactggccttattctacagcagggttgtatcagctaggtaggccttcactgatgcctctgaaggcagatcagttagctagttacctggttatcgaatgacggttaggttagtcatccagtgctgtgatgttgccaatatgggtggaatggacagcccaccagtgcactgaatgtggactgtgtttggtgggcctgccaagtctgaaatggccactgtgggtgaatcaacacacacatgtgtcctgactccctgactctaaagaaggggctggagcaactccccatgtctttgccgagcttttccattcttagtcatttggccagaaagtgaaagcttttctttagctattattgttattatttttgtctatgcctgttggaggtttggggttaaagatctgtctagcacccagtttgggatatacatgaaagataagaagaaactcagataactgaccttcctcaagtccaaaggtcactagtcagaatttttctttttattaaccatccttctattctctatgtccatgagttttcagagtctttttgttgttgtccattgacttgtttcagagtattaaattgtatttagaacgaaggataaggaaaaactgaaactacaaaactttgttccagagcatgcatttatcatagatgttgaataatgttcttctttaaaaacataataaagtgtaaacatattttgagtaatacttatttcactccaagaacaatcagcttcaagtcaaccattatttattacataaagaattaaaccaggcattatatgagacactaatatttgtgaaagatgcaaatgatgctcttgaggatcttcctgctgacaaggctagtgagaagaggaagttagcgaagaaacagaaaattaaataaatattgtgccatagaaaggtatatgataagaaccaaaaatttaaaataacataagaatggtttttaaaaatgtctcttagataatgttttcaactaatttatcatctgaaatggaatagaaaatctattaatgcttatgacaatttaacacgtgtaaattgaaactgtctcagaaattgaagatataagttcagcttacccttaaaaaattttgtttcaattattgtggaaatatttgcaaataattacatatttaaagaactgtatagtgaatcaatttcccaccgtttatattcaataactatctgtgtatggccaagttttattttctgtacactccctattcccttttccctatcaatatttcagagcaaattctaggcaattttttgagtcattccttgatgaaagcactaatcacttttatctcatgtttttttctctttctcctcttccccactggattctcttataagaagaatttctgtacactcatccacatgctgctttttgttttacttatagtgctgcagctctgatggttcaactctgccaaaagatggatctttaatgattagcactacacactgaccaactcagaagaaggagccacaccacctgtgactccagccctgacttctgctctggaccagtgtttccataacagggacttcaaaatcactgtgatttgaagcctttttgaacatgaagatgttactcctgctgcattgccttggggtgtttctgtcctgttctggacacatccaggatgagcacccccaatatcacagccctccggatgtggtgattcctgtgaggataactggcaccaccagaggcatgacacctccaggctggctctcctatatcctgccctttggaggccagaaacacattatccacataaaggtcaagaagcttttgttttccaaacacctccctgtgttcacctacacagaccagggtgctatccttgaggaccagccatttgtccagaataactgctactatcatggttatgtggaaggggacccagaatccctggtttccctcagtacctgttttgggggttttcaaggaatattacagataaatgactttgcttatgaaatcaagcccctagcattttctaccacgtttgaacatctggtatacaagatggacagtgaggagaaacaattttcaaccatgagatccggatttatgcaaaatgaaataacatgccgaatggaatttgaagaaattgataattccactcagaagcaaagttcttatgtgggctggtggatccattttaggattgttgaaattgtagtcgtcattgataattatctgtacattcgttatgaaaggaacgactcaaagttgctggaggatctatatgttattgttaatatagtggattccattttggatgtcattggtgttaaggtgttattatttggtttggagatctggaccaataaaaacctcattgtagtagatgatgtaaggaaatctgtgcacctgtattgcaagtggaagtcggagaacattacgccccggatgcaacatgacacctcacatcttttcacaactctaggattaagagggttaagtggcataggagcttttagaggaatgtgtacaccacaccgtagttgtgcaattgttactttcatgaacaaaactttgggcactttttcaattgcagtggctcatcatctaggtcataatttgggcatgaaccatgatgaggatacatgtcgttgttcacaacctagatgcataatgcatgaaggcaacccaccaataactaaatttagcaattgtagttatggtgatttttgggaatatactgtagagaggacaaagtgtttgcttgaaacagtacacacaaaggacatctttaatgtgaagcgctgtgggaatggtgttgttgaagaaggagaagagtgtgactgtggacctttaaagcattgtgcaaaagatccctgctgtctgtcaaattgcactctgactgatggttctacttgtgcttttgggctttgttgcaaagactgcaagttcctaccatcagggaaagtgtgtagaaaggaggtcaatgaatgtgatcttccagagtggtgcaatggtacttcccataagtgcccagatgacttttatgtggaagatggaattccctgtaaggagaggggctactgctatgaaaagagctgtcatgaccgcaatgaacagtgtaggaggatttttggtgcaggcgcaaatactgcaagtgagacttgctacaaagaattgaacaccttaggtgaccgtgttggtcactgtggtatcaaaaatgctacatatataaagtgtaatatctcagatgtccagtgtggaagaattcagtgtgagaatgtgacagaaattcccaatatgagtgatcatactactgtgcattgggctcgcttcaatgacataatgtgctggagtactgattaccatttggggatgaagggacctgatattggtgaagtgaaagatggaacagagtgtgggatagatcatatatgcatccacaggcactgtgtccatataaccatcttgaatagtaattgctcacctgcattttgtaacaagaggggcatctgcaacaataaacatcactgccattgcaattatctgtgggaccctcccaactgcctgataaaaggctatggaggtagtgttgacagtggcccaccccctaagagaaagaagaaaaagaagttctgttatctgtgtatattgttgcttattgttttgtttattttattatgttgtctttatcgactttgtaaaaaaagtaaaccaataaaaaagcagcaagatgttcaaactccatctgcaaaagaagaggaaaaaattcagcgtcgacctcatgagttacctccccagagtcaaccttgggtgatgccttcccagagtcaacctcctgtgacgccttcccagagtcatcctcaggtgatgccttcccagagtcaacctcctgtgacaccctcccagagtcaacctcgggtgatgccttctcagagtcaacctcctgtgatgccttcccagagtcatcctcagttgacgccttcccagagtcaacctcctgtgacaccctcccagaggcaacctcagttgatgccttcccagagtcaacctcctgtgacgccctcctagagccaacctcagttgatgccttcccagagtcaacctcctgtgacgccctcccagagccaacctcgggtgacaccctcccagagtcaacctcatgtgacaccttaccggagtaaaagtggtaaacaaaagcaatcagtaccaattccaaaaactgtatccagaaaaggtacattaaaaaaataattcctagtatgtttctacttactcttcattgttttaaataatttgaacgtttattttttctgaaaaacttgacactttgtatttcctaaaaaagccatggcatatgtgtggcataccaatttttaacttgttgtctttcagcttccaaatcctttcttctttttcactctactttataggaaccgtatctctgctaaaccagacctcatcctatagagttttgcaacagggagaaagaataggaaattagaaatctgggagatctgttttcttcgtttatcagtatttcctgaataataggttttacactggtaacaatacttgattttaatctccccctactttttaaaactcactccagaaaaacttcattgtctgctgtctgctgtgttacactcagggttctggattccagttctttgagctctatgcaaatgtctcaaacttccagcactggctgagcaatacctattgttagaattctgagtgtgagatccatggggccagtcctaccatcttccaggttcagctaactccagtcttttccatttgctacttagcttcatgaatggaatcatttttttgcaattagtagttcatatttagtagccaattagtagcgtggtgtctaccttaacttgttctgttcttcaattgctgtttacccaattacttatatttaattatgtccctccaaaatcactcatgtggtttccctttttctgactaagctctttatagtactaatcttgatataaggatgaagcaggagtgagaaggcatcttatgctttattttttaaaatttacttttaattttcagggtttttttttatcattgcccttcactgtctctggaaaattacttaaacttatagacagtttacctcaaaataaggtgggataataataacagttctctttcaacttctgggttcctctggttataaaatgccatgaagcacagcactatccacagcagcaaagacatggactcaacctaggtgcccatcaatggtgaaatggtgtattagggttctctagagggacagaactcatggaatacacacacacacacacacacacacacacacacacgagagagagagagagagagagagagagagagagagagagaaaggggagtttattaagtattaactcacacaataacaaggttccgcaataggccatctacaggttgtggagcaaagaaagcccatccgagttccaaaactgaaggagttggagtctgatgtttgaacgcaggaagcatccagcataggagaaagatgtaggctgggaggctaggccagtctctcttttcacatttttctgcctgcatatattctagctgtgctggcagctgattagattgtggcaacccagattaagggtgggtctgcctttcccagcccactgactcaaatgttaatctcttttggcaacacccacacagacacacccaggatcaatactttgtatccttcaatccaatcaaattgacagtaataaccattgcaagtccaccccttgtcaacttgaacccatacacatctcttgagatcatgcataatcttcaaataaagacaataatacagtcataattatgcctaaaataatacaactatcctttgtacaactggaaacgcaccaatctccaatccaaatactattacataaaattaacaatacttaaatgctgatatgaagtcaataaatcttgtcacatgataaatgagaaaagaaataaaatgaagatattttcttagtacaagtgtatacatgcacaaaaacgttttcaacaaaagaaagaggaaatactcatgacaatttcagtcctcatttctgcagctggtcacgtggtcatggctggtattgatgactaccttctactacccattctgtattccctttgcctttggcaagcacctca

SEQ ID NO: 15084 - DNA, 50850 bp, Human; identical to SEQ ID NO: 15083
  misc_feature (1)...(50850): n = A,T,C or G

SEQ ID NO: 15085 - DNA, 50850 bp, Human; identical to SEQ ID NO: 15083
  misc_feature (1)...(50850): n = A,T,C or G

SEQ ID NO: 15086 - DNA, 219964 bp, Human
tctctactaaaaatacaaaaattagctgagcgtggtggtggacacctgtaatcctagctactcaggaggctgaggcatgagaattgcttgaacctgggaggcagaggttgcaatgggccgagattgtgccactggactccagcctaggcaagagaacaagactcagtatcaatcaatcaataaataaaaatacaaaactcttctcctcctcatctccattaccttcctcttagtatggccccaaatatttgagtggttgaatgcatgcgttctggacttataagaggataattcccctttctgttttctcctcatcacttgaaaaaaatagaaaatgaagaaagcattcacacctacaagaactcgtccagttttttagtttttttttttctcagtatactcagcatttctcaacagtcctgagaggtaggtattatttgaaggtgagaaaacaggcagagtgtttaccaccttgcacacgacatgaagaaactgcaaggcgtaggagccaggcctcctaaatctcagtccagtgctccttccgttccgctggtcgtcactgcacacgttttctctttttatgtctgggtgaagaaagagtgggtcccagaaacatgaaagcgatttggttttgcaatgggaaggaacagagacaaatctgtaggactttcgactcagtagacattccctctagcatttctgaggggattgtgggcgaagaggagaggtctgagttccacggagtaaggactggccccgttcctttcagtgaatggtctttctccaaatacacacgcacacaacacacacaaccgggggcctcagccatgagagttgttcgtgatagaaatggtctaccagattaccatgacaggcactggggaccagttgtagttcaaagaaacgagagatgagggcactacaaagaggcagggattaaacaaacaaaaacagcaacaacaacaacgacaacaataaagaatgaagattattcaaccagaaacgacaatgagggtggggagaagatagaggatgaagacagcgcagggttgggagtagaaagaccacattcttgtgctggatgttcaaggatcaccgtgaggagagtgagggcggctttgcccttttgatgttgagttaaactgtaatacagattttccatgtaagtactccgtcattttcaggtggcaaccggataaactttaggtgccaccatggagccgacaatcaccagcagcgaacaggacgggaagaaggctgggacagaagggtagttgcatctccgcaaacgcacaggtctaggaaagaggcacctgggctgtccccgggctatctcgtttcaaagtcacttaagtttctgtagcttagaagcggcccttgccctctggtatcgggagacgactttgctgcagacatcgaggtgctcggaatgaccttggtgatcaaccttaacctgaaattcccggtcctgcattgcccatctcccgggtcactgctgctgacaaggctcttctacagtcctgggttattctacagtctttcaagagggcttcccctaaatcctctccctaggaatgcttggaaggacgggaggagcagcctggaggctcccatcgtttattcggacacagtaacagcccgtgccatggctgcgctaccgcgggagctaggctccgcagcagagggccccgggctcgcttcggggtgggggcgcccggggtgtgccgcgccctcggggcccacgtcccgggcgggtttccgggcctcggcagggcgcgaggcggcggcggggccggctggcaggctgatgatgatgatgctctgtgctcgtagccgatgggaggcagcgtgagcccgagagagcccagagcagccgcggtggcagcgctggagcgcagcctcctcccgctcccataatgcacagggcggcggcggtggcggcggcggcagcggaggcagcatcgcgggccgccgaagtggctgcggcggcggcggcgacccctaggaccccgggcaggtggagcgctcgcggctgctcgcggcgagcccgggagtgatggcgaggcccctgcgggcggccagcgcctgaggcgccccgccccgccccgccccgcgcggccctccccgcccggccctgccctgccctgctccctgccggcggctgcgggcgcttcctagtccgctcgggcggccgcccaggcgaggtgcggcctccgcacaggcggggggcgtaggcgcgcggggcccgccatggctgcgtcggagctctacacaaaggtaaggcaccccgcggccggcgtcgaggactggggctgtgcggccctcgccgccagctgtcaggctggggagggggcgggagcgccgggcccaggcgagccccaccagcgccatccccttcagcgcctcagaaccctcggccctaccagccggtcgcccgctgcggcaccttcctctttcgggcgagatggtgaaggcggcggaaggtggcccgcctcgggggtctcccaggcccctgccgcgctgctcgagctgggggcagagcgggcttcggagtggaaagggggcccatgtggatttagcagggcgggcgtgcctcccctcctgcttggctttggaaaattcccggcgggtgggagatgcttgctccagtagatcggatgggttctctcgtggggacacgcgcttaaaataacgtcttgtgttggtatgcagtgccgcttctaccgccagctagcctttctgtgaggttattttgaatcctgcaaacggtggccgtatcacctttagctccccagtttagctgcgctgggggtggcgagccccggggaaagatgctgccggatgaacgcgagctgattcaccggctgggagggtcggtactcatttatcgctgggagtttgcaacctgcgtgtaatcccgcagagccttgttaggctccatgtctttaccatcctctggggcaagcctttcccttctgggtttggtttaagggaagtggcagtcttttcttagactgacatcaatatactcagggtctggcgatctctgaatgacatattatggagaactgtcacttgagtgctgcgcagatttgtgatgacctttgtgaatatatgtaatcatggcattttatactgtacactcatgtgtaggtagatattttgccagatattgattacttctacatgcagttaatagagttgccttttcacattagcgtttgcaacagaactttcatttagggtcctgtaatcactggaatcattgtttccaaatgtcactgaagtccagggcccaagttgcagtgtgttttgtagaggaaagaagactgggcatcaagagacctggattcaagccgggacttactaactgtgaccttggacaagtcacttaacatctctggttcgatttcctaatgagtaaatgcagttaattatacttgccttgcatcccttacaagctgttgtgagaatcaaacttaataatcgttgtgaaagctttttgtaacctatgaatttctctgcaaatatgagatatatgattaatttcttcaaccatgaaatgagcttgcatgaaacattgtctgagacctctttctttctagttttagatttaacgactgtacagttggaacttctctctcaacctggtaatttctttaggcattgtagatctctaacatatgaacgaatgcaattggaaactgattaaaagtaacttaaacacttaatatggtgcttgctatgtgccaggtactgttttaagcgttttaaaaatatgaactcataatcctcataaggaacttatgaggtcgatattaagaaatatcaaaatcattttcacatgaagagataatcagtctgtaaacattccttggttactttgtgtagcccatcccctccacttctacatcaagtttgtccaacccgcagcccatgggccgcatgtgggcccaggacggctttgaatgtgccccaacacaaattcgtaaactttcttaaaacatgggttgttgtgttttttttgcaattttttttttagctcatcatttatcattagtgtattttatgtgtggccaaagaaaattcttcttccagtgtggcccagggaagccaaaagattggacaccctccgttctatatggtgagcagtcatctttgagtcacctaatagtaggctgcttaactagagactgagtggataataaattgttgttggatttcgaatgcttttttcccccaggataatttgggagaaaaaattgaaaagatgttgtgatttgtaaatggtaaagttttgggcttctgtcacagctttatcacaatctattttaaaatttaccttttaacagcctgaggaacataatgagacctggtctctacaaaaaaattaaaaagttaggctgggcacggtagctcacgcctgtaatcccaacacgttgccgaggtgggtgaatcacctgaggtcaggagttcgagaccatcttgaccaacatggcaaaaccccgtctctactaaaaatagaaaattagctgggcgtggtggcgcatgcctgtaatcccagctactcaggaggctgaggcaggagaatcacttgaacctggaaggcggaggttgcagtgaaccaagatcgcgagcctgggcaacaagagcgaaactctgtctcaaaaaataaataaataaataaataaaaattagctgggcgagttagtcacgcctgcggtcccagctactcgagagctgaggcaggatgatcagctgaggcaggaagattgcttgagcctgggaggttgaggctgcagtgagccatgactgtgccactgcactccatcctgggcaaaacagcaagaccgtgtgttgaaaaaaaattttttttaacctctttgtcattataaagacagactggcttagagatcaagactgaagttggggcttacactgccttcttctaaatatacttatgcctaattaatagtctggttacttggttatttgttggcaaattctttttgtgaatgggccttagcttaatggcaagcagaaatacttatcaggcatcctgtgtgccaggtactttgcttaatgtttagaggatttaacaatgaacaagatacagtcctttccctcaacacgctcatagtctgcttcttacattcttgacccactttgaatctataggggcataaataacctgctgttacctcaacagcaggcagacagctggtatgatatttattagtagaagttagggaatgggttgggacatggggaaggttgggctgattccagagataaaaactactattgtaattactagaggaataggaaaatcattagaagtattatcagtggataagcacaaggatcttccccttgcagaggattataggaaggaagttctaggatagattacaaggaaagatgtattagtgatatgccataattatggtatttaacattgtggttaaatctgaaaagtgctctttaaaaaaatgtcattcagatcttaagggcagattttaatgtgtgatacagatcagttcctattacagtgaaggacaagagactgttcaatttcttctttttagccagaatggtaatggttttgtcacagcaatttaacaaggcttccattttgtaagtttttccagcagtataaacattttaaggacaatagctaggttcttgggatacttttctggaaacgaatattttggttaaaacatgttttgttgatttttaaaaataacagctttattgagatatgtgtcttataccatataattcaccatttaaagtgtactattcaatggtttttggtttattcacagagtagtatgttgatgtgtttgtggtcaacctgccttgctcccaaaagaattgaaggaaactatgatatctcattgcttctgattttgaaaatatttgctagtcttgacttgccagtggatatctatatcatacatcatccataggtgcttttggtaactagaagcaattctacatttgtggagtagggtttatcaattagacctagaaggattatcgggaacattataatgaatggcatgctattcctcctgtcatcatgttcccagacaccatggatagcaccatggtatccatgctataggatggtcaagattacttgaagctggttttttttttttttaattttttattttttttgagacagggtctcactgtgtcacccaggctggagtgcagtgaaatgaacatgactcactgtagcctttaactcctgggctcaagctgtcctcccacctcagcctcgtgagtagctgggaccacagctatgcacccagctaatttttaaatttcttctagagatagtctcagtatgttgcccaggctggtcttaaactcctggactcaagtgatcctcctgcttccacctcccatagtgtgggattacaggcatgagccaccacacccagcctattttatttatttatttatttatttatttatttatttatttatttaggttcagggtctcactctgttgtccaggctgaggtgtagtggtgtgaacatggctcattgcagtatcgacctcccaggtgcaagccatcctcccacctcaccttcctgggtagctgaatctacaggcatgtgctaccaaacccagctaatttttgtactttttacagagacaggatcttgctgtgttgcccaggctgatctctaactcctcaggtcaaatgattctcctgcctcggccactcaaagtgttgagattacagacatgagccaccatgcctggcttatttttaattttaaaaaagttttaatttttttgtttacttttgtgttttgttttgtttttacctgaagctgtttgattaggaggttcccatgtgtgctgagatgctgagtattgtaacagtgcaacgacaatctaaaattccacatttgcaaagcatgttaacttgcctagatgaaacagctcttaaggtcagtagattgtatatgtgtaactttccattcccaacatatcctctcatatatacaggagccacatggcctagattttttctgggatagatccacttttatattctatggcactgtctcttcaaactactgatcttggaaattctaatattttcatgtcgagactgtatttctcagactgcttccaacatcttaaagaggaacagaaatctcatctctgatcatgtgccctgacttggagtttggcaaggatgttagctgtcctcaagtctcctgtcatgccctttccatttgaatttcctcctggtgttcctaggcctgttaacgacttgctgttctcctagttccgcagcttggaaacctccgtatcttttttcttgtctttcacattcgacttcttctatatcaattctaatttcagttgacatccagctgatagctcagatttggaactcccactagtactctttttctctgtcttaatgtcccaaacatgtttctgtcttattacggttactgtatttgtgtatatgtttaccactcccacgatactctaagccccctgacatgctgttttgtttacctcctgtagagcctagcccagtgttacacagaatagctgctcattgaatatttgttgaatgaatacttaagcaggggagggatggaatgaaaataatggtttggcatgatcagtccacttgtagggacgaagcagggtataaagatgtggttaaacaagtaaacacattttcaggcatgttgaacaggatgagtaatagaactgggaaccagggagaccaggaaactttcaggaaacaaaatgtgaagtggtgaaggtctggtggactgaggcaggggcagaaggtgtgggaaagaagaggataaatctgagagacaggtctctccgagatggattacatataggatgggaaggagcaggagtagtatgaaataatgccagtagctccagacttggaaactgaaaattaattcctgtttcatcacaacttttgactgcctctgtggaacttgaatgctactaagaaatacttctttacatagcttgacaaagcaaaatgcccattatttcctcttgaaatttgttactgtttcttgaagtgtgaaagttttgtgtattgtccagaaaagattacagagagattctgattctaatgagaattgctgctgccacatattttagatcttcctggtacttttagcttttttttttttttttaaataatgaaagagaactggaggaagctttatgaatgggcttccagggatttaactgtgacctcaggggaggggtgacagggaatgctaactcgtgtatgggagaatgtgggagaggagagatgatccgccttacttcttacctcagaaggtaatttagtttctctgtttttcattttatgatgaattttgcctccattgggagaattcaggagtacgtggtccactagaggatagacttggatgtatttgtctccacttcaggcaattcccagtgaagtatgaggtactgttggaagtctaaacttctgatctatggagtaaggtctggccatagacaaaatattatgtgagcaattccacttcttccacctcacctgaaggcatgtcctccatcctacagtggtcttcctagacttattctatttatcttcctagggagtttgtccttttctccccagcaccaccccactcccaatctttcatcaactttattgaggtataatatacttgaaaagtccctcattttaagtgtacagtttgatgagttttgacacatatattctgtcatgtaaccaccgccacaaacaagatgcagaacatttccatcaccccaaaagttcccttgtgctttgtctcttatcttccccaacatcttcagggagtttactggagttatgcttgctcattagggcagaaggaagttttttctttttggtttttccgaaatgaatgctatggttccaccttagcccaaccaatagagatacttattacaaaggcctggcattggagatcatggctgtggagtttcattttcagtgggaggcggaagtggatataaaaggagtttagatgatttttgtttaatctttccttcacacactgaccactttgcctttattaatgatgtctgcctttgatgccttctgaaatgccctttggttaattttgccctttaacggttcctcttccccatctgtcttggttgtaacatcagtctgagtttgtgctgatacaacctaaactttgcagaaacttatccctggctcttcatgcctcaggcattctccatttctcttctaagccctcctcacttggaattctttttaactagcaggcattagcgttaaatatctccttgtacagcaaaggctttttgccaattgtagaacttagggatgatgtaattattttttgatttcaaaataatggttctaaacttgattgaaatcaagggagaagtgcattgtacataatgcactaagtgttcatgaggaccatgtatctacctcctgtggcctaatgtactactgtggccaaaaatgtgggcaagatgctgggctagagggagactggatgcacaaaaaagataggttttgtccatcttttgtcacatatacaaaaacatatagtcctggccaggaatcctgcatgtgtggttggggtttctacttcttgacaaatgtacatgaaactagagaaatttcagaataggagaagtaaaatgatcagggcagtgaagaggctagacagattaaaggtgtcgaactctctagtttagaaagatgaaggtgagctgggaatacagtagaggtttttttttttttttgagacagagtctcgctctgtcacccaggctggagtgcagtggcgtgatctcagctcactgcaacctctgcctcctgtgttcaatcgattcttctgcctcagcctcccgagtagctgggactacaggcatgtgccaccacccctggctaatttttgtatttttagtagcgatggggtttcacagtactggccaggcgggtctcgaactcctgaccatgtgatacgcctgcctcggcctcccaaagtgctgagattactggcgtgaaccactgtgcccagccctatagtagactctttgacatccagaatagtggaagtttgtaacatcaaatctcagtttagtagggatatgttttagatcttgaaacaaacgaatatatgccattttaaatgaatttctactttaaacatttacattttacatttctgaaactcatcacttcaagttatggtattagctgaggtacaggatgtaaatagagagggtctgggtaatttatggatgagaggtttggcacattgacttaccaaacctctctttaacagtgttagtcagtttaccagccacagctgttttagttggaagaaacagaaacccaaactcaaagccaaagaggagtttatttgctcatgtgacttaaaaatctaggcatggctggaatcaaggctcagacatggtcattggggctctcttcactgactctcacatgctgtctgacattggtttcatcctgagggcagctttttttaggggtgaaaagatggtcagtggcacctgcagatcacatgatcttacagcactgggcctggaggaagagagcctgatagaggaattctggtcatgtgccttctcctttcattgggcctctaggcagtaggtgaggagcaccatgagtggtcaagtctgtgctcaccccagagaccagggggaggacagggcactgtgattgatagtcctactccaacctcatgggatggctgtgagctgttcgccattggaaggaaaagtgctaggtagtcaaaataaacaactaccctcagtccatgtatgctatgaataggtcactgaaaatgatagtcatggaattctacccctccttttctgatctttgagcaagaagaatgggaaattttgcttgaccggggacattaggtatctttcccctagagaatcattttggattgaaaaatagaagccaggccaggtgcggtggctcatgcctgtaatcctcagcactttgggaggccaaggcgggcggatcatgaggtcaggagcttgagaccagcttggctaacacggtgaaaccctgtctctactaaaaatacaaaaattagccgggcgtggtggcgtgtgcctgtaatcccagctactcaggaggccgaggcaggagaatcgcttgaacccgggaagcagaggttccagtgagttgagatcgtgccggtgcactccagcctgggcgacaaagcaagactctgtctcaaaaaaaaaagccatggagcgtctgtgcaagcaaatgttactaatagcatgttagaaattgaaattttgaaaatttattcagtcttcaattttgatttttcatgtattattattattattattattattattttttttagacaaggtctcgttctgttgcccacactagagtgcagtagcgcaagcatagctcactgcagcctcgaactcctgggctcaagcagccctcccagctcagcctcctgagtaaccgggactgtaagcgcatgccaccatgcctggctaattttttaatttttgtagagacagagtctcactttgtttctcagactagtctcaaacttttggcttcaagcaatctcccacttaattatcccaaaagtgctgagattataggcgggagctaccatgcccggccattattcagtcttaatttgggggctatgaaccctatgtcacctttcttactgatttctttctaccgtatttcctcagcattttatttcccctattttcttcacatccttgcttgcatacgttattctcttcccctattttcatacatagataagttgcacgatttcttattgcacaacagtaagaattgtgcacaatttctttttgcctgtccgtcattccttgttcatgtctagtggtagtctgtcttctgttctcttccttccacctgttcatctgctttatccccctactatttaattttatctacccaccccttatgccctgttatgatttgttataacgaagtatatatacatcccacacctataatggaataaaataagttactaaagggtgaatctttttttcataacttagattgaggagggaacttcatttttgtttttgctttattaccactccctgatctgacatcacaaaggaagtcattttttatgagtttgcataaatcattttctgtgtttgtgagcatgtgtatgtgtttcaaacaaacacttttgtgttagactagttttagactagttagactagactagttcaaccttagttttttagcttaccatactggtctgcattacagtaagatgactagatattcctttaaagatatgatctcaccttaaaacatttttctgccagtacttaaacaacttttacacagggttggtctctctatgcttaagcttagaaaaaaatcttctagtttgataagcagcatggttgggttgggagcagaatttttctggagatgctgtctgtaaaattgggaaatgtatatcttaataataaggaattttggtccacaacctagattacattttcataaagtcggaatgtgtatttcttgtttaagaaatgaaaatgttaagccccttagagttactattgcattttaacccactcttactgtttatactaatttttttcatccttgaccaaaatttctcaacctctgcaccactgatagtaggctggataattcttttttttttttttttttttgtgggaggggtggctctcctgtgtattgtagtatgtttagccaaatctctgacctttatctatgagatccagtagcaccctccatccctagttgtgacaaccaatattgcctacagacattgctagatatctcttgggatggtggggatgggggagaatcacacaaacccttgaaactgctaaactagatgataagccttcaacttagggtaagaacaagtaggaagaagttaattgggaaattagaattaattgggaaaacttttttaaaaagttgatttataagcattttttttctgcttgtagaagtgatgccttgtagctaatctggattatttgaataatacagaacatataagggaagaaagttaaaataaactaattataccacctagaaataatcattgtcaactattgatttactttaagtcttttgtctatattcacaaatggtaatgatttttaaaatgatttttaaacttaatatgtattgtgagaatttatatcaataaatattcgttgaaaaaatatatctgtatatatattttttgagacggagtttcgctcttgttgcccaggctggagcacattggtgcgatcttggctcactgcaacctctgcttcctgggttcaagtaatacctctgcctcagcctctggagtagctaggattacaggcacccagagtagctgggattacaagtgcctgccaccacgcctagctaattttttgtacttttagtagagacgggatttcaccatgttggctaggctggtcttgaactcctgacctcaggtgatctgcccacctcagattcccaaagtgctgggattatgggtgtgagccaccgcccccagcccactgaaaatatttttaatggcagcataatattcagtcatctgggtataccaaaatgtatttactgctgggtatttttcactaatggaagtgatatgttatggtgagcatctttgttcataagtctgcttagtcagttttagttagttttagaattcaagtctccctagcaagaattagcatttgtatttatgcaggatagggcattcacattcacttcattttaaaaatagcactctttatgtgcattgcctgagggatagggtgaccagatgtcccacttctagaagatgctttctgctttttaatacctttattctgttttgagaaattttcttagactagaaacatataagttcatttcaaaaatttaaccttttaaaaattgaaactgcttctttttctgaccattgtcattattgttgcttttattcactctgtttcttgatcttggatcaatctgtgccagagagaataattgaactagaaagaattttaaaaagagaaaaaacatgaagcttctaaattactatacatgatataattttagtttgaaaattacctgataatatgttatcaggacattgtagacatgtcctcctaattagaacaaattaacagtgtctggagaaggccatgcctttgctttcggggacagttgagaacccgagagtccttcagcatcaacaacctgctttgtaaaacaattagaatggagcaaaatatgcccaatgctaaaggagcgttatagaatggaatctttatagcagtcagaaggtgttttgggattagtgaggccttcaggtcattgccgtgtgtagcagcccttccgaaggactaggatcacggcagtagccacagacctgggcaagggttgattgtgtggagccttagacattaaaggcataggaaactgagttgaagccttagcagccttggaagtttctttgcttttcttcctccactaaaaccttgattttttttaaccttatatagttgttacttgttttcttgtaaagactgtggctcagtcaaatgtgtggttccatggcagtaaattatcaaataatagtgattaatatttactgaggctttactgtaggccagatactattctgagggctttgttgcaactgtttccttccttgccttccaaccctcccagggtcctgaaagcgaggcagtacatcatagaagtcaagggcatggaatccacacctagatactggatcttggtttgaatcctggttttgctattctactttctctgtgtctttaagcaagccacttaacctctttatgcttcaatttccttatctttataatggtgataataaaacctaccttatgtggttttaatgatgactgacttataatatattaagaaatgcttagaatagtgaccggtatttagtaaattcttacaagtattagttattactattgttgctgttatagctgtcattctcctttctctctgtctgctttctcatcttcttaagctcacttacctcctattgcaccttagatattgatgttcctgggctctgtccttgacctacactccctcccactgtggcctgatccagtcctgaagagtcaggtgccagccctgtgctgatgacttccaaacctgtttccagcctacttgctcttcctacaaacctagatccctacagacaactgccttatggacatcttcacaagccccccaaacccagcatattcaaaatcgattgtcatctgctccctccttcttcatactaccctacctgatttaatttctctgtgtcttagtttctacatctgtatgatggcataatacttacttcatagggttgttatgaagattaaatgagatagtacatgggaagcacttagaataatgcctggcacatatttaagaaatgttagctactgtcattattgttgttatttctttttcctgtctggtgaatgacatcagtatccctccagtaacccaaacacaaaacttagaaatcgtcttgatttactttcccccacacccctgcaccccacctaatcagttatcatttcctagtactgttactgctctatttggggcccttatcttttttttctttctttctttctttcttttttttttcttgagacagggtcttgctctgttgctcaggctggagtgcagtgacgtgatcatagctcactgcagtctcgaccttgtgagctaactaatccttctgccttagccccccaagtagctggcactatagtagctgcatgccaccacacccagctaattttttgttttttggaaacagggtctcactgtgttgtccaggctggtcttgaactcctgggctcaagtgatcctcccaccctggcctcccaaagtgctgagattagaggtgtgagccaccatactcagcttggtcccttattctttcctggttcctcaaacagcttcctaagcaatctttggtcttactttctataatctgttttttcattctgttactagtgagatctttgtaatgcacatatctgagcatgccactgcctggcttgaaattccttcatgattccccataggattttgtcctgagaataaatttgttagtgtaatgcttcctgaactttggtgtccatctgaattactaggaatcttgttaaagggaagattctgactcagtaggtctgtgacagggaatgagcctgcatttctaacaactcccaggtgatgcctgtgctgaattgagaaccacaccttgagcagtgaggctgtagtacacaggctcttcatgacctgccttcgccctgggcctgcctcatctctcatgtttccctcctggcattcagtcttcactttaagtgaggagcttgccaactttgccttcttctgatttccagcattccccttcctggattacttttcattcatgaattagttcttccggaccccagtgtggctaagatgttccttctgtgtgttcatattgcccattcagtttacttctgtcctaaccctttactgcactgcattgcagttgtctatctcccctttgcttctctgaaccccttaaagacagggaaaacatctcatttgtttcatttcattgacaacttttttgagctgtaattcatataccatacaattcattgtataaagtgtataattcaatggttcacatttattttttgactcagtatctagaccagtgtttgctatgtagtaggtaccaagttagtgattgaacatatgaatgagtggaattacaataaattatcattggaaagttttttccaaatcttctttgtattttttggatttaacgaatcagatcattcaaatcatcttatttatttatcagtaactcttcatgtgcttcccctcttctactgctccctccctttggcacctgggaaggcaaccactttattcttctcttggccagttttaacatgtcattatagatgactttccttagtctcttggccagttttaacatgtcattatagatgactttccttagtctccagtgcttccagttctctttttcaacccatgctatgaggagcagtactgacccatgtcagagatctcaacatgctactctctagctcaacacccctgagtggtacccaatcacttacttccccagcctagttattggctatagaattaacttattcttggccgggcgcagtggctcatgcctataatccctgcactttgggaggccgaggtgggtggatcacctggggtcaggagttcgagaccagcctggccagcatgttgaaaccctgtctctactaaaaattaaaaaaaaaaaattagctggacgtggtggcacatgcctataatcccagctactcaggacactgagtcaggagaatcgcttgaacccaggaggtagaggttgcagtgagccgagattgtgccactgcactccagcctgggcaacaagagcaaaactatggcttttttttttttaagatggagttttgctcttgttgcccaggctggagtgcaatggcaccatctcggctcactgcaacctctgcctcccgggttcaggctattctcctgcctcagcctcctgagtagctgggattataggcacatggcaccacaccctgctaatttttgtatttttagtagagatggggttttgccatattggccaggctggtgttgaacccctgacctcaggtgatcagcccatctcggcctcccaaagtgctgggattacgggtgtgagccaccgcacccggccagcttattctgtagcctggtgattaagacttacgatctttttctaaacctactgtcttggcttgatctttcacaacactggagtttctcagactttactatgtgtagcaatcatctggaatacttttttttttttcctgtggagacagagtctggctctgtcacccaggctggagtgcactggtgcgatctcagctcactgcaacctgtttaccagcatggtctccgtctcctgacctcatgatccacccacctcggcctcccaaagtgctgggattacaggtgtgagccactgtgcctggccctttttgctatttttaaaggcaactggaacaactgcctcacttatattaaaacataattgagagtcttctatggcaaaagaagttccattacctttgctaataataggtgtgaaatagtataggaaatcactcacaaaattacttgggaactcttttcctttaaaataaactatttaaaaaggtataaaaataataaatgcccagggtagaattttggaacattttgaaatgcaaaagaaaaattgtatgtaatctcactgtcctcagatactcttaatgttttgatgtatgtccttcttgtctttttccctatatatatatatattttttagcgaaatgatttactttatgaatactattttctctaagaagtatattgtgaaggttttcccatgccaatacgtgttattctacagtgtgtttttttcatgacctcagagtattatattgcattaatcagtcatatgttactgaacgagacccctgcgataaggacttctaattttttgacagtttacatttaaactgaagataaccaaagcctttgtgtgtttgtttacaaagaaataaattgtagtcattaattaatttaactgtaattgcaaaatatcccatttttctactataacaatattggaacacaaacttggtgaattatgatatcaattttttttttttttttttgagacagtcttgctctgtcgcctaggctggagtgcagtggcgcaatctcggctcactgcaagctccacctcccgggttcacgccattctcctgcctcagcctcacgaacggctgggactacaggcgcctgccaccacgcccggctaattttttgtatttttagtagaggcggggtttcaccgtgttagccaggatggtctcgatctcctgacctcatgatctgcccacctctgtctcccaaagtgctgggattacaggcgtgagccactgcgcccagccgatatcaatgttaagattaatctagttagatcttagaagaccaaaaaacaaacagaaatatcaaagaactcaggaataaatccttaaaaataattatatatttgggatctcagagtatgccaggcacaacagcttactaaaaggcagttctccaaactacagaggtagataggttaagattattaatcagcgggccagttagctccaacctgagagggtaaaagatcccttcccattccagtattttggaagccatataaggatgagttgtattataacctacacattctcatgttagctgaggagactacccctgagtaatcaaaggcactcaagatttgtcaagctcttgcatgcatatttaatggaatgatagcctcattgctcagaagctgttggctttagaaatggaaaggttgacttaggctaaaggaaggagaaatatagcagaggcagttattcaagaaaaaaacacatgtactgaatcaggagaagtaatgtgggaaataatctctgagacagactgcgatctggaaagatctgaaaaggagttatttagttaatgtatttcaaataagctcccctggtttgcagattccgtaattaaatgtttctcataatgagtttacaactgaaatgtgtctgggaaactggccaggggttttaaggagcctggttcttcagaaggcattcacttcccttgggtcagaggtggcatctcctagggttgaagagttttctgagtctgtgtaaggagcagtgcctttgtctcaggaaaatgagaatagtctgtggaccatgcagaagttgcctcctcagtcactgcctgtgggagtcattgaggtccaatttgtcttttggagctggggcctccactagggtgtgtttaaggaggatctagacaaaacctgtatagtacagcttagctggttagattgaggattaggatgtctcatttgagttcacaaaaaatcaaagtgatgggtacaattaaatgaaagtcagtgactgtttcacaaatctgtaagactcatttgtaatctgtgccattctatacattagacttaggtcagcggtccccaacctttttggccccagggaccagtttcatggaagacagtttttccacagacctggggagcaggtgtggcgatggtgatggttggttttggggtgaaactgtttcaccttagataatcaggcattagttagattctcatgagaagcatgcaacctagatccttcgcctgtgcagttcataatagggttcatgctcctatgagaatctaatgccactgctgatctgacaggagacggagctcaggtggtattgctcgctagctcaccactcacctcctgctgtgaggcccggttcctaacaggccagggactggtactggtccatagcccggggatgggggacccttgacctagattcttaatattgtccttaaggttaaagatttccaaaaattcttatttgatttatctgttggctatgtttaagaggattttctaagataactgtcatagtggtgaaatttaatagatctgaatgagtagaggctaaattaattattttaaaatgtatatattggtgaaatagatggagtagtttattatacatgattccagcttgaaaatggcttcagtggggcagcagttaaagttttctaagtttgaaattgcgtagatttgagtatattcagaatgtgtgggctgtatgtaggaaaacagagtctcagccagagtactggaactgctgtgaatggttttcattttagtccgcttaattccttaagtagccagttgtcctttggttttcattcttcactgccatagcagtgacatcagatgcagctggagctgaaagtagaagggttatgttaattaattctagtgaaacaaaaactgcctcaaataattaatggaataatagtctcattaaaagaccttagagcttttttgtgctctttttttttttctccaagagattagagaaggaggatggcacagattgttcacttgagacctttttaagctattgatccatcttaagtcctcatctgatgcctctgatttcaacgtgaatcattcaggccatgtagtgattttctcttatttcctcttgaggctgctctctctttgcctttggtgacagttttcaagagagcagtgcctgatctttggcttgtcagaatctaaaaatggcccctattttattggcttatttacagctgtcatattttagtttaaatacagttgacctagcaagcaaacatttgtgtgttacaagtatgggacaaatcccaggtggggttgtctgccaggttattggagggagagaagaggcttatatgttcccatcactgttttcttcattaatcatgctgtctgtcagctgatcatgctgtcatggagtttttttgtttttgtttttcttccaaatagttaaagaaagatgcattattaaacagagattagccagagttgggaaaaacaggtagagagacaagtaggaagatcctttcttatatgtgatcatcttggttttccaacccaatatgaggatgctgcctttgagtaaactaaaaaagagtttaatctggccaggtgctaggtctcatgcctgtaatcccaacactttgggaggctgaagcaagtggattgcttgagcccaggagttcaatccaagccagggcaacatggtgagactccgtctctacaaaaaattaaaatattagctgggtgtggtggcacatgcccatagtcccagttactcaggaggctgaggtaggaagatcacttgagcccgagaggttgaggctgcagtgagccacgatcaaaccattgcactccagcctgggtgatagagcaagactctgtctcaaaaaaaaaaaaattacaaaaaaagttgaatccacttccaattttaataacacatgagaagagaataggagaaaataacgtataacatacggcttacggtttttttggtagataagaaggtacggatttcattgtattgttgaaaatatgcaaggatcttatgtatgttcaggagctaaatttctgggaacataataataaagatgtaaagaaaaagacagtaaaagaaaaagggaagcataaaaacctaaaataaaaagctaagtacagtagtttgagactagagatttgggtataattaaccacatgtgtgttaccagctatgtgtggagtaaacagggttaatgttttggcagggggtgggggtgaggcggggaataatagcccaataattcagggaaccaatggtatgcctacaagtaatcttggccagtgtgctatggaggtagcaaactcacagtagatgaaacaaaggagggatttagaacacataggactaatatagatgtatatttatgtttctacttttgttgtttgtacattgtgtgttgtgatgccttttttggtggtttgttttgtcaggttagttctactttttttttttttccttataaaaccctaacaatgtttgttgtaattttatcaaagttttcataaaactagctacaaaatccacttggattatctgattctaagtttttgaaagatatgattgaaacagctttgccattttaggacttgtgtgaaccagaaatactatgaaaagaaaatagagaaagacaatttacaatttataaacaagagttaaactttacaaatttgaatgattaaataacaaatacataaaatgaataagaaacaccaaggagaacaaataaaataacaaacagtaacgtaatatggttaagggcatcatctctagagttaggttgagcttctccttgtgtgaccataagcaagttagtgaatgtactttcctgatagggcagttgagagattagatacatacatatatatgtaaagcccagtacttggcatatcataatagagtcccttaatgttaactcttaggtagcattattggcttgtctattttaaataatttataaaaatctattttcttattttaaaaaagtggtagccctagatagatctctagttattacactttttttttttttttttggggacagggtctcattctgttgctcaggctagagtgtagtggtgggatcatggctcactgcagcctcgacctctcaggctcaagtgatcctcccacttcggctgggactacaggtgcatgccactatgccctgctgatttttgtatttttttgtagagttggggttttgccatgttgctcaggctggtctgctcctaggctaaagtgatcctcctgccttggcctcccaaagtgctgggattacaggtgtgagtccctgtaccaggcccttatcacactcttaaagcttctggaacgttttaggacatcagctatgtacactattaaaattttcccttcattctagttaggatttggctatggatactctttcgattgtaatctgtctacaactcagcaatgtcagcaccatctgacaaagctgtaactttcattccagtccctttttaatgtttccatcatcaacattcttaaccagttttctgctggaaaggagaactgtattctaaacgagggcttttaaaggtactgcacccagttgtaattaactagcataattagcattttatgtgtaatatagacatgtgtcataaactgttgcttgaatcctaaagtcagttccaaacccatttctccttctgttatagaggttcgaagacaaatatgcctttttctaacttcccttgcagttagggccagctgtgtgatttagttctggctaatgtgatataaccagaaatcttctggaagacctctacagggggaaaaaaaagtagcttctctcataaaaggaatagaaacatttgtttgtatatatactctctttcttccatccttaagtatgtaatgtgatatatggagtctttggcagccaaattgtaatcataaggtgacaagcctcagaatgaaaagttaacaagctaagaaggtagagcagaaagacagaatctgaattcttttttttattttgagacagcgtttcattctatagcccaggctggagtgcagtggcacaatctcggctcactgccacctccccctctcgggttcaagtgattgtcacacctcagccacctgtgtatctgggattacaggtgcaggcaaccacgccggctaattttgtatttttagtagagtcagggtttcaccatgttggccaggctggtgttgaactcctgacctcaagagatccaccctccttgtcctcccaaattgctggattacaagcatgagccactgcatctggccaagggactgaattttttttttttttttttgagaaagggtctcactctgttgcccaggctggagtacaatggcgcgatctcggctaactgtaacctccacttcccaggttcaagtgattcccacgcctcagccacctgagtagctgggattacaggtgtgtgccaccacgcccagctaattttcattttattattattatttttttgagacagagtctcgctctgtcacccaggctggagtgcagcggcgcagtcttggcttactgcaagctcagcctcccgggttgacgtcattctcctgcctcagcctcccaagtagctgggactacaggtgcctgccaccatgcccggctaattttttgtatttttagtagagacggggtttcactgcgttagccaagatggtctcgatctcctgacctcgtgatctgcctgcctcggcctcctaaagtgctgggattacaggcatgagccacagcgcccggcctaattttcatatttttttagtagagagagggttttgccatattggccaggctggtctcgaactcctgacctcaagatatctgccctcctcagcctcccaaagtgatgggattacaggtatgagccactgcgcccagccaagagtctgaaaaattttttttttaatctttcaagcttttatttaaatgccatgatccaggatggattttagatcttgttgaaagcagccacatccatgggctgcacatagtcctcaaacgcagtgatctgctcctccagcatatctgttccaactttatcatcctcaactacacactgtatttgaagtttcttaattctgtatcccactggaactagtttagatgagtcccagactaagacgtctgcttgaatgcttctgacgccctctaatttcgccatatctgtctcatcatcccaagatttcacatctaataagatggaagacttggaaacaagtgcaggttttttggctttctttgattcatattgtgcaagacgttcttcccttagcctctttgcttcttcactttcttcctcatcatcagatccagagagatcaatgtcatcatcatctttactatctgtagctccacttcctgtagtgtcttccacatctgcaggaccatacttgcccaaagctttcttcactcctggcaggctggccttttccttttcgtaagacttgatgtgattataccaacatagagcatgacacaagtcggcaggcagtgggcggggcactgcttcaaatactgccacatctgcttgtgatggcacataccccttgatgtagctcttgtctgtcaggtaatcattgagcacctggaggccggcggggcttttcaggtctccaaaacccatggctttggctgtatctgagagttctccatgtacgaattgagggccctgaattaagtggcccacagattgtccttggaccttttgttgcatttgaaaataaattaataaaatgggcctgtcttaaattcctacctccacagctcccgaagataatgggaactgccgagtctgagttcttaacgacattattgagctgccagaatagccccgagataaccttctctggacttcttgttaaggatacaaactcctaagagtttaacctacctgtcagacttttcttttttcttttttttttttgagatggagtctcgctgtgtcgcccgggctggagtgcagtggtgcgatctcagctccctgcaacctctgcctgctgggtccaagcaattctctgcctcaacctcctgagtagctgggattacaggtgcccgccaccatgcccggctaatttttgtatttttagtagagacagggtttcaccatctggtcttgaactcctgacctcgcgatccacccgccttggtgtcccaaaatgctgggattaccgacgtgagccacctcgcccagcgttctgtcagacttttctgttccttgtagctgaaagcattcctaatgtaagatgtggcagcttcaatgtgaataaagttaatataaaattggagaatttgtctatatggtgttatttaggcacagaaatacaggtaatatgggaatatgacagcattcgggggtgaaagatcaattctagtcatgctttggacattgcaaaacatgggtattaatgccaaagaatccagtcctagtcataatttctaggttttctggctacctcctcagtcctttcccactgtacttacggcattttaaagtgttatcttccccaggcttagaaacctgaacatgacagaggcaaggattgaagtttcaataatatgggagaagctagctgggtatgagtaagagtgagtgggtggaggacatcaattaaaggatgagtgtgtagaaacatatcagttttctaaccatggttgtttctaggatatcccaagtttatggtatctgcaaattcttgaatttcagtgggggaaagaagagaacaagatatttaaaaaggcaaaaaaaaaaaaaaaaaaaggagaaggagaaacagcagcaacagcctttgaaggtctagaaaattttcatgcaagcgttaaaagctccttcaacttagggtttcacttccgcctggtttctgaacacttatgtgaagttgatggtaaagcaatgtcgatcatgtgctaacccattcctgttaagttttagattaatggtaaaatgtttggtaaatttgttcatttggtatggaaagttaaagtagaggtagataatacctcttagaagtgagaaaatacataggacccttgtggaaaaaaagtagttaggaaattaagaaaatttgaccatatcaggagacgaacataataagtttccacttacttaatttttttgatacagtttttatttcattcagttttgttgtttctaaaatttatttttgtaaatttattattatttttcctagacatggtcttgctctgtcacccagggctggtatgcaatggcacaatcttagctcactgcatcatcctcccaggttcaagtgatcctcccacttcagcctcctgagtagctggaactacagatatgcgccaccatgcctggcaaatttctttattttttttttagagacagcatctcactatattgcccaggctgaactccttgtcctgaactccttgactcaagagatcctcccaccttggcctcccaaagtgctggcatttacaggtgtgagccaccatgcccagcctaaatttattttttattgatacataatagatgtacatattttgcgggtaatgttataatttaatacattgatataatttataaagatctaatcagtgtaattgggatagccatcaccttccctatttgttttttctttatgctagaaacattcaaattagtctgttagctattttgaaatatacagtagattattgtaacctgtagttatcccactgatctgttgaacactagatcttatttcttctatcaaactgtatattaatatttgtgcccattaatcaacctctctttatctccccctccctgctaccttgcctggcctctggtatccaccagtctactctcttgtcttcatgagacctacttttttagctctcacatatgaatgagaacatgtgatatttgtctttctgtgcctggcttatttcacttaacataatgacctctggttctatccatgttgctccaaatgacaggatttcaacttgtacttaaatttgtatcgtttgctgagacttacaaggcaatctctgtttccttaatcataaaggaagacactaattctttgtgtaactgaagaaatcaaccaaaatgttatttactaatggcacaatgagagaattgattactttaaatggaggctgacacttgcaaacccctgtatgtgttcatctgccttttacatttgtcaactaggttggtatcctctctgttctcttactataagttttggaaatggctggccttactgatcagacacttctatagatgtggtatggtcagaggttatattatttctggtttggagtgagaaagagagtttgtaaatgcactataggtaaatatggcaagtctgcaattacagcactattaaatatttagatcttatgtacaaatgatacagaataattacgagctttattttatattttgtctctactctctgttgttcagtgttagaccctgaagtacttctgatctaattagaatccattttgtcaggttttgtgaatttcaaaaatttatgtatgtatgtatgtatgtatatatgtattgggatggagtctcactctgttgcataggctggagtgcagtggcgcgatcttggctcactgtaacctctgactcccaggttcaagcaattctcctgcttcagcctcctgagtagttgggattacaggtgtgtgccgccatgcccggataatttttatatttttagtagagacgaggtttcactggcctggctggtctggaactcctgacctcaggtgatctgcccgctttggcctcccaaacaaaaatttaatattagtttatatatataaatactatcttgaccactatttaaaaaagataattaacagcatctcatattaatatggataaatgtctaggatatattgttaaatagagaaaagtaaaatacagtgtgtgtgtgtgtgtgtgtgtgtgtgtgtgtgtagtatatgtatgtgtgtgtgtgtctgtgtgtatgcctatgttatggaagtttatactagactgtttagactgcttaaaatatttttttctgtgggcaagagggttttgggagattttcattttctattaatactttattcaattatgtaatatctgaattgttataatcaacatacattcttttataatcagaaaaaaacaaatattttcttttttcaagtagtgtaaacaaatatattcctttttcaattttatcttatttttatttttattatttagagccagggatttgttctgtcatccaggctggagtacagtggcacaatcatacctcactgcagccttgaactcctgggctaaagcaattctcccacctcagtctcccaagcagctggaactacagacacaccaccacgcccagctaatttttgtatttttttgtagaaacggggcctcacaatgttgcctaggctggtcttgagccctggggctcaagcgatcctccctccttggccttccaaaatggtgggataacaggcatgagacaccacacctggccaaaggtatttcaaagagacatttttgagtaaaaaaaaaacgttttctggctgggcgcggtggctcacgcctgtaatcccagcactttgggaggccgaggcgggtggatcatgaggtcaggagatggagaccatcctggctaacaaggtaaatccccatctctactaaaaatacaaaaaaaattagccgggcctggtgggaggcgcctgtagtcccagctactcgggaggctgaggcaggagaatggcgtgaacccgggaggcggagcttgcagcgagccaagatcttgccactgcactccagcctgggcgacagagcaagactccgtctcaaaaaaaaaaagttttctgattttgtgtatacacacaatacaaacaatatttaaatatattttataatatatttaaagcattgtttgatgcttttagaattgagatgcctcactcctgatccattttttggtgttgggattagcctcttggattaggcatgaactaagaagaacgttttttgagagaagggagagaaaaggagaaagctacctgaatgaactgatttggagggtactaagaaaggctacaaataaaagaaaatccataaagaatttctacaactcaacgacaaacaaccaaagaaccctattaaactccctgttgaaaaatgggcaaagaggccaggcatggtggctcacacctgtaatcccagcactttgggaggccgaggcgggcggatcacctgaggtcaggagtttgagaccagcctagctaacatggtgaaaccccgtttctactaaaaatacaaaaaattagctgggcctggtggcgcacgcctgtaatcccagctactcaggaggctgaggcaggagaatcacttgaaccctaggggcagaggttgcagtgagctgagatcgtgctattgcactccagctcgggtaaaaagagcgaaactccatctcaaaaaaaaaaaaaaaaatgggcaaaggatttgaatagacatttctccaagaatatatacaaatggctaataagcacatgaaaagatgctgaacatcattaatcattagggaaatgcaaatctagcctacaatgaaatatcatttcatgcctattatcacacaaaacaaaaacaaaaaaatacaaatgttgaagaggatgtggagaaattggaactcttgtgcacgggtggtgataatgtaaaatgcagccactatggaaaacagtatgtcagttcctcaaatttttatttattttattttttatttttaagaggcagtattcctctgtcacctacgctgaagtgcagaggggtgattgtagctcactgtaaccctcaaaatcctctgatcacccaagcgatccccctgccttgttctcccaaagcactggggttacaggtgtgacctactgtgcccggccccctaaaaaaattaaactgataattaccatatgatccagcaatctcacttctgggaatatacccaaaagaattcaaagcaaggtctcaaagagatacttgtacatctgtgttcacagtagcattattcacaatggccaaaggatggaagcaacccagtgtccattggtggatgaatggataaacaaaatgtcgtgtatttatacaatggaacattattcagcctcaaaaaggaaggaaattctgaaagatgcctcaacatgaataaccttgatgacattatgccatgtgaaataagccagtcacaaaagacacatactgtgtgattctacttacatgaagtacctaaagtagtacaatcggtagagacaaagtagcatagttgctcctagtggctgagggagggggaaaatggggcgttcatttaatggatatggagtttcggttttggaagatgaaaaagttctgtggacagacggtggtgatggttacacaacaaagcaaatgtatttaataccaccactgaagtgtatacttaaaaatgataaagattgtaaatatgtgtattttaccacaattaaaaataataataaaaaaagaaaatccattaatgcttcagaatcttctaaccttttcttggccatcctctttgcaagttgttattttaaaagcttaaatatctttaatgtcttatggtaaacaagtatcagtccttccttcactgagaatgagataggtagctagaactggggatggaggagaagctgcttcaggagtaaaagggcaaagaaaaaaggagatactttgggccactaaaagcaatttcagtcacatcacaattttgccttgccttggctctgccccacaaagcctagaatctagtagtagctctagtttttaaaaatcttaaatgatatcttacatttgatatgctttatggaattcctgactacattcctgagccagcaagacatttgtagaaattcatcaagtctttaccactgctattccattaggggttaatatgggtgagtattcacataataatcttggtatggggttggtacttctaaacatcaaatgaaggcaaaccataaaggaaaaaattgacaagaatatacagtttcaagctctctacaacaacaacatgttcaaaaggacattaataggccatctgacagaacaggaaaatatttttaattctttggttcagggctcaatatcaatatataaaaagtaataatatctgtgagaaagactaacaccttaatagaagaatagaaaacactaaggcaattcacaaaagaaacttagcctgtaaacattgaggaagtgttcaactcagtaatgtaagaaatgcacattaaaatgaagaggtttttttttaaccaaacaaattaataaatattttttaaaatcacacttatttcttagggaaatgaacactatcacaaactgctagtgggagtaaaattcgttcagtctttctatagggcagtttaacacaatatatgtatcagaagccttagaattttttacaccctttgagctaacagtcataattttaagatttattttcaggaaataagcatgaatgaatattggaaggatgattatgtcagtgctgtggaatagtgtatccaagtggagataacgtagatgtccagcaatagggaattgtttacatagattatatctgtacaaactagtgttttataattttattagtcttcttaaataattaatttttggttttgttgatttttctttattgtacaattattttctagtttgctgattatgagtttttgttgttttcttttttctactttctttgagtttaatttgctattctttttctagcttcttggaatgaatgctcagacattgcttttcagcctttctttgcttctaatatatgatttaaggatgtaaatttccctcgaagcaacactttggctatattcctcaggttttgatatgttgaatttttattatttttcatttatttattaatttcccttgatagtttttctgtgaatcatttcataaagaaattgctttatttccaaaaatttggcagtttttaagttatccttctgctctcaatttcttcttctgcttctttttttttttttttttttttgagacagagtctcactctgttgcccaggctggagtgcagtggcgtgatcttggctcactgcaacctccacctcccgggttcaagcgattctcttgcctcagcctcccgagtagctgggactacaggtgcacactgccacgcccggctaattttttgtatttcagtagagacagtgtttcatcatgttgcccaggctggtcacgaactcctgagctcaggcaatccgcccgcctcagccttccaaagcactaggattacagatgtgagccgccgcacccagccaatttcttcttttaaatatttaaattctattgatttatacatggatgtatctatgtattgatttaagctatttcaggacatctgctctcaacttctagcataatttcactgtgaacaatgaatatctgcgtatattttttgaaatttgttgagacttgccatcctgactcctcattccatctgctgccagctgcttttaacatttttttctcgggctgggtgcagtggcccacacctgtaatcccaacactttgggaggctgatgtgggtggatcccttgatctcaggagtttgagaccagcctaggccacatggcaaaacctcatctctactaaaaatacaaaaattagccgggcatggtggtgcatgcctgtagtcccagctactcagaaggctgaggtgggagaatcgcttgagcctgagaggtggaagttgcagtgagtcgtgattgtgtcactgcagtgcagcctgggtgacagagcaagatgactctgtctgaaaaaaaaagctgtttcaactaagatcacaccctcttgcagggcagcctatatcggtgactgactggttgttgcacaggtttagtaaaggcccatccccattgtgccaactcaggactaccctgaaggaagggcattccagtttcacagcacctcatggggttgactgagggaggcattgcattcttctcaaagtgtatattgaatagaacttaaacttttctcagtgttgagtcatcaatagtccaatagtacaatgaagccctcatagtctactaaggtgttatgggatatttgcccatatacctcaagtcaaaatatttggagggcctgcgtccttcatgataatgtcataaacccttactttttgttatattttcaaagctcctctagatccctgtattttcacagcttttcttccttagtgaatactctttggagggtcttcctagattttaagaaccttctttaatccccagccattttataactcgacttcctctttcacctcagccacaagggactggaccaggagtggcaacctagtcattccgtgtccatttcctggacgtttccaggggaggaagcttactttctgtagttacacctgtaaacttgaagctcaggagctatgcagtgggcatcttttaccagtcatgtggcctagaaagcacagggggcagatatacacaaatgagcagagatgagaaaccaagagggatgatgagccatctaagccctgcttccagtcctgtctgaagcactgttcctgttcttggacttcatgaagggacctatatccttataatcttctttgcctgccttagcttaactcaggccagtttatgctacttaggacaacattaattttcttttttttttcatttctcttttttttaaaaattatactttaagttctagggtacatgtgcacaatgtgcaggtttgttacacatgtgccatgttggtttgctgcacccattaactcatcatttacattaggtttttctcctaatgctatccctccccctgcctcccaccccacgccaggccctggggtgtgatgttccccaccctgaggacaacatgaattttctaacttaaactcagatgaacttggaaactgtataacagataaaattataaaataagactagaggtagagtttttgaatgaaaacaagggattctctctcaagaaaagctttaatgcatgcaaggactttatgccttctcttttgaccactcagagtccatttttgcttcttaaacttctatttatctatctatttacttattttaattgacaagtaaatactgtatatatttgtggcttacaatatgatgttttggtatatgtatacactatggaatacctaaatcaagctgtttaacatatgcattacctcactttcttttgtgatgagaacacaaaatctactgtcaacaatattcagatatacaatatattgttattaaccattgattatcatgaagtacaatagatctctggaacttactcttcctgtctaactgaaattttgtgttttttgaccagtagttcctcaatgttcctggccctcagcctctggtaatctccatttcactctctgcttctatgactttgacttttttttacaatccacatataagtgaaatcatgcagtatttatatctctgtgactagcttatttcacttaacataatgtcctccaggttcattcattgtcccaaatgacaagacttccttctaaggctgattagtagtattctattgtgtatatgtatagtacattttcattatccattcatttgttactggacacttaggtttgctttggatagttgaattttggccattttaaagtcaatttaatttttttagtattttaggcttaaatatattttgatatatgtcaaaaaatatggatatatatatatcatatatctcaagaatgaatgctagctaacattgaaacttgtagatagtagaaggaaaattaatttgccaataggacattgttgagaattatgttattgccaacctttaacatttattgtaaagtctatgcaatagctgttcttgcttatgtattgaagtgctcaggtagataaattcagcggaatccttaacacttgcccgtagcttggcacctagcacctaggataatagataacaagaaaggccaggcacagtggctcatgcctgtattcccagcactttgggaggccaaagtgggtggatcacctgaggtcaggagttcgagactaggctggccaacttggcaaaaacctatctctactaaaaatacaaaaattatccggacgtggtggtgtgtgcctgaagtcccagctactcgggaggctgagtcaggagaatctcttaaagccaggagggggagaatgcagtgagccgagatggtgccactgcactcctgaccgggcgatagagcaaaactccattaaaaacaaaaaacaaaaaacaagaaataacattagatcttttatttaatcataatgttattttgaaggacctctgtgactaaatactatagtatatttgtaacccaatactaaatgatttccattggcaagaaagatctgtgggtgttagcacagaaccaagaagacccttggtcccttgtacatctgtgggctttgttctggtccccagccagaaatttcatcttatatttttgttcatattggatagcagattatgggtggattagtgaaaagccatccttagtaatagggaatgttttgatgatgagtcattaatgctttttgtttggagatcaaagatgacaccattcagtgataaacatgtatttccttcatatgatatagggaagatgtttgactctgtattgctgatttgctctggtcctccctgcctcattcttttctgtctattacaggtcgacatctcagattgtggggtgttggagcgaggggccaggcagtgaagcttgctgtgctcgtagtttgctcttgggcttttagttgtttttttctactcttgtatgatacaagctaaaatatggtttcgtaatatttttgtttcagataatttattattgaatacagattatagtttcagataaagaatatacttttcctatatttccctcacttccttcaattcttgtctatggaggctgtgtaacagtaactcagaatgcacggtatttctagtgtgtggaccttgttgtcaaggttttagacacactgagcctaatgtcttctagagtataatattattgtataagcaagtatcagtgctaaagaatacattttttttcttttttttttgagactgagtctcgctctatcgcccagactggagtgcaatggcatgatcttggctcactgcaacctctgcctcccggcttcaagcgattctcttgcctcagcctcccgagtagctgggattagaggggcccgccaccgtgcccagctgatttttgtatttttagtagaacggagtttcacggtgttggccaggctagtctcaaactcctgacctcaagtgatctgcctgcctcgacctctcaaagtgctgagattacaggtgtgagccaccatgcccagctccagtaataaatttttgaaatggaagaaacattctccattctttgttaatgtgctatgggaaagagtggctacatatttattttatagctctggaattaatgattcaaagtattatacatctcatttgcaatgctccatagattatttaagatcatttgctagccacttaatctgtggctataattaaattactctcaaacttccggctctgagatttagtttttcttggacaaaaggctaccttttctatctctatcttccaaaacatgttcactaactcttgagagtcccaatcaaaagcctttttcacatatggcctgcacctcaggcctttcttccctcaggccttggtgatagactaagggttctataaattctgattctcatccccaccagcctataggctctgttgactcatagcctaagcactatctctgagttttctcctatgtttaaaaactaccaaaactttttattatgggaaaatctcacatatatactaaagtagaaagaacagtacaataaattcccatgtgcccgggccccaacttcaacagtatcaactcctggccaatcttatgtcagctatatcctcactcattttgcctttccatgttattttgaagcaagtcccagacatactgttaattcatcccagatattccactgtgtatctgtgcagaaaagagcatagcaggcctgattgctatcctttggaaggcctgtttacaaggttggcccttggcgagcatctgggaacttggattttgggagggttctcaaccaccctaactagtagtagtgtactgtacctaagctttgtgtgcaaactacatggtttgtggtgaatacttgctttccttctgggagtctggaatcttagtaagtgctatacagagtttgcctatgtaacctgtcctcagtaaaaactgagcaatgtgtccctaatgagcctctctggtagacagcattattgtaactagccgctgggggaattaagcccatcctgtgtgacttcactgggagagggctcttcgaaacctgtatttggtttcctctaaacattatgtcatgcaccttttacttttgctgattttgctccgtgtctttttgctgtaataaatcttggccacgagtacagttatatgctgagtcttgtgaaccctcctaccaaatcaccaaacctgggtgtggtctggggatccctgacagattatctctaacataagcacttaaaaaaatctatatatctatgtatgaccacaaaaccattgtgacacctaaaaatgtttataattccttaatattatcaaatatcaagccagtgtttgcatttcctattgtctcataaatgtcatattctttttgtctgctttgttctaatcaaggttcaggtattgcaactggttgacacttattgtaagtctcaagctataggttcgtactctatctctttttcttttcttttttccttgaaatttattttgttgaaaaaactggatcatttttcctgcatagtttcccgcagtccagtttttgctaattatgttgccatggtgtagttcaatgtgttgctttgtaaattagtagttggatctagatgcttcgtgtatgagtttttgaaagcccaatgccttcatatatcctgaggatatgccttaatttccgtttgattaatgtttgccaagaacattgatgtacttggataaaaggggattaaacagtaaatatctttgtttttgttagcatgagacagatcttctgacacttggagcctgactcatgttactttagagaatccaataaaaaatacatggcttagtgttcattacttgcttttcaggaggtaaccctggcggggatctctgagcaaaagctggctttaattatctagagttggtacagtgtcattgtgactagatattatgatgtaggtggaaatgtggggttttcttattttttaaagactctataaaaacaaaatattaatagaaaacatcagaaccctactaaaaattgtagacccccacatgcattaattttctatgcaatgaaatccttcagtaccttagtaatgaagttctaattaatgagttacttaagtccctcttaattcaacttggtaggaataatccaacagccaaggcccaatgtagttatcatcgtaggtcatctttggagatgtgccttttttgaaacagctggatggttgggcgtttaataaatatttagaatgtaaatgtatacttaaatttaaaaaaattaaattgtaaaatacacataacgtaagttaaccatcttaaccatgtgtaagtgtacaggtcagtaatgttaagtacattcatattgttgtacaaccaggccaggcatggtgctcacacctataatcccagcactttgagaggctggggcaggaggatcccttgagcgcaggagttcaagaccagcttaggtaacatagtgagaccccgtctatacaaaaaataaaaaaattagctggatgtggtggctgcacctctagttatagctacttgggaggctgaggtgggaggattgcttgagcccaggagtttgaggttgcagtgagctgtgatcatcacaccactgcactccagcctcggcaacagaatgagaccctgtctcaaacaacaacaacaacaacaacatattgttgtacaaccaatctctaaaactcttcatcttgcaaaactatatccctgtacccattaaacaataactccctattccccactccctctagtccctggcaaccattattctactttctctccctatgaatctgactactctaggtaccctatataagtggaatcatatagtatttgtcttttcatgactggcttatttcatatggcgtaatgtcctcaaggttcatccatgtcgtgacatctttcagaatttcctcaaggttcatccatgtcgtgacatctttcagaatttccttctcttttgaggccaaataatattcttttgagtaaatacaccacatttttgtttaatctattcatccattgatggacatgggttgcttccatcctttggctattgtgaagaatgctgctgtgaacatgggtgtacaagcatctctttgagaccttgctttcaaatcttttggatatataaccagaagtgggattcctcggttatataggaattatatatttaattttttgaggaaccaccatactgttttccgtactggctgcaccattttacattaccagggtgcagaggttctaatttctccagggcacaatcgttctaatttctccacatcctgtccaactcttgttattttctagttttttgatagtaggtattctaataggagtgaaatggtatctcattgtaggcttgatttgcatttccctaatgattaatgatgttcagcatcttttcatgtgcctattggccatttgtgtatcttgtttggagaaacgtctattcaaagtctttgctcattttaaaatcaggttgttcatcattgttgctgttcagctgtagaattcttttatttttgttttaaatttacttagagacaggtctcactatgttgcctaggctagtcttgaactcctgggctcaagcagtcctcctgccttggcctcccaaagtgctgaggttacaggtgtgagccaccatgcacagctgagttgtagaattctttatatattctgggtatgaatcttttatcagatatatgatttgcaaatatttcctttcattatgtgggtttccttttcactctgttgattgtgccctttgatgcacagaggttggtttttttttttttttttagacaaagtcttgctctgtcaccaggctggagtgccctggcacgatcttggctcactgcaacctctgcctcctgggttcaagcagttctcctgcctccgcctcccgagtagctgggactacaggtgcgtgccaccacgcccggctaattttttgtatttttagtagagacggggtttcactgtgttaatcaggatggtcttgatctcctgacctcgtgatccgcccgccccggcctcccaaagtgctgggattacaggcatgagccaccgcgcccagccgatgcagagaggttttaaatttatttacctttttcttttattgcctgtgctcctggtgtcagctccaagaaatcagtgccaaattcagtatcatgaagttttcctcctgtattttcttctaagagtcttacagttttagctcttaacatttaggtctttggtccattttgagttaatttttctatgtggtataaggaaggtttatcttcattctctgcagttttacttttacactttggtctaatggtgcatgtacacgccatgtagaagataagttaaggttctaaatttagttatgctattgacaactgcttgctgtggaaatcttgctataatgcctcctcccatgggcagttgttactgatttatctcatctttccccagagagttttgcgttttaagaaagagaaattgttaaatattatttgttattaagtgtcatttatactttttagtttagctttttaaactttttattttgaaaagtttttgaaacattcacaaagtaaggagaagagtaaaacaaatccccccaagcccgcagcttcaacaaataacagccttctgcacatttgcttcatttcttctttttcccaacattttcttcttctgaaagattttaaggcaaatcacaaccattttattatttcactcatatgtttaaggtaaacatagacatttctgatcaaatgtgtgttatgtcagagtatgcctttctatgtactttatggtagagttcttgtataattaattttgttgttttaaagcctaggtctagggactagcaccagcagcagaattttgatatttgtaattgctttagagttcacatatttgctttatagaatgtatttgatcatgtgtacaactaatgtgctgcatatgcttcagaaatgcagaccccaattatagctcttttggggaaatatgaactgctttacagccctccacattaaaatgtggtttccaagaattcattatttacagacatcagctacatatatttacaaatggctcagaatgaaaactcacaggaaagattacaaaaataagcttctctgtctttttttttttttaatccttctctgtcttttgagtcctggtgaatactatgcaacaaaagcattcacctcatccataattctttcaaccccttatgggtttttttttcaccctagataatttagtaaagttcaataaagtaaaggaactttttgctacagaagtactatgtagaagttaagaattcacaaatacatggccattgaaatgagagataatcagaggcctcacccagaattagaaagctttcatcttagtgtttatgttgctattgtcaggtactgctggagcccaaagaatgggctcttggtggataggtcatctcagcagactgaaataaagctgtctgggaatgtggggtagggattgagggtagtgagtgaggggcatcaggaacgccggccgtacaagtatgctggtttccttagtcagccaaggataatgcaaaattgaaaccaggaaatgtcatagtgtaaaacttttttttttttttttttgagacggagtctcgttctgtcatctaggctggagtgcagtggcatgatcttggctcactgcaacccctgcctcctgggttccagtgattctcctgcctcagcctcctgagtagctgggattataggcacctgtcaccatgctcggctaatttttatatttttagcagagacggggtttcaccatgtggtccaagctggtcttgaactcctgacctcaggtgatctacttgcctcggcctcccaaagtgttgcgattatagttgtgagccaccatacccggcccttatttttaattttttttttatttttgggacagggtctgctctgttgcccaggctggagttcagtggtgtgatcatggctcactgcagtcttgacctcctgtcctcaagcaatcctcccacctcagccccctgagtagctggaactacgggtgtgtgtcatcatgtgcagctaacttttttattttttgtagaaacaaggtttccctatgttgcccaggctggtctcgaactcctggactcatgcgatcctcccaccctggcctcccagagtgttggcattacaagagtgagctgctgcttcggccctagtacccattttagcacagtgttccatacatcccccaggaaataattttgtgtcgtatgacctatttctcctctttgaaagcttccaaatttttagtatcaacgtaaaacttgtatcacagagtcttctaaaaagatatttaagaagcatttgtacataacacaaatactcattcttttcttaagaaagcccatatcccttatgctgacatttctagctctgagtgtttccttcacccgtgtgcctatgacatgggtgtatcctcgtgggaatcttctatagagcctcagttgtaagcctttgatgattccagtgggcatgatgtggtcaggcaggtgtacacccttggcctttagaattggccgcactcctctttgcctttagtgaagcaacaaaggagaaagtgtaatactgctctcctttgtaacatagtctttctttttctctgcctgtgtgttatttcctttcctttatttctcctctttttaaagacttttaccttagtgacaacaatattaaaacaaaaaatccccaagagtctcttgttttcaactggaaaagtctgatttctagaatttattaataagtctaatctcttttaaaatgggaagaaaataaaactactcatttaaaaacacagcctctctgagaaggtaacatttgagctgaggtttgaataaggaagatacagtgtagtggagagagaatgaaagtcggggccagacattctttggtcaaatcctggctccaccacttaactagacatgtcatcttgaccaagctactttgactcactcaacctgagttttttcatctgtaaaactgaggtaataatgctcagcgatagggctattaggattaaaatggacgtggctctttgacctccttttgacatggatcaggaagagacgcctggacatggcaaacagagaacaggctctgctctcatcctccttgtttcaccatcccccacccccagcttaacgcagaacctcgcttgtaagagggacttggtaaatacgtgttgaattggaatttgatttgaaaatgaataggaaaagtatagaagaggaatgtgatttaaacagttcataaaaatgaaaacgtttactatggaaatgtgggtttcagaactgtgccctcatgactgcttgtttacggtgataattagcaacttaaaataattttgtgttgatgcttaatgccaggctcttgaaatcctaagattcgcctaaaggatttactatagtgttttcaaagaagcaacattttgaactgacaaatacgtttgtgtgttgttagaagaaaaatttgagaaatttaattatttagcatattactatcatgctaaaaaatctttattcttgtcgtttctgttcaagttattgaggctttttctaccaaaagtgtatgtttatgttattatcttttttaacagtctatgtaaaacccactcctttctggctatgatgtgaaaaattacattagcatagtagaaactatattatccatacaagaggttacttaatcttttttttaaaagggtaaatattatgctgattcatgtttttatttcattttaataacattcatctagtactacctagagtaaggatttctaaaaagagaccttgttattctagaattcagtatctcatgatctaatcagaggtctcgtgcagagatcaactgacttaggctgcttaactcatgtgacggaaaacttgaactctctaggattctaattgtccccttaattccaatagtatttgagaatatatactactttgttcaaattcaataccctaaaacattttttgtcattagaagtgattaatcacctgacagtcttgtttttttttttttttttttacatagtgaattctttattctcttttaaagatttgtgttctgtcatttacagatctttagtagagaaggataatttaagggattaagaagttagttgaaaattgtttagaaatgaaaatcatttgtagtgacttacatacttcctagctattgaaagttctgtaattattaactctgccttactgttttttgtaattattcaaaagaacagacagtttacttaaaaagacaacattgaggctgggtgcggtggcttacacctgtaatcccagcactttgggaggccagggcgggcggatcacctgtggtcaggagttcaagaccagcctggccaacatggtgaaaccccatcgctactaaaaatacaaaaaaattcatccaggagcagcgaaaaattgtatttctttgtattttcagtagagacggggtttcaccatgttggccaggctggtggcaagcgtggtggtgggtgcctgcaatcccagctactcggagactaaggcaggagaattgcttgaacctgggaggtagaggttgcagtgagccgagatcatggcactgcactccagcctgggggacagagcgagactctgtctcaaaaacaaacaaacaaacattgaaatcagaaaacatttgggggaataaggaaatacctgcaatttttgattctttctaccaagttgttttgttaattcaggaacatatatggcatttcatataatgatcactttgaaatacttgtatctgcaaaatcctgtgaagagtgaaacagaagtcaggattaaagttagtgttgatttcatcttctgtcctttttctggtaataaaaaggattaggagggcaaaatacttttgtctttaatatctactctatcctccctggctactggaacagatccacattcttattttctaaaaacaaaaaggaagggtgtgtgtatgtgtattttctaccatagctacctaactagccagggcttcttgtgttctagttccttgcattctaattcacatatattttcaggaaaatgtaatgcatacctgtaatacgttcaacttgctacaattatcatagaatacttttggttctgctcttatagtcatttagtgattgatctaatcactttaatctttcttaacatgaggatcctaagattagttacttttcctggcctacttgatcatgtgtcagagctcaacaattccagtgccccctaacaaatgttagtggtctctctagttctgactgacttcccagggatacttctagagccccagctaccagatgcttcctgactgggaggtggacggcttgcagttgctttaggaagggattggcactgccagaagcaaggcttttggtcagaatgattcatttccacagtgtgacattagctgtatagagcagactgtttttctaaatcgttgtgttataataatagaagttcaggaaccacaattagggctgtcataagggtgtggacatagccataagctaaggaagaagttcatctagtctggggatggaccttcgcattcttgccaggatatcttttaacataacatttgctcaattaaaataccttaatccatagaatgttggggagtgggacatgtttttccaaattatggattggaatggatggggaaggaaaactgagtgctgagaatgggttttttagaaatttctaggcgtgtccttgcacccatagttttttgttgttgttgttgtttttaaatatattgctgagtctctactgcctcccagatgtcactttttctcttccctactcctgaaatttctaaggcattgctaccatcagtgtatcataaattaattcacagtgcttgccatactcacggtcccttcaaagggtaactgtacccctcactctccctgttgacctggggcccctgctaagaaaccaaatgatccagccaagctgattggacaaggggaggccctgacctgaaaatggctcactcgtaagggccttttgatgtggcctggtctcaaaagggcagtctaaacagaagtagcaatgtttaagtgagccatttaggtgtcctgttttggggatttctgtaacaagtatggaaaagataaaccagaggagtggtgtagacacattgacagttctgaccccattagcagtggtgtaccagaaaagccaccaattcctactcatgggcttccagggcctgccttggaaccaacactttgcttcggttttttcctctatgtgacttagctcttctctggttccttatcctgttgtttcctctgtattcatatgtgtgccctgctcatccttcacctgagtgagcttgagtatcagtccattgcaatgatagaagcctaatcacaggagaccttagaaacctggaagagccacgggcaggttggtagtccaggggcatcaggggatagagtcactatttagggccaagaaattaggaatctgggcctcaggctccttgccttgagctgccgcaactcctctactaatggaccggattcacttaaaaaaaattttttaaagccattttaggttcacagcaaaattaagcagattgccctcctccacagtcttaccttttattaaaaaaaaaaattatgaacaggaaattaatgttagggatatcaaatggaataaatttcaccttgttgagttgtttttgatgtgtgatgaaagtttttagaatttatagccagtacttatggtgtctgtattgcttctgtttttgtaaaattattggaaatctactctggcccaggattcctgtgtgtttcaatatgttcaacatggagttgttagagtatggatcatgttgactcctgtttttcccagctctggctatcctcttccctcttcagcagcagcaaagggcccaagcccactcacaaaaaacaactaccaggaatatgagttctattcccttctggatcagggtttcttccacatgatgccatgaagaaggtcaggtagagtcacagatacttggtttatttatgttaaacgaaaaaaagagatggcctataggagaaaagagatggttgctatatccaggaagttctcaagctcacagaccccgtgcatgcctctttcatctttctccgtatgatctttgcctgtgtctgtgcagataccactctagctcttctctctcttgtggtcacaagaatataaaaactgcctagccacttcctctttattatgcctgagtctccagttatcatgctgagtgagccaagttcttgctgactgaatcatgttcttataattctactgatgtagaataatactgattatatcctgtttctactaacaaaatggacatacaaaatttgtccaacatgcataaccacatacttataccttttccttcatgaaagctctagccaattctttcatcaagtatttactgagtactactatgttccagtccttttatgatctgagccctgggaatctctctggcctctcatttcttgctacagtgattctaaactacttgttattcctcatgtgtattttatcctgttccacatctttatgtcttcattcatgtctggaacatgaatttgttcatttgcttggttaactcctatttgtccttctagcccaaatccatgtccccctcctttaggaagttaccatgtactctatttttctttgcacaagttgggtgaggtttgcaaactccactgggctcccatggcaccttgtacattcctccttcacagaactttgtgtgtcatattgacagtgtctgtgtgtgtccatctcatcagcagaactttgagggaagggaaaacatcttacccatttttgtttctgcaattcttagaacagtgtatgaaatagaatatacacatactgaatacttgtggaaccaaacagaattagttagggtataaagtaaaatagaaaatcttatagaatctctaggcaatctttgtttgcattaaaatctgtttttcattcctagagaccatttgcttagatcttcagcaaggacatacctagcatctgttgcagcaatgtgtcaatcatgagttacaggcacaccatctgttttttactgcaccggtgctgactgggattttggcaatgcagataaatgtgcttgcacctaataatgctagttctaacctccaaagtcaggcagtagacatgattatgaagactcataatacctacatatagtgtggtccagtgcactaccaaatgccatggctctagcaaagaatctggtatcttagatgggtaggcataagggaacccaaccatgaatccagctgcaagtgcaatgctgtatcccaggactagacctgtgcctgttggtactcagtaagtacttgttaaatgaatgactgcatttgggtaaatggatttagctatatgtaaggaagctatggtttggcactttgtagcactgtagattttgactgtgctggaggcatggctaaggactgaagctaggggagataatgctaaggaagaattttctcatgggactcctccttataccacactctccaatgataactaacactgccaaggaaaagagaatgtgggaaaccaagttgtgttacaatgaaatggaattttagttgagtcctgattttgctttcctcttgccatttgtgcagctgtgcaacttttttcagatccattatgtttgcttctgaagggagaggggagccagagagggcctcaaggatcggggatcaggacatccttggtctggtgtgggctctggtctgagccagctttgttcttggagctctagttttcttggaaatggggtgtttggaccagatcatctttaagccctcttctgattctgagattttacattcgctaaacaattgtaagatttgaaatagttacgggttttcctaaattctgcaggtgtttcctggatgagttaaaagctgactgtaaatagatcaaattgtagatggtgtagttaagtttctttgcgttttagctagagactttgtagatgtttgccagtcaagtttctatcgcaattagtatttagttcttatttcttccttcacatatgaaaaatcaagtagacatgttgtagaaaattaagggaactgatttctttttagttttattgaggtataattgacaaaaattgtatatattcaaggtatacgatgtgatgctaggtggggatgtagggtttgggagagaggagacagcattgcttagatcagtcacgttcagagacctctttacataatctttacttccatcacaggtgcagataggtggcttcagttcatatctcttcaggaatacacacacaaactggtggagaagagcaaaggcatgctgagctggagcccagagcaaggccagactcactgtccagctcttttctcctttactcagagaggtctaagagaggtgtggctctttcatgattgggcagaatgataaatgttcagatgccatggactttcagtatggttcacaaagagtggaaaccacaaatgataatctgtgaattccaagctactgtattatatggatatatgaatatagtttatgaatatatattaaacaaaaataggatcatacaatgatgatgttttacagcttgctctttctcaattaacagtatctttccatgtcagcacatacagacctaacttttttttaagtattccattatatagatataccacaacctctaaactatgcagttgacctgtgaacaacctggatttgaactgcatgggtccacttacacatggatttttaaaaataaatatattggaaaattttttgagatttgcaacaatttgaaaaaattctcagatgaactatgtagcctagaaatatcgaaaaaaataagaaaaagttatgtcatgaatacataaagtatacgtaaatactagtctattttatcatttactaccataaaatacacataaatctattataaaaagttaaaattggctgggcgcagtggctcactcctgtaataccagcactttgggaggctgaggagggcaggtcactggaggtcaggcattcgagaccagcctggctaagatggtaaaactctatctctactaaaagtacaaaaattagccaggtaattccagctactcaggaggctgaggcaggagaattgcttgaacccagggggcagaggttacagtgagctgagatcacgccactgcactccagcctgggtgacagagcgagactccatcttaaaaaaaaaaaagttaaaatttataaaaacttacacagacatagactgcacatggcactgttcacagttgagagaaatgtaaacaaatataaagacataaccacacaaaattaactgcagtacacatagtactacagttttactgtagtaattctgtagccatgttgtgttgctgttgcttgagtgagctaaaaaggttgtgagtattcccttaaaatgtgtgacactaaccatccccgtgtgaacagtttgtctctccagtacattgcatatcacagcaaaaagtgatctcacgcttctcacgtatttttcattgtgtttagtgcaatacagtaaacctgacaacttaaggcaaaaggcagatgaaggatcttaagctgaagaacttaatgccagcaaaggatagtttgataattttagaaagaggttcactcttttaaaaatgtctggagaggggaaggttccaaaatggctgaataggaacagctccagcctatagctcccagcatgagcgacgcagaagacgagtgatttctgcatttccaactgaggtaccgggtttatctcactggggcttgtcggacagtgggtgcaggacagtgggtacagcccacggagcatgagctgaagcagggtgaggcatcgcctcacccaggaagcacaaggggtcggggaattccctttcctagccaagggaagctgtgagagatggcacctggaaaattgggtcactcccaccctaatactgcacttttccaacgttcttagcaaactgcacaccacgagattatatcccgcgcctggctcggagggtcccacacccatagagccttgctcactgctagcacagcagtctgagattgaactgcaaggtggcagcgaggctgggggaggggtgcccgccattgcggaggcttgagtaggtaaacaaagcagctgggaagctcgaactgggtggagcccaccgcagctcaaggaggcctgcctgccactgtagactccacctctgggggcagggcatagctgaacaaaaggcaggagaaacttctgcagacttaaacgtccctgtgtgacagctttcaagagagtagtggttctcccagcatggagtttgagatctgagaacagacagactgcctcctcaagtgggtccctgacccctgagtagcctaactgggaggcacctcacagttggggctgactcacacctcatacggccgggtgcacctctgagacgaagcttccagaggaatgatcaggcagcaacattagccgttctggaatatttgcagttctgcagcctccactggtgatacccaggcaaacagggtctggagtggacctccagcaaacttccaacagacctgcagctgagggtcctgactgttagaaggaaaactaacaaacagaaaggacatccacaccaaaatcccatctgtacgtcaccatcactaaagaccaaaggtagataaaaccacaaagatggggagaaatcagagcagaaaagctgaaaattcaaaaaatcagagcgcctcttctcctccaaaggaacacaaaggaacgcagctccttgccagcaatggaacaaaggtggacggagaatgactttgacgagttgagagaagaaggcttcggaagatcagtaataacaaacttctccaagctaaaggaggatgttcaaacccatcgcaaagaagccaagaaccttaaaaaaagattggacgaatggctaactagagtaaacagcgtagagaagaccttaaattacctgatggagctgaaaaccatggcacaagaactacgtgacgcatgcacaagcttcagtagccaatttgatcaactggaagaaaggatatgagtgattgaagatcaaatgaatgaaatgaagcaagaagagaagtttagagaaaaaagagtaaaaagaaatgacaaagcctccaagaaatatgggactatgtgaaaagaccaaatctacatctgattggcgtacctgaaagtgacggggaaaatggaaccaagttggaaaacactcttcaggttattatccaggagaacttccccaacctagcaaggcaggccaacattcaaattcaggaaatacagagaacaccacaaagatactccttgagaagaacaaccccaagacacataattgtcagattcaccaaagttgaaatgaaggaaaaaatgttaagggcagccagagagaaaggtccggttacccacaaagggaagcccatcagactaacagcagatctctcggcagaaactctacaagccagaagagagtggggaccaatattcaacaatcttaaagaaaagaattttcaagctagaatttcatatccagccaaactaagcttcataagtgaaggagaaataaaatcctttacagacaagcaaatgctgagagattttgtcaccaccaggcctgccttacaagagctacctgaaggaagcattaaacatggaaaggaacaaccagtaccagccactgcaaaaacatgccaaattgtaaagaccatcgatgctaggaagaaactgcatcaactaacgagcaaaataaccagctaacatcataatgacaggatcaaattcacccataagaatattaaccttaaatgtaaatgggctaaatgctccaattaaaagacacagactggcaaatttgataaagagtcaagacccatcagtgtgctgtattcaggagacccatctcacgtgcagagacacacataggctcaaaataaagggatggaggaagatctaccaagcaaatggaaaacaaaaaaaaaggcaggggttgcaatcctagtctctgataagacagactttaaaccaacaaagatcagaagagacaaagaaggccattacataatgataaagggctgaattcaacgagaagagctaactatcctaaatatatatgcacccaatacaggagcacccagattcaaaaagcaagtccttagagacctacaaagagacttagactcccacacaataatactgagagactttaacaccccactgtcaatattagacagatccacaagacagaaagttaataaggatatatccaggacttgaactcagctctgcaccaagtgtacctaatagacatctacagaactctccaccccaaatcaacagaatatacattcttctcagcaccacattgcacttattccaaaattgaccacatagttggaagtaaagcactcctcagcaaatgtaaaagaatagaaattataacaaactgcctctcagaccacagtgcaatcaaactagaactcaggattaagaaactcactcaaaaccacacaactacatggaaactgaacaacctgctcctgaatgactactgagtacataacaaaatgaatgcagaaataaagatgttctttgaaaccaatgagaacaaagacacaacataccagaatctctgggacacattcaaagcagtgtgtagagggaaatttatagcactaaatgcccacaagagaaaccaggaaagatctaaaattgacaccctaacatcacaattaaaagaactagagaaacaagagcaaacacattcaaaagctagcagaaggcaagaaataactaagttcagagcagaactgaaggagatagagacacaaaaaacccttcaaaaaatcaatgaatccaggacctggttttttgaaaaggtcaacaaaattgatagactgctagcaagactactaaagaagaaaagagagaagaatcaaatagatgcaataaaaaatgataaaggggatatcaccactgatctcacagagatacaaactaccatcagagaatactgtaaacacctctacacaagtaaactagaaaatctagaagaaatggataaattcctggacacatacaccctcccaagactaaaccaggaagaagctgaatccctgaatagaccaataacaggctctgaaattgaggcaataattaatagcctaccaaccaaaaaaagtccaggaccagacggattcacagccgagttctaccagaggtacaaagaggagctggtaccattccttctgaaactattccaatcaatagaaaaagagggaatcctccctaactcattttatgaggccagcatcatcctgataccaaagcctggcagagacacaacaaaaaaagaattttaggccaatatccctgatgaacatcgatgcaaaaatcctcaataaaatactggcaaactgaatccagcagcacatcaaaaagcttatccaccatgatcaagcggacctcatccctgggatgcaaggctggttcaacatactcaaatcaataaatgtaatccatcataaaaacagaaccaaagacgaaaaccacatgattatctcaatagatgcagaaaaggcctttgacaaaattcaacagcccttcatgctaaaaaccctcaataaattaggtattgatgggatgtatctcaaaataataagagctatttatgacagtcccacagccaatatcatactgaatgggcaaaaactggaagcattccctttgaaaactggcacaagacagggatgccctctctcaccactcctattcaacatagtgttggaagttctggccagggcaattaggcaggagaaagaaagaaagggtattcaattaggaaaagaggaagtcaaattgtccctgtttgcagatgacatgattgtatatttagaaaaccccattgtctcagccccaaatctccttaagctgataagcaacttcagcagtctcaggatacaaaatccgtgtgcaaaaatcacaagcattcttacacatcaataacagacaaacagagagccaaatcatgagtgaactcccattcacaattgcttcaaagagaataaaatacctaggaatccaacttacaagggacatgaaggacctcttcaaggagaactacaaaccactgctcaatgaaatagaagaggacacaaacatggaagaacattccatgctcatggataggaagaatcaatatcgtgaaaatggccatactgcccaaggtaatttatagattcaatgccatccccatcaagctaccaatgactttcttcacagaattggaaaaaactactttaaagttcatatggaaccacagaagagcccacattgccaagacaatcctacgccaaaagaacaaagctggaggcatcacactacctgacttcaaactatactacaaggctacagtaaccaaaacagcatggtactggtaccaaaacagagatatagaccaatggaacagaatagagccctcagaaataatacacatctacaactatctgatctttgacaaacctgacaaaaacaagaaatggggaaaggattccttgtttaattaatggtgctgggaaaactgggtagccatatgtagaaagctgaaactggatcccttccttacaccttatacgaaaattaattcacgatggattaaagacttaaatgtaagacctaaaaccataaaaaccctggaagaaaacctaggcaataccattcaggacataggcatgggcaaggacttcacgtctaaaacaccaaaagcaatggcaacaaaagccaaaattgacaaatgggatctaattaaactaaagagcttctgcacagcaaaagaaactactatcagagtgaacaggcaacctacagaatgggagaaaatttttgcaacctgtccatctgacaaagggccaatatccagaatctacaaagaacttaaacaaatttacaagaaaaaatcaaacagccccatcaaaaactgggcgaaggatatgaacagacacttctcaaaaagaagacatttatgcagccaacagacacatgaaaaaatgctcatcatcactgaccatcagagaaatgcaaatcaaaaccacaatgagataccatctcacaccagttagaatggcgatcattaaaaagtcaggaaacaacaggtgccggagagaatgtggagaaataggaacacttttacactgctggtgggactataaactacttcaaccattgtggaagacagtgtggcaattcctcaaggatctagaactagaaataccatttgacccagccatcccattactgggtatatacccaaaggattataagtcatgctgctataaagacacatgtacacgtatgtgtattgaggtactattcacagtagcaaagacttggaaccaacccaaatgtgcaacaatgatagactggattaagaaattgtggcacatgtaaaccatgaaatactacgtagccataaaaaaggatgagttcatgtccttcgtaaggtcatcagtgaagctggaaaccatcattctgagcaaactatcgcaaggacagaaaaccaaacactgcatgttctcactcataggtgggaactgaacaatgagaacacagggacacaggatggggtacatcacaccggggcctgttgtgcggtggggggatgggggagggatagcattaggagatatacctaatgtaaatgacaagttaatgggtgcagcacaccaacatggcacatgtatacatatgtaacaaacctgcacgttgtgcacatgtaccctagaacttaaagtataataaaaaaaaatgaaaaaaatgtctggatagggccagtcgcgatggctcaagcctgtaatcccagcactttaggagaccgaggtgggccgatcacgaggtcaggcgatcgagaccatcctggctaacacggtgaaaccctgtctctactaaaagtacaaaaaaattagccgggcgtggtggctggtgcctgtagtcccagctacttgggcggctgaggcagaagaatggtgtgaacctgggaggcggagcttgcagtgagccgagatcctgccactgcactccagcctgggcaacaagagcgagactccatctcaaaaaaaaaaaaaatgtcaggataacaggagaagacgcttctgccgaccaagaggcagcagaggagttgccagatgccattaagaaaatcactgaggaccagaaacagtggctcatgcctgtaatcctagcactttaagaggccgaggcaggaggattccttgagcctgggagtttgagaccagcctgggcaacatagggagacactgactctacaacaaattaaaaaattcgccacgcatggtggtgtgtacttgtagttctatctactcaggaggctgagaagggatgatcacttgagtctgggaggttgaggctgcagtgagccatgaatgcaccactgcatgtcagcctggggcaacagaatgagaccctgtccaccccaccccagctctccccaaaaataaaatcattgaggagaaaggatatctgcctgaaagaagttgctttttttgtttttgtttttttgtttggggtgtgtgtgtgtgtgtgtgtgtgtgtgtgtgtagagacagaatctggctgtgttgcccaggctggcctcaacttgctgggctcaaacgatcctcctacctcagtgtcccaagtagctgggactacaggtgcacactaccatgcctggctaaacagatttcctttttctttttcttttttcaaatgagacagagtctcactatgttgccgaggctggtctcaaactcctgggctcaagcgatcctcccaccttggtctctcagagtgctgggattacaggcgtgagccactgcacctggccccgaactgatttttaatgcacacaaaagtgccctattctggaaaataatgccacaaaagacatttactagtaaggaagagaattgagtaccaggatttaaggcaggaagggacaagataactgtactattttgtgcaaatgcagtcaagtttataatcaggactatctttatctataaagctgctaatccatgagccttgaagggaaaagataaatactagctgccagtcttttaagtggaccccaagaaggtctggacaacaagaactctttttcctttcctttttttttttttttgagatggagtcttgctctgtcgcccaggctggaatgcagtggcgtgatctcggctcactgcaacctctgcctcccgggttcaagcagttctcctgtctcagcctcccaagtagctgggactacaggcgcctgtcaccatgcccggctaatttttgtgttcttagtagagatggggtttcaccatgttggccagcctggtctcgaatgcctgacctcgagtgatccgccctccttggcctcccaaagtgctgggattacagatgtgagccactgtgcccggccaagaaccctttttctgaattggttccattgatgccttgtccctgatgtgagggaataccttgtcagtaaggaatggcctttttttgaggggggatggagtttcactcttattgcccaggctggagtgcaatggtgcgatcttggctcaccacaacctccacctcccaggttcaagggattctcctgcctcagcctcccgagtagctgggattacagagatgcgccaccacgccggctaattttgtgtttttagtagagacggagtttctccatgttggtcagggtgttctcgaactccccacctcaggtgatctgcctgcctcggcctcccaacgtgctggttttacaggcgtgagccactgcgcctggcccaaggatggccttttaaagttcctttgatattgggcaatgtccctggccacctagaaccccatgaattcaacaccaaagctatcaaagtggtctacttgcccccaaacacagcacgtctaattcagcctctagatcagggggtcataagaacctttaagcttcattacacatggtactctgtggaaagaattgtcaatgctatggaagaagacccccaacagagggaacgtcatcagtgtctggaaggattacaccattgaaggtgccattattgttatagaaaacgctgtgaaagccatgcagcccaaaacaataaattggtgctgtagaaaatcgtccagatgttgtgaatgccttcgtaggatttacaacagtgccaatcaaggaaatcatgaaagagattatggatgtggcaaaaagggtggggagtgaagagttttgggctatgaatcttggagaaattcaagagcaaatagacactacaccaaagcaattaacggaagccaacttgatggagatgagtatatctgaaccagtgccggactgtgagaaaaaagatacagaagtagcagtgtcaggaagcaaattgacattagacaatctagcagaagagttctgatttttcaagactgcttttgacttcttttacatgaaccctcctatgatttgggcactgaaacaaaatcaaacagttgcagaaggattggtacccttatagaaacattcttagagaatggaaaagcaaaaaagacagaaattatgacgtatttctgtaaagttacactaagtgtgcctgtttctcctgcctccccttctgtctcctctatctctgctgcctctgtcatccctgaggcagcaagaccaagccctcctcttcctcctcctcctcagcctactcagtatgaagatgacaaggtgaacacctttatgattctccacttccacttactaaatagtaaatatattcttttccttttgattttcttaataagtttcttttctctagcttactttattgtaaaaatatggtattttaatacatatacagaatatgtgttaatcaactgtttatgttatcagtaaaacttctggtcaataggaggctattagtagtagtaaagtttttggggagtcaaaagttacacacaaatttccaactgtgcaggggattggcactgcttacccacatgttgttcaagggtcaactgtatattattatagttaacctttacactaatatacatatatgaattagcctttgtgtaatttccaatttttcacttttacaaacaatgctgcagaacatttttagaaataattatttgtattttttagtatctccgtgggaaaattttatatatgaactttctgattcaaggatatgtatattttaaaaacttttggttttattgtaaaaatagtacttactcatgaaaaaatgagaaatatggaagtatgtaaagtacaaaattaaaggttccctcaccacctatttcagtatgcatccctgaaatatgtatttcacattgttgaagaaattaccaaattgctctctcaaaggttgtgcctgttgattccatcaccaatatatgaaaatacctgtttgtccactttcttcctaacacaggttattttcaatcctttaaatattttcaaatttaatttgcaacttttaaatattttgttattatgttttatagagacagggtctgtctctgtcaccaaggctggagtgcactggcatgatcataaatcactacagccttgaactcctgggctcaagtggttctcccaccccagcctcccaagtaactggaactacaggtgcacaccaccacacccagctaattaaaaaaaattttttttacatttttatagagacggggtctcaccgtcttgcccaagctgggcttgaactcctgggctcaagcagtactcccacctcagcctctcaaaatgctgggattatagatattagccattgtacctggcctaatactgtattttaaatttgcatttgcttaattattagtgagactgcacatctttttaattttttatttttctgagacaggatctcattctgtcacccaggctggtgtacagtggtgtgacctcggctcactgcagcctctgccttcccagctcgggtgatcctcccgaatagttgggacaattttgtctagagatgaggtctcactgtattgcccaggctggtctccaactcctaggctcaagcaatcctcatgcctcagcttctcaaagtgctgggattacagacatgagccactgcacctggtccatcttttctttgtttaactttttaaatggtgcttctgttcgctacctgtttttttcttttgcctatttgctactaggttgtttatctttttcttattaattcgctgatatgtgaggttttgttttatgaagcttaatcttgctggacataaaattattggctgctaggtttttcttttttctttcatcactttgaaaatgccatcccattctcttctggcctgtgagagttctgctgagaagtgtgccattagtctgatggggtttcctttataggcaactaagtgtgcttttctcttgccgatttaaaatttttttccttcactttgactttagacagtctgatgataatatgctgtggtgaagttttttttgcagtttattttcctggggattgctgggcctcctgtagctggatgtctaaatctctttcttgacttgggaaattttcatcaattatttccttaaataggttttcagaactttttgcattttcttcctccttgagaataccaataattcgtaagcttggttgccttatgtagaccctaatatcttgatgtctttattcattcttttttcctcacttttgtctgattatgttatttcaaaagacttgtcttcaagttttgagattctttttttctgcttagtctagtctatttttgaagcatttcaaatgtattttgtaattccttcaataatttttcagacccagaatttctgtttgtttttgaaatctgtctcctgtaaattcctcatgtgcatcctaaattgattttctgattttctttatattagtttgcagatttctcttgcatctcattgagcttctttaaaatcaatactttgaattatttatcgacatttcaaggatttttgttctgcttaagatctattgccaaataattattttgttcctttgagggcgccataataccttgctttttcatacttcctatatgttgatttctgtgtatctgaagatgtgactatgatgctgattgggtagggccatttgtctgcatgaagtgacaaagactttgtatgatttccttggatatacatagccttaatgcggtagctttcttgaatgctggttgtagtggcgtaccaggcagtgagcagacacacaacctcctgtgcagctgtgatgtcatgggtgataggggcagtagttgtgagaagctcttctctttctcaagtgctgtgctcttgtgttaattgttgcagtgggctcttcaggctgtcccagaaggtggattgggccatggaacccccaggggcctggatcctgcaccctatcttggagtggggggcaaagctggaatggagctaagttagctaggcctgcactcagaccacctaccctgatgggagtggctacctaccctgatttaggcctctggtaaaatacctgggttagggctgaccactgttatgctgatgtctcagcctgggaagggagggtggttctagcttcacagccttggctggcagacatgggacctgcttccctcttacaccccagtcttggcaaggttcatgcccccatctcaactatgttagccagtctggctgttcacttagtcactacagtttgcttctcgtctgcagtgcagtcttgggctataggagtcactgtgcagctcaatactacacctctctggcacttctcctcctctggtccatgggtggggttggggggagcccagtttcagcaccagcagctggagcccataccacactcatttctcagttctggctgtgggagcccctcccacaggtttcagttccccaagccccagcctgagtctctctactgccaaagactgctgctgctgtggctagctcccaggcgtgtgaggtgcagcttgctaagtaagagctaggaaagagaatagggtcctgctgtaggtgtccagtctgaaggaatgcctgggatacttcctcaagcagttccttctcacagtctcctggctgctccgcatgttagatctagggcttagaaggggcaaggtactttcctgtggtctggattgctcgattccctagtgggaaagtggaccacagagagatatgtacccttttccatattggggattcactcctggtttttggccggtcctggccatacgggctacctaccttccttcttctcagattttggagtttctttttgcttttctgttggactcattgcttttcatgtcaaacatattatcatggataatatgttcaaagtatgattgtctacacactattttggttcttctgagtttatgaagtgtgctagaaaagcctctagtcagccatcttgggcgaaaaaaatctcaagatgtatctttttcttaatgatttgtaagagttctttttaaaagtctttttaaatttattctatttattttctagagacagggtcttgctctgttgctcaggctggagtgcagtggcatgatcatagcgcactatactttcgaattcctgaattcaagcaatcctcctgccctagcctcccaagtagctgggactacaggcaaaagttctttatacattaagggactttgcttttttacaaatatatttttggtcaccctgtattttgggtttgtttatgatgtattttggcacccagaagttttttatttttctgaaaaatattttataccaaccattctttcaaaattataaaacctagatcaactttcatagctgcttttctcggctaaaattaagctaaaaggacacttaataaaaggggcaaggataggggatcatgggaggagttaataagaaagcatcatgcagcccaaagtttaacacttccacttaaagatgcaggccaacagggcttttttgcttaaggtgtctcagccagcagcaagatggcctactcatttgccctctcaaagccagctcattatagaattccgtaataatcttgccctgaccttactaccaaggctgctgtttccaggtcaagaatctcccttctagtgctcatcattaatgaggtaataccagtgaaatgtccctccttgcccctgcccttaggtaaagctgactcccagtgtggccaatacagtctctatttgcctaatatggatgacattttggaagcaattatgtgtatattagataaatcctgtctacaggctaaatgtgagtgacagtcatatatacataactaggaaaacgactaatcataagcaggagttgtacaagatgtgcttttgtttatgattaaaagactgctgattagaactagggtgttggaaacatctggtcattcattactctgcttaaaagcctgtgatgaatccctgtctcatgcagtatataggccaaactgcctaccatggcacatgaggtctttcacatcctgctcctaacctattttttcagtcagctaaacactatgctaagcactttcatttcacacatatttattgagtacctgctagttaccaaacattgttctaggtttcggtgttcgttgtccctgccctcacaggctttctggctagttagggacacaaagaatcccacataaccaaaacaatctatagagtagtcagggtggactttttctgagaaaaacgcatatataaactgagaccagaagagtgagaaggaactagtcctaagaagagatgggaaatgaggggaaggtgttctaggcagtgggtacagcaatggcattgaacttgtagtttgggtgttctaggaacaacagaaggctggcacagccagagctcaggggaagggagaagaccccagtgagttgctgttaaacctgtgggtaggggccagatcacatagtacatcgtagagtatagtaaaggaattcagatgcagcacaatgaggtacctgaatcggggtttggcctggggttgggctggcgacaaaactgtgtagtggttttaagccttatctaatttatctgcatcacaactctctgaggcaggtattactaataaccagttttatggatgagaatcctgaggaagaaagttgggtaattgttcaaggtcacacagttggaaagtattggagcttctggatctgtctaactccagagcccatgttctcaaatgtaattgtatatacagtctaattggtttattttgtaagtaagggaattgagattcagaaaaattaaaaataaactagaatgattaagaggatgtgaggcactgtttaaaaaatttatgctcttcttccatctggaaagatgaagaatgaacttttgatctggtggaagcttctaacactatgaggcacctgaagagggcaatgctgacttattcactacaaaaatagcttaggcatcttttgaagcttcagataagtaattcacaggtcaaataaaaggaagtgcttttgatacagttggtagctgattatttcagatacagattaacaatgtttccagtagcttttaggaaatctgtagaacaagttagcaaaacagaaaacctcttctgtataaagcatactaaaatactgatgaaaatgtctgtaagagaagtttaaataactaagaaaatgaggaaaaaatgagtacagggaaaatgaaattttataataataaaaaaagaaagcaattttagttgtaagttttataatatttaaacattttagttttatatgtcttaagaaatacttaactcatggatgacgttttttaatataactgaaaagccactatagaggggtaaaggaaataatatcctttcttagtttttacagacagaatgaaattcttatttctagagaagtccatcttgatgaagaaagtgtggtcaagtcactgccaggatgccggcttgacatctggggaaaaggctgaggcacaagttcttttagagtctttgtttgcttatgctgcatttttctctcaaaataccctctcagcgtatacagttggagtacctgtcactcaagaaaaaatgtcctttagttcatgagatttttacaacctaaaatagactgacaatcaattttgatctttctgttatgattcccattgtcctgtcagtttctctcagtcatactgagaacccgaccacccaatttggatgattttctctatcagttcaatcataccacttaacatcttagggctgtcagatttaagggaagcaaagtgtactcttgatctctctagatgtttggaaattactgaatgagaatttcataaccttttttttttttttccaagacggattctcgctgtcgcccaggatggagtgcagtggcacaatcttggctcacagcaacctccacctccagggttcaagagattatcctgcctcagcctccagagtagctgggactacaggtgtgtgccaccgtgcccggccaatttttgtatttttagtagagatggggtttcaccatgttggccaggctggtctggaactcttgacctcaggcaatctgcccaccttggcctccgaaagtgctgggattataggcgtgagccactgtgcctggccgataaccttaatatctaattatttgtgctgcttcgttctctagtaattgtcttatcatgatcaaggtgcaagcatggccagcagctggcttgggtctaatgccacttctgtgttcttttcttccttgaggatttctctcggtgatctttttggtacttagtatgcatacagttgtgctttcaagatatcagatgaacactgcagccttgtattattcgcctaacctgtagtatatatttaaaaatattaatgccacaaagtagaaattgtgggttttgatcaaaccttttttttttttttgagacagagtctcgctctgtcgcccaggctggagtgcagtggcacaatctcggctcactgcaagctctgcctcctgggttcacgccattctcctgcctcagcctcctgagtagctgggactacaggcgcctgccaccatgcctggctaatttttttgtatttttttagtagagacggggtttcagtgtgttagttgggatggtctccatctcctgacctcgtgatccgcccacctcggcctcccaaagtgctgggattacaggcatgagccactgcgcctggcccaaacttttttttttttgagatggagtctcgctgtgttgcccaggctggctagagtacagtggcgcgatctcagctcaccacaacctctgccttccaggttcaagcaattctcctgcctcagcctcctgagtagctgggactacaggcgcatgccaccatgtccggctaatttttgtatttgtagtagagacggggtttcactatgttggccaggctggtctcaaactcctcacctcgcgatctgcccacctcagcctcccaaagtgctgggattacaggcgtgaatgaccacacctggctgatcacacagtttttatggggtttctgctgaacaagtctacctaagctatggggagaggaatagatagcatataagatttaaatatgaataagttttactaacctagagccccttcatgcttactcatgttctgttcatcaccttcaaaataacttcctattgtgaaatgctgttttgtttgggcaagctagcctgtttttaagtttgggtgactaggtttctgtttttcactcatgcttatggttgatagcaaattacagtatttttgtttttaatgttaagatgatttattgtttattaataattgcaaaaacatcaggcaatgtttgctgtaaaaaattgcaaaaacaaaaattaaccactgctaagattttaagtatgccctttaaatgtcatatcattttcctttttacaaaacatacctattggcccgacacagtggctcatacctataatcccagcactttgggaggctgaagtaggaggatcgcttgagcccaggagttggagatcatcctgggcaacatgttgacacctagtctccgcaaaaaatacaaaaattaaacaggcatggtggcacgtgcatgtagtcacaattactcaggaggctgaggcgggaggatcgtctgagcctgggaaggttgaggctgcagtgagccatgattgtgcccctgcactccagcctgggcaacagcaagactctgtctcaaaaaacaaacaaaaatacatattgttttcacttaaaaatatattgtgagcactttcctttgaccacatgtattctactcacatatattttatgatcatatatattttatgatattattttatttaaaattgcactgaatttccttagtcgattttttttattgttggtcctttcagttgttttctttttgtcttctttgttttggggtggggggagaaactatgtcattaaagtctttatatagcttagataacttctttaagctataacgctacaaaaaatttctggagcctcgccctcgccctcgccctcgcacggtcctcgtctcccctttgcacagtctccctctgatgccgagccgaggctggactgtactgccgccatctgggctcactgcagcctccctgcctgattctcctgcctcagcctgccgagtgcctgggattgcaggcgcgcgccgccacacctgactggttttcgtattttttggtggagacggggtttggccgtgttggccgggctggtctccagctcctgacggcgagtggtctgccagcctcggcctcccgaggtgccgggattgtagacggagtctcgctcactcagtgctcaatgttgcccaggctggagtgcagtggcgtgatctcggatcgctacaacctccacctcccagccgcctgccttggcctcctaaagtgccaagattgcagcctctgcccggccgccaccccgtataggaagtgaggagcgtctcggcctggccgcccatcgtctgggatgtgaggagcccctctgcctggccgcccagtctgggaagtgaggagcgcctcttcccggccgtcatcccgtctaggaggtgaggagcgtctctgcctggccgcccatcatctgggatgtggggagcgcctctgccccgccgccccgtctgagatataaagagtgcctctgcccggccgcgaccccgtctgggaactgaggagtgtctctgccccgccgccaccccgtctgggaggtgaggagcgtctctgaccggccgccccgtctgagaagtgaggagcccctccgcccggcaaccgccccgtctgggaagtggggaacccctctgcctggccgccaccccatctgggagatcgggggcccctctgcccggccgccccgtctgggaagtgaggagcccctctgcccggccgccgccccgtctgggaggtggggggcccctctgcccggcagccccttttgggaagtgaggagcccctctgcccggcagccaccccgtctgggaggtgtacccaacagctcattgagagcgggccgtgatgacaatggcggttttgtcgaatagaaaagggggaaatgtggggaaaagaaagggagatcagattgttattgtgtctgtgtagaaagaagtagacataggagactccattttgttctgtactaggaaaaattcttctgccttgggatgctgttaatctataaccttaccgccaaccccgtgctctctgaaacatgtgctgtgtccactaagggttaaatggattaagggcggtgcaagatgtgctttgttaaacagatgcttgaaggcagcatagtcgttaagagtcatcaccactccctaatctcaactacccagggacacaaacactgtggaaggtggaaggcggcagggccctctgcctaggaaaaccagagacctttgttcacatgtttatctgctgaccttcccaccactattgtcctatgaccctgccaaatccccctctctgagaaacacccaagaatgatcaataaatactaaaaaaaaaaaaaaaaaaaaaaaaaaatttctggaaaatcccagctactcaggaggctgaggccagagaattgcttgatcctgggaggcggaagttgcagtgagccaagattgcaccattacactccagcctgggcaacagagcgagaccccttctccccctgccccccaaaaaagaatttttacatttttaaggtatttgaaaaaaaaattgtcaagcttccttcccagaaatgctatgaagatttatatgctaaaaaccagtgcctgagattcctaattcctgtgcccttgccaatattttcaaatttctaatattttaaaatttgacagttgaaaatggtaccttttgaaaaattaatttatgaaagaatgttataaaatgaagttagtctttttgttttttgtttttatatttatttatatttgtatgtatttgtgaggtacctgtgatattttgatacatgcatagaatgtgtaatgatcaaatatggtatttagaatatccatccccttgaacatttattatttcttttttattatttttcttttttttttgagacagaatcttgctttgtgcagggctggagtgcaatggtgcaaacatggctcactgcagccttgacttcctgggctcaaatgatcctctcacctcagcctctctagtggcggggactacaggtgcatgccaccacgcccagctaatatttgtattttttgtaaagatgccaccatgccaggctaatttttgtattttttgtagagacagggtttcaccatgtcaccagcccaggctggtcttgaactcctgacctcaagtgatatacttgcctcggcctttcaaagtgctgggattacaggcatgagccactgtgcccggccacatttatcatttctttgtgttaggaacatttggaatcttcttcttctagctgttttgaaatacataatacattgtcgttagctatagtcaccctattattgtgctattgaacactagcagttatttcttctaacagtatgtttgtacccattaactaacctctctttatccctctactgccacatacacccttctagcctctagtaattataattttactctttacctccgtgagatctacttttttgtagcttacatatgaatgagaatgtgtgatatttgtttttctgtgcttggtttatttcactcaacttaatgacctccagtttcatccatgctgctgcaacgacaagattttattcttttttatggccgaatagtattctattatgtatacataacactttatcagttgatctgtcggtggacacttaggttgattccatatcgtagctattgttaatagtactgcaataaacatgagggtgcagatatgcttttgacatactgatttcctttcccttgaataaatacccagaagtgggattactggattgtatggtagttctatttttagacttttgaaaaatctccatgctcttttccataatgactgttctaatttacatttccaccaacaatgtataagaatttccttttctccacatcctcaacagcctctgttattttttgcctttttgataaaagtcattctaacgggagtgagattatatctcattgtagttttgatttgcattttctgatgattagtggtgttgagcattttgtcatatacctgttagccatttatatgccttcttgtgagaaatgtgtgttcagatcctttgtctactttttttttttttttttttgagacagggtctcactctgtcacttaggctggtgcagtcattgtgcactgcagccttaacctccctgggctcaagcgcttctcccacctcagcccccaagtagctgggactacaccacacctggctaatttttgtattttttgtagagatagggtttcgccatgttgcccaggcaggtcttgaactcctgagctcaagcagtctacctgcctcagcctcccaaagagttaggattacagacgtgagccaccacaccaagcccctttgcctactttttaatgagattatttgttttttgttttgttttgttttgctgttgaattgagttctttgtatattctggatattagtctcttgttgaatgaaaagttggcaaatattttctccagttctgtgggttatctctttactctgttaatcgttttctttgctgtgtagaagccttttagtttaacatagtcctgcttgtctatttttgtttttcttgtaattttgaagtcttagctataaaatctttatctagactgatgtcctggaatgtttgcccaatgcttacttctacaagtttcagatcttacatttaagcctttaatccattttgatgtatattttgtgtatgttgagagactggggtctagtttcattcttctgcatatggttatccagttttcccagcaccatctattgaggtgactgtccttcccaattgtacgtacttggtgcttttttcaaaaatgagttggctgtaaatgtatacatttatatctgtattctctattcttttcccttggtctatgtgtctgtttttataccagtaccaggcatgcttatttggttactacaactttatagtatattttgaagtcaggtagtgtcatgcctccagctttgtttttttttgctcaggattgctatgtctatgtgaggtcttttctggttccatataaattttaggattgtttttctgtttctgtgaagaatatcattagtatttttgaaatggattgcattgaatctgtaaattgctttgggtgatactggcattttaacaaaattaagtcttttcatccacaagcatggaatatctttccatgtttttgtgtgtcctctttaatttctttcatcagtgtttttatagttttggttgtatagatgttttacttctttggttaagttaatttctaggtattttatattatttgtagcagttgtgaatggggttaatttcttgatttctttttcagattgtttgctgttggcatatataaatgttactggttttgtatgttgattttgtatcctgcaattttactagattcgtttatcagttctaacagttttatttggtggcgtttttagggttttctaaataataagatcatgtcatctgcgagcaagggtaatttgacttcttcctttccaatttggatgtcttttctttctcttatctgattgctctggtgaggacttccaatattatgttgaataaaagtaaaagtagacatccttttgttgatccgtatgttagatgaaaggctttcaaatggtccccattcaatgatgttagctgtgggtttctcatatgtggcctttattattttgaagtatagtccttctgtaaccactttgttgaggttttttttttttatcatgaagggatgttgaattttattgaatgcttttttaacatgtatcaaaatgatcatatggtttttgttcttcgttctgttaatgtgatgtattacatttattgatttgtgtatgttgaaccatccttgcatgtctgggatgaatcccacttgattatggtgaatgatctttttaatgtgttgttgaattcagttgggctagtattttttttgagaatttttgcatctgtattcatcagtgatattagcctgtagttttcttattttgttgtctccttttctgattttggtatcaggtaaagctgggcttgtagaatgagttcggaactattccccacttttcaatttttttgaagagtttgagcagaattggtattagttcttccttaactgcttggtagaattcagcaattaagccatcagatccagggcttcttttttgtcgttgttgttatgactctgatcttattacttattactcattattagttcaggttttcaattttttcattattcaattatggtaggttgtatgtgtccaggaattatcaatttattctaggatttccaatttgttggcatatagtactttataatgtctctaatgattctttgtatttctgtagtctcagttgttatgtctcctttctaatctctgattttatttatttgggtcttctctctttttatcttagccttggtcaaggtttgtcaatattttcaaacagtaaactttttgtttcattgaccttctgtattttttttttagtttcaatttcatttatttctgctctggtctttattatttcttttcctctaccaattttggatttgatttgttcttgctcttctagttccttaacatgcaccattattagattgttcatttgaagtctttttacttttttgatgtaggcatttattgctataaacatctttcttagtactgcttttgctgtatcccatagattttggtatgttgtattaccgtttttgtattttcaaggaaattttaaatttccatcttaattttttaaattgaccctttggtcattcaggagcatgttgtttaatttccatgtatttgtgaattttccagggttccattgtagtcagaaaagatacttggtttctccttttttgaatgtgttgagatttgttttgtggcccaagttatgttctattctggagaatatttcatgtgctgatgaaaagaatgtgtactcttctgcaaatgggtgaaatgttctgtaaatgttaggcctgtttgcctgtagtttaactctgatgtttccttgttgattttctgtctgggttatctgtccattactgacagtgaggtgttgaagtctctgacttttattttattacagtgtatccctctcttggacctattaatgtttgctatatatacttgggtactttggtgttgggtgcatagatattaataattgttgtatcttcttgcttaattgatccctttatcattatatagtgaccttctttgttactttttacagtctttgacttgtagtctattttatctgatacaagtatagctactcctactcttttttggtttccacatgcatgcaatatctctttccatcccttcactttcagtctacgtatgtctttataggtaaaatgggtttcctagggacaacagatagttgactcttgtttcttttttgatttagccactctatatcttttttgattggagaattttatccatttgcattcagtgttattgataagtaagtactttctactgtcattttgttgcttgttttctagttattttcttattctctcttctccctctcatactatcctcctttgtggttaagtagttttctctagtagtatgttttaatttgttgcattttatttttactgtatttttcataagtttttactttgtagttaccatgagacttatagaaaacatcttatagatataataagttatgtcaaggagatgactatttatcttagatcacaaagacaagacagaaatgcagaaatatttttttaaaaaaaacctctataatctaattccattccccctacgttttcactttttattgtctcaatttacatatttaatatagcttatctcttaacgggttcctgctgctatttctttttgatagatttatcttccagacattatactagttatgaattgaaagcacatcaccattgcagtttcaattattctgaggtttttttgtgtacctatttttacctgtgagttttataccttcacatgttttgttttttcacattagtgttttgctttttttttcttcttccacattgaagaactccctttagtatttcttataagacaggtctggtggtggtgaattctctcaacttttgttttgtgggaaggactttatctctccttcatgtttgaaggatagctttgttggatatggtattctaagatggcagggtttttttgtctttcagcacattgaaaatgtcctttcactcccttctggcccatatactttcgcttgagaggtctgttgcaaaatgcattggaactcctttatatgttatttgcttcttttcccttgctacttttaggaccctctgtttgtccttcacctttgagaatttgattattatatgtcttggggtagcctcatttgggtcaaatgtatgtggtattctatgaccttcctatacctggatatttatatgtttctcaagttttggaaagttttctcttactattaatatttctttgaataagccttctttccctcattcttaatcaactccctcttgaacaccaataattcttaggtttagtcttttagggtagttttcaatatctccttggcagagcttcattcctttttattcttttttgtttctcctatggctattttttttttttttttacatggagtctcactttgttgctcaggctggagtacagtggcgcaatcttggctcactgcaacttatgcctcccgggtacaagtgattcttctgcctcagcctcctgagtagctgggattacaggagtgcaccaccatacctggctctagtaaatgatctgagtgctgcccatcctgaatgaggatggtcccaaagggaatatcctgtcagtgtggaaaggctggctagggatttgggcacaggggaattatggaatatacctcctacagtatgatactgctgaactctgatttggagtctcctctgagtttaagagcggagtttccagggcccaggatgatggtcctatatcctctctttgtttctggctgtcctcaggggtatttcacccttcaggcactcatgatacttcctgtgggttgaggcaaagataggtcttctgtcaggtaacccaaggtggcagggaagttgtaccttgatctcactttttccagtgtagaaactcagtcagagggaaattttccttgcacttggtgccagacagatttggtggagctgcgtcattgatataggagtctgattatcttaccatctgctcagagttttttttaatacttctctgtggccctgggaactgtctcattctcattttaattctgggatattgctggtgataatcttggcattatatttttgtttttggttttcagtggggggagggggtggtgaaaccagcttgcttctgtgccaccattttggagaagaatctgcctatatttactcaattctgacatacacattgttttttatagtaggaatgcatcttattggtagtctcttagatttaatgaaatatacatttattcagtaagtaattactgggcatctattatagatcagacactatgttgggctgtgggcatcagtttgagtaaaacagacatcttcctatcttcatggttttcatagtgaagaaaaagtacagggttatctgagaaaacgtaacagtggagcttaatttagatagacacgtcagggaaggtctttccaagtaacggatattaaaacttaagatgtgaaggataaggaggagtcagtcagaaaacaagtgaactagggattccaggccaagaaaaagcaagagagaaaatctcgaggcttgatctagcatggattgtttaagcagttaaaggacaggtagtgcagatggcccttggtggggtgaatagaggggctaagcagtgaggtagtagggaatgtcatgagatggggttggttcttcgaaccttctgagggcaagtgccaaataatgcagggctcataggggttatgtgaatgttttagccaaagttattaaaggattttaagcaaagatgaaacatcatttttccatttttcatcctgtttttccatttcaaaaacatcactctggctgctgaatagagagttgggggaggaaagcttgatagagaactatttctagcattagagtgaatattggctaggatttggtggtggctgtagagatggagagagggggacaaaatttagttaaaatattgcaggtaggacttagtgatggatttgttacaggagtgaaggagagggaagtcctgagtatcagtttttttcccaggagcaactatctgcgtagaggtgcctgtctgagatgggaatgctgcaggaaggacatatttaaaaagaggtaggagaagagttctgttttggacttgttgaatttaagatgtctatgagacatctaaatagagattttaggaagtaatgtggatctaggggtctggagttcagtagaaaagtctaggtagagatagaaatttgggaaaaattggcatttaaactcctgagagtgggtgggatacaatgtaaacataaaaataagacccaggaggtgaaggttgcactgagccatgatcacaccactgcaatccagcctgggcaacagagtgagaccctgtcacaaaaaaaaaaaaaaaaaaaaaaccacagtagtgcaatctaatcataagaataatattaacataggctagatgtggtgacttacgtctataatcccagcactctgggaggctgagatgggaggatcacttgagccaaggagttcacgaccagcctgggtgacagtgagaccttgtttctaaatttttttttttttttttttgagacaagttctcactgtcatccaggctggagtacagtggcaccatcttggctcttgcagcctccacctcttgagttcaagtggttctcccacctcagcctaccgagtagctgggactacaggcgtgcaccaccatgcccaactaatttttgtatttttttggtagagacagggtttcactgtgttggccaggctggtctcgaactcctgacctcaagggatctgcccacctcagcctcctaaagtgctgggattacaggcgtgatccactgctcccagccccatctctaatttttttttttaaagaatattattaatgagaataggtcacatatcaactgccttctacgtactaagcactgttctgagtacttcacatatataactgatttaatcttcatgatacccctatgtggtaggtattattaccctcattgtaggcaatacataggaaaaccacagggctagtaaacccagaaagtcttatcctgaactattattattattatttttgagatgggtcttgttatgttgccaaggctggtctcaaactcctgagctcaagtgatcctcccacctaagcctctcgagtaccagggtttacaggtgtgcacatcaccacgccctgctctaaagcctgagcctgaattcaattttttttttggagacaggatctagccctgtcgctcaggctagagtgcagtggcaagatcttggctcactgcagccttgacctcccaggctcaagcaatcctcccaacctcagctttctaagtagctgggactgcaggcatgtgctatcacacctggctaattctgttcattttttatagaggtgaggtctcactgtgttgcccaggctgatcttgaactcctggactcaagcagtcctcctcctttggcttcccaaagtgctgggattacaggcatgagctactgtgcctagcaagcctgcattcttaacaccacattaaaagagagaagagacttagcttagaggtctgggcaattctaatagttacagataggatagagaaggtagagctggcacaggaaatgggaaaggaatgattagagaggcaggaaggaaccatgccaggccagagtgttccaggtaggctgccagggtcagtggtgaaacactgctgaaaggtgagcccttaaagaatacataggtattatatgggtgatgaggatgggggaaagggcttgctgggcaatttgagtagagatagatacggagaaaccagctggtgtttgcagttgttaagagggttgaatgcaaggccaggagaggtgagagatgacactggagaagttgacagggccagatcatgaaagatttgtaacattctgtattacagtccattctcatactgctataaagaaatacctgaggccgggcgcagtggctcacgcctgtaatcccagcactttgggaggctgaggtgggtggatcacttgaagtcaggagttcaagaccagcctggccaacatggtgaaaccccgtctctactaaaaatacaaaaattagccaggcgtggtggcacgtgcctgtaatccaaggtactcaggaggctgaggcaggaaaatcgcttgaacccgggagacagagtttgcagtgagccgagattgtgccattgcactccagcctgggcaacagagtaagactctgtctcaaaaaaaaaaaaaaaaaaaaaaaaaaaaagaaagacaagaaaagaaaaaaaaaaaagaaatacctgagactgggtacttaataaagaaaagaggtttgattggctcccgattccacatgctatataggatgtatggctgtggaggcctcaggaaatttacaatcatggcagaaggttaagggaagcaggcacagctggagcatgaggacaagagagggtgggaggtgctgctacacacttttaaacaacctgatcttggtataattcgctatcacaagaacagcactaaaggagaaatcctcccccgtgatccagtcacctcccaccaggacccatcttcgacactggggatcacaatttggcatgagatttgggttgggacacagactcaaaccgtatcattctgccactggcgcctcccaaatcttatgtcctcacattgcaaaatacaattcccaatagtccaaagtcttaacttattccagcattaactcaaaaatccaaaatctcatttgagacaaggctagtcccttttgcctatgagcctgtaaaataaaaaacaagttagttacttccaagatataatggaggtacaggcattgagtaaatactccctttccaaatgggagaaatcagccaaaagaaggggcctacaaacctcatgcaagtacaaaacccagcaggacagtcattaaatcccagcaggacagtcattaaatcttaaagttccaaaagaatctcctttggctctctgtctcacatccaaggcacactgatgcaaggagtgggcccacaaggccttgggcagctccacctctgtggctttgcagggctctgccccaccccacagctgctctcaggggctgggattgagtgcctttggcttttccaggcacatggtgtaagctgtcactgtctaccattctggggtctggaggacagtagccatcttctcacagctccactaggcagtgccccaaccccacatttccctcctaccttgccctactagaggttctccatgaaggctctgcctctgcagcaggcttctgtgtggacttccaggcttttccgtacatcttcttaaatctagccagattgattctcttgaacactttgctgcttagaaatttcttccaccagatactctaaatcatctctctcaagttcaaagttccacagatccctagagcaagggcacaatgccatcagtctctttcctaaagcatagcatgagtgacctttaccccagttcccaataagttcctcatttccatctgagaccctctcagccttgccttcactgtgcatatccctatcagcattttggtcataaccattcaataggtctctaggaagttccaaactttccctcatcttcctgtcttcttctgagccctccaaactgtttgaacctctgcccattacccaggtctaaagccacttccacattttcaggtatctttatagcaatgccccacacctcattaccagttttctgtattagtttgttcttgcattgctataaagaaatacctgggactgggaatttataaggaaaagaggtttaattggctcatggttctgcaggatgtacagaaaccatggctggggaggcctcaggaagcttccactcatggtggaaggcaaaaggggagtgggcacatcacatggcaaggattggggagagagaaagcaagagagagagcgagagtgtgagtgagtgataacgatcttgcgagaactcactatcacgaagacagcaccaagccatgagggagccgcccccatgatccaaacaccttccaccaggccctacctccagcattagggattataatttaagataagattgggtgaggaccaatatccaaaccatatcattcctccactgaccccttccaaatctcatgtccttctcacattgcaaaatacaatcacaccttcccgacagtcccccaaagccttgactcattctactattaactcagaagtccaaatccaaagtcttatctgagacttttctccttccacctctgagcccataaaatcaaaacaagttgactactgccaagataccgtggggtatggacatttctcccattccaaaagggagaaattggccaaaagaaaggggctacagacaagtttgaaacctagcagggcaatcattaaatcttaaagatccaagataatcctgtttgactacacgtcccatccagggcacactgatagaaagagtgggttcccaaggccttgggcagctctttgtctgtggctttgtagggttcagcccctagggctgttcttatgggttggagttgaatgcctgtggcttttctaggctgaaggtgcaaggtgccagtggatttacgattctgggatctggaggatggtggcccccttctcacagctccactaggcaatgcccccttgcaactctgtatagggcctccaaccccacattttcctttggcactgccctagtagaggttctctatgagggctttgcccctgcaggaggcttttgcctcggcacccaggctttctcatacatcctctgaaatctaagtggaggctgccaaacgttcttcactttttattctgtacacctacaggcttaacaccacatggaatctgctaagctttatggcttgcattcttcaaagtggcagcttgagctgtaccccggcttttttgacccttggctggagctggagctggagcagccagcacgcaggaagcagagctctgaggctgtgcagggtagtggggccctaggcctggccctctacaccataatgtcctcctaggcctctgggcctgtggtgggaggggctgctgggaaggtctccgaaatgccttccaggccttttccccattgacttggctgttagcacttgtctctcttttagttatgcaaatttctctagcaaatggttgctgctccacagcctgcttggatttctctcttgcaaaagctatctctgccacatggccagcctgcaaattttccaaacttttatgctctacttcctgcttaaatatatattccaactttaagtcgcttctttgctcctgtacctgagtgtaggctgttcgaagcagtcgggccacatcttgaatgcttttctgccttgaaatttcttctgccagataccttaaatcatcactctgaagttcagttccacagatcccctagggcgggggccacattgtagccaagttctttggtgaggcgtaacacacgtgacctttgctccagttccactaagttccacatttccgtctgagaccttctcagcctggccttcactgtctggatcactatcagcattttggtcacaaccatttaaccagtctctaagaattccaaactttctttcttcttcctgtcttcttctgagccttccatatgcttccaacctctgctgttacctagttccaaagttgcttctacattttcagttatctgtatgtgaggcaatccctcactcctagtaccaattttttgtgttagttcattcttgcattgctataaagaaagacctgagactgggtaagttataagaaaaggggtttaattggcttacggttctgcaggctgtacatgaagcatggcggcatctgcttctagggaggcctcagggagctttcacggtggaaagcaaggcaggagcagacacatcacatggcaaaaagcaggagcaagagacagagaaggtgggcggaggttgcaacacattttaaaatgcccagatctcacgagaactcactatcacaaaggcagtagcaagccatgagggatctgcccacatgattcaaatacctcccaccaggcctcacctccagcattggggattacatttcaacatgggatttgggcagggacaaatatccaaactgtgtcatttcccaagttagcaaaagacctagaagtgtcgattcccaaagctggggagcaacacaaagggagctgcctgttataagtgggagggaaatacataccggcacctgtctattatttcccaggtactgttttggcaccttatccatattgtctcatataatgtatgtgttgtttgatgtttaatgccatgattccttaaatcttaccatgttaagacattttagttaaaatttaaaaaattacccatgacttctttcatcactacatcatttatcagggtgatagatagtctatgtgggaggaagacccctatataaagaggcctgtacatatttaatatgacttccatttaatacttttttctacattgagaacaagtgttgaaaatgataggaaagtgtgagttgttttgcttagttgagcaactttggtcccaatcaggagaaagtgattcaatgagattgtgtttttcttattcttccttatacaacctaatcattttgaaatcagagatctttctcggtttgaagtctgcttctgccatttattagctgagtgactttggggcaagttatctaacttctctcaagtgttttgttgaataaggaacttctttaataataattataaagcatattatgaggttaagtaaagttaggacttttctttatcctgatcaaagtcctgtgatgaatacaacctatatagttcgcttccctgttggtgattctgttttacctttgattattttaattatttagaattttgtggtttaaaataccaccagctaattatagatggaaatactaatttttcttgatatgcatattaacactgttcttaagaagtgagatctagttctgaaaataatctttacacgaatgttaaataactacagtgtctaaaaatactcattccaaagctctgtcatctcacataaaattttagaaaaataagaatatttaatttttgctacttaatggtgacaaagcatatccatcaatttgcaagttcttgttttcttcctaaatttaaaatgataatttcagtgtctggagggagctgacttgaacttgattttccttttttttttggagacagagtcttcctctgttgcccaggctggagtgtagtggcacaatctcggctcactgcaacctccgcctctcaggttcaagcaattcttgtgcctcagcctcccaagtagctgggactgtgcaggtgcgtgtcaccactcccagttaattttttgtattttagtagagacagggtttcaccatgttgcccaagctggtcttgaactcctgagctcagacaatccacccgcctcggcctcccaaagtgtgatttactttttttttttttttttgagatggagtcttgccctgtcgcccaggctaaagtgcagtggcccagtctcagctcactgcaacctctgcttccctggttcaaacagttctgcctcagcctcccgagtagctaggattacaggcgcccaccaccatgcccagctaatttttgtgtttttagtagagacggggtttctccatgttggccaggctggtctcgaactcctaacctcgtgatctacccgcctcagcctcccaaagtgaagcgtgatttacttttaaaccaggtacatttcacagtatatgcaaggtaacttgcagagtcagcaaaaaaataaaaattttaagtcaaccctatgattttgttcatttatagaagttcatgaacctgagctcattcattaaaattttagtcttcagcatcctcagattgtttttttgctgttattgactaacctcatttttggtagagccttcattctcttgtcagagctcattggaacactgcaggatggatggcaagctgattggcatggctttgacatgttgtcttagatgagacattcttaagtttcaccagatgacatgggccagtttaatagctgttttcattatgataccaagaacaatttgggggtggaggaggggaattccttcataataaaatctactgttttggccaggcacggtggctcacgcctgtaatcccagcactttgggaggccaaggcaggcggatcacaaggtcaggagatcgagaccgtcctggctaacacggtgaaaccctttctttactaaaaattagccaggattggtggcatgcacttgtattgtagtcccagctacttgggaggctgagggaagagaatcgctcgaacctgggaggtggaggttgcagtgagccgagatcgtgccactgcactccagcctgggcaacagagcaagactctatctcaaaaaaaaaaaaaaagaaaaaaactgttttaacaatgggtgggcatagtggagtagaaagaatgtatggctcctagagtagacttggaacttcatctctatcatgtttaaggtttaagcctcaatagctgttaaaatgggttagtactggggttagttattgtgattatttgaatgaaattatacatgtaaaatacctgggcctctactggcacacaaaaggtgctcaataaatgttagctctggttccttataagcctttgctaagtcctgtcaagcagagttggttgtcattcagctcctcggcagcatttctgtgacgctgcagtgaggtacaggacacttctgctcttcacttctcgactctacccagaatgcaccatgtgttcagcactccacaccccttttttctcttacacccattttactgtgaccccttgccctgatctagaccctctggctttcctttcttcccatctgtccccctccttgctgctccaggagatggctggtggaggtggtggcgccagcatttcttttccttctgaggaaggaatttgtggtagggtttgggtggggactgaatctctgttctggaggtttggggtagcttccactctaaacacatgaacatgaagggaagagttgtgggtttgtcgggggtgggaggagagaaaaggatttctcattacttctctgctccccacatgcctagctctttttccttctgtcacacaaatatttcttacataactgtctaatgcatcatgcatattctctgtttctggaaattacagagcctttcagaagattttgggagtgtttggtaagaccgataattctttttgtccaccctcttggaagctaagaacactcatataacaaaagttttttgaaaaattattatgggcagtccctgctgaatagacaaagttgaaaaagatacagctctccttgcaaggagctcacagtctttaaagataggcacccaaagtcatcatttagtgggataaggattctagcagaagatcgtataaggtaatagagatgttgagaatggagagccaaatgaggagaagaagtcaggaaaagcctgttagaggaggtggcacttgaacacagaattgaggaataaataggagcttgctgctgaagagggaagagattgtgtttcagatggaggaaacagctacagcaaaggcttacaagtgtgaaacagcatggcttgttcagggtatagcaaacccatagttttctgtgactggagaatagaagtggcaagtgaaaattggtggggagcaggatgaaatgtttaagaatatattccatcaagggccttcaatagcgtaagtagtgttctacttatgaacctaagtggtgggcatatggaagttcattacgtcattctttcattcaacaaattatttatgtatacacacacatgcagacacacacacacacatcctcttgtatgacatatttcataacaaatttaaaaaatacaaaatacaccattactaaggggggcaattttctagatttcctagtttctttaataatttttgtttccttttttctggggagctcatcatgtgcttttagaatagtagttcctgaattttttataccaaaaacatgctctaaagactatatgaattacttagtaatcatgtgtaacatccgcattaatgtcagatttcagaggagggggtactggtgacgtttcaggatttcttccctgctttagttcaaagcccagaggagcacttagtttttgtaatatgcttgattgaattgtgacataaagcactcatttttgcaaacattcacaatgggctatcgaaagtgagccatggccgattctgaattgccaagctgctcatgatttaatacagaagctaataaagatgtgcacatgtgctataaagcaaataatgtatatgggagttagggggagaagagagaagatcatatgggtcaaattctttgggttttgagggctggtcagtttactctgttaatgctgttagttttgttcccaaaagtgtctggggcatcagaagcaactgcttttggtgcccacaccctcagtgttccttgacagacaaaacacaagttagcaaaacttccagtgagtcatctgcatcaatcaagggcctcttcagtgttgtcatcatggtaagataccaaaagaaagatgactggtgggccaggtgcggtgactcatgcctttaatcctagcactttgagaggccgaggtgggcagatcacctgaggtcaggggttcaagaccagcctggccaacatggcgaagccccgtctctactaataatataaaaattagccaggtgttgtggtgcatgcctgtaatctcggctacttgggaggctgaggcaggagaatcgcttgaacctgggaggcaaaggtagcagtgagcagagattgtgccactgcactccagcctgggcaacagagcgagactccatctcagaaaaaaaaaaagaaaaagaaaaaaaaaagatggctggtgcctccttaaacatgcaaggctgggtgtaacccccaaggaggtgcaagggcagtgctgggtgagccaacactgtttggtgcctctctctggcatgttccagtgccagcatgtcccttgaacgtgcctttctagtgctcttcttttagactctgtcaaaattacctcattgctgccaggcaggcctcattaaattgtattgtggaaggacagatgtcttttattttccttgcaagctattatgcaggttaaatctgtgctagcattattttctcagattttagctattataaaatttagtccgtcttcattttattctcatcctgattttttgtcaagtggttcatttgaattgtcacaaatctttgatgtgtgtttacattttatgtagtttaggtttattttctcatttctccctccctaggttttttctttaatcccaatacctcaaatctcaggctcttctttttccttctcctaccagtttctacatcattatttactttttctttacctactacttcatgagtctctcttctttaagcctctgattcatgccccatctcaaccctgcttggtggcctcaaactctggtatggcttcatggaaaatcctgagctaagcctgtggaatgttgccaatttttctcacctcttttccttgccttaccttatctcagtcttaaataaaatcaacatatatgtgctgcccacaaactatgggccaggaacttggctgacctcaaaggggattcaaagatggctttgaaagagtatatagtctggtatggaaggtaggtagattcataaataactaaaataaggtttcaggtagcataagtgagatgtttgagagactctcacaagataatgagggactagatctagagtagtgtgagtggagaagaggaaacggggatcactgaaagagagcctaaccctttgttagctaatcatgacagaatccagctacatgacagtgttaccgggtcgtccttgctcccagagctcccaagatggtggcaggccacttccaaaatggcggcgggccacttccaagatggtggcaagcctcatgttctctgacctggggttcttggcctcacggattccaaggaatggaatcttgggccatgcggtgagtgttatagctctattagaagccgtgggtcacggaagagaactgtggaacccagtgactgactagtgttcagctcgattaggacgaacccgggcacttagccatgtaggaacgatggcaagcctgtagccctatcgggagcagcagtgggcgcctagctggatcaggagtacagcagacaccctgctggatccaccctgtggaagtcagccacaggtctgtaacagtggcaaacagcagtggtggacggcgagcgaaagctcagctcgagccgtaacaaacacagaccaaaagaaagtgcagttgcaagatttaatagagtgaagacagagctcccatacaaagggaggggacccaaagagggtagccgttgccggctggaatgcctgggtttatatcccgatcattgtccctcccgctgtgctcttaggcgatagatgattagctatttctttacctcctgtttttgcctaattagcattttagtgagctctctgatggctcgggtgtgagctaagttgcaagccccatctttaaaggtggacgtggtcaccttcccagctaggcttagggattcttagtctgcctaggaaatccagctagtcctgtctctcaacaggggctttcccttgccttgctggggctgtgtccagtttgattcactttggccagggttattgttttctaactgcttctttttcaccaggagggccttctgcagactaagtaggcagtgtctatccttgtttctgattcctgcccgactcacactgtgtcccatttctaggttcctcatgcgttccagtggccttgtcttcttgcctgccttcccccagtcttctcaccggatgtgactggacaagtttagttctattcctgccatgtgtattgctttgcggcctgggggaggcagggttggaagtgatgaaagcagtaggaagtggcatatcaggttgagatttccctgtttcagcatctaaggtatatatcctcaaactgacccccttctggcatagttgtttctgcagagtcactgatctcattggttaagatggaaaagaaccacagaaaggcaatggtaataatagaatggtttctgacctatttctccttggatgctttcctcagaggtaaagctaagataaagaggaaattggttatcagggtggtgttcagtgtttaaatatcttgcttttggtgaatatgagggccttatcctcccactgcttatctgtaagtgttgttaacatctagcccttggaaatctggtctttggcaaagtatctactttttgcaaaatacttgtggaaatctgagctggagctccctactaacacagaacatgaaggcactttctagatttaaagtctcctcatgtttaggcactggtcagtcatgcttctacaaactcacttggacacattttccttttttgtgttttcatcagtcaaggtgataggtcatttcatgattctgaatatctctctctctttttttttttttttttttttgagatggagtcttgctctgttgcccaggctggagtgcagtgacttgatcttagctcactgcaacctccacctcctgggctcaagtaatcctcccacctcagcctcctgagtagctggggttacaggcacgaaccaccatgcctggctaatttttgtatttttagtagaggcggggtttcaccatgttggtcaggctggtctctaactcctgagctcaagtgatccgcctgcctaagcctcccaaagagctgggattacaggcatgagccactgtgcccagcccgactcttaatctctttatatttatatatcttttctggaaccagtagtgccttccagagaaagctacaaaagtgctgtctttgtaaagtaagcttcagagtgggagcagttagtacatagaaatatttattacatgagtaaggctttagtgatatgtacagatattactcagtttatggactgtgtccctgggaaaaaagttgtaaaacaaatttcagtaacatgtttgatatatgacattagaaatcacttcctatgggaaaaacagtaacaaccccaccttgtacttatatattggtttatacttttcatgaagtttctatgtgcgtaagcctttgcaataaactagaagactattgttgtcatcctcattttattgttgcctgaaataaaggccaaggcccatctggtggccctgggagtagaacccatagtctaattccatactctttcctctgcaaactgtttagattaaaagtttgtatgtgttggtaataataagagaaaattaaagcaattgagcgagcttttaatcatgctacttatattcaatttaaagagatgccttttattctgatcttctttcgataagttcttactaagcaccagctctgtgtcaggtactgttctaagtactgcctgctgtgttgaacaacacagacacagaacttatgttctaatgaaggaagagagatagtaaataagtaaacaaacaagaacataacagcaggtgatttcagatagtgaataagagtgctgaagaatgtaaaatagagaatggtaatagtagtttggattgatttccgctagaaaggtctgggaaggcctctctgaagaggtttacatttgagctatcatataagtgagaaggaggcagacataagcagatctgggagaagtacattatagagggcttaacaagagccagggtctagagacaggagcaaacaaaactgtgttcctgaagaactaaaataagatctgcatagtgccggcttagaggttggcaggggaaggaaaggacaggtcatgaaggcccttgtagaacatggtaagggatttgtatgttaactatgatggccaggccaggtgtggtggctcacgccgtaatcccagcactttgggaggccaaggtgggaggatcactctctgaggctaggagtttgagaccagcctggccaacatggcgaaaccctgtctctactaaaaatacaacaacaacaaaaaagtagccaggtgtggtggcaggcacctgtaatcccagctacttgggaggctgaggcaggagaatcgcttgaaccccagaagcggaggctgcaatgagccgagatcatgccattgcactccaacctgggcaacaagaggaaaactctgtgtcagaaaaacagaaaacaaaaaaactgtgatggctatttgtcctactgttttcttgttaaaatgtcctttattttgtaaaacgatggtgatattagacagtaaattggtatttatgttgcctctgctgagtgtgagggctttagcctctacttgtctgtaagtgctgccaataattaatggttttataatcttacttgtcaagactaaaagttagttaataaccttatatcagtccccaaactttaagtaaaaaattttaccagccatgaaatctagtagtttggaaactatggcaatataccacagcagcttcccaataggaaggcttgaaaatatttgtcagtaaagaggttaacataggctgggcatggtggctcatgcctgtaatcccagcaccttgagaggccaaggcgggtggatcatgaggtcaggagatcgagaccatcctggctaacacggtgaaaccctgtctctactaaaaatagaaaaaaattagctgggtgtggtggcatgtgcctatagtcccagctgctcgggaggccgaggcaggagaatcacttgaacccaggaggcggaggttgcagtgagccgagatcgtgccactgcactccagcctgggtgacagagtgacagagtgagactccgtctcaaaaaaaaaaaaaaaaaaaaagaggttaacgtaatatccaggacagtggcatggcatgctgaaatgtttttcttaatttaaattatcttgaatctcagatctacctgtactttcgttcacccactttcttttcgctttctcctatctgtaagttcatcactgggtcatataaatttctcttgtacttgggaatgaccttgttacaagcttccagaactttgtgcccagtacttagaatagtcattacattatcacagttctttgggaagttgccccatatttaacatactcaaatccaaatgctccttctcaaagctccaagtaaattagtaccctgattattgttaaaaatgaaatctagaggtgaatttacatgaaatgaggatacagatacaggccagagaccgggtttagtctggcccatgccagccatgattgattgtgtcatgtctttcccttgctggctgaatctaggattcctgttttcatatgtgatttgttcatgaaaatgggcatttaggtttagtgtatgtgtgttttaaagggaaatttcttcccagagagtccaagcacataaaaacacttcttcaatgtggtattcgaaagatttatgcatgttagtatattttgttctttttcttcaaaattgaccacataatcttctggcttatgtccagggagtatctagttgaggcaaaatatttgctgctttgggaatccctgatgattaccatgcctttttcatgatgttgaggctacaggagctaagcttattagtgactggctgtgccatttttaccatttcccactcatctttataaaataatgaaggcaaaatgctgaacaaccgtgtttcttcagttttaaaaaatctgttatttttattctcctcttctccctactgtgatggctcctgaaggatgtctgagaaatcactaaggctttgcagagcacaggatgcaaaccaccataaaaaaatccaaattgtgggccgggcacggtggctcatgactgtaatcccagcactttgggaggctgaggcaggtgggtcacgaggtcaggggttcgagaccagcctggccaacatggtgaaaccccgtctctactaaaaatacaaaaattagctgggcacagtggcacatgcctgtagtcccagctactcgtgaggctgaggcaggagaatcacttgaacccgggaggcagaggtggcagtgagccgaaatcgtgccactgcactccagcctgggcaacagagcgagactgtatctcaaaaaaaaaaaaaaaaaagaaaaagaaagaacaaaaaaatccaaattgtaaacccagccataaaaagatggcagtgctgttgaaactggcagaaccacaacaccatagcttcaaaaatagatcttatgtgtacattttaacctaaaattatactttcaggtggcatttactgtgtaaagcaaagtcaagctttgatcataactgttttttcagagcacactttttatataatttgggaatggtggtgctatgagagctaaaatattttttgtttactaatttaaaaagtaaatttcagctggacgtggtggctcacacctgtaatcccagcactttgggaggctgaggcgggtggatcacctgaggtcaggagtttggagaccagcttggccaatatggcgaaactccatctttattaaaaacaaaaaaattagctgagtgtggtggcaggcgcctgtaattccagctactcaggaggctgaggcaggagaattgcttgaacccaggaggcagaggttgctgtgagctgagatcatgccactgtactccagcctgggcaacaagagcttaactctgtctcaaaaaaaaaaaaaaaaaaaaaaaagtgaatttcatgttggccaagatttcttttttcataaattgtttaattataaatagttatcatatgtttatatatgattgtaaaataattgatttgctagtttaaatttttttctttttgtcttctagtttgccagggtttggatacctgatccagaggaagtctggaagtcagcagagctgctcaaagattataagccaggagataaagtcctcctgcttcacctcgaggaaggaaaggtgagatctcactttcatttgttgtcattggcataaagtgaagggagttcaaaagtgtaaatttactgtgaagtaaactcccaatggaagttaaattttgaacttacctagaatttttacttactaaattggtaaaaatggcaaactcagttttctatcctgatagtgtttttaatggcatagattagtgaaaatagcagatactttaaaaagcttctattttggcctgtgaatttattatgattatcaggtttagattcacatctaatcctaaaactcttgcatttaactggtgtgctatggggagtgcttgtagtgtttttaaaaagaggcatggtgccaggtcttagaggagactcattggtggcagcatggagagcaaaactgaggggaagatactagttgggaggaaggcggggaagaattaggccaattaggagggcttttaataccaaactagggaattaacttatttaacatttattggtcatctgctttgttaggcaaaatgttcggcactttggagtgaattttctcacattaaatttcacaccaaccctatgggttggcaggtgatataatcactattttccaaataagaaagccaaacttcaaagtcattaagtagttttgctcaaggtcacacagccaggaagtggcttttggaatttgaagtgagatttgaacacagatgactctaagatgagtgcttatactatttgactatattggatttttgcagattgctggccatgaccagttgcttaaggtgatgtctgccatgttatccactgtaaagttactgttttccctttgtaattaatgaatgtcattgtgttggggcagatgctttgaggccactcatatatcctgcttctccttaaacttttcctgctaatatttgcccagtgttcattactgtgtcttgcctgcagcaaatatcgttgtgttctagtggtgattctccatttctttccttccttctatacttattaactagaattcttctatagggaaggaagtattgtttctcctctcccatttatttattactttaatcatttatttattatgggctcatgggtatttcttttattcttcattactatcattatttattttatcaattaaattgttccagctttggtcattgagatctctcttagattgggtcctttgacttttttgacaggtccctatccttttttatttttttttgaggcagggtctcactttgtcacccaggctagagtgcagtggcttgatcatgcctcccaggctcagcctccctccctagtggctggaaccacaggcatgagccaccatgcctggctaatttttaaatttttttagtagagatggagtctcaatatgttgcccaggctagtctcgaactcctgagctcaagcagtcctcccacctcggtctcctgaagtgctgggattataggcatgagccactgtgcctggcttattttttttttttttttagatatagcacttctcctggtaccctaagatacttaccctgtatttcccctttcccagccctgttaccttatattggaggatagtatttgacagccaagatctgagcactaggtgtgctcattgctattgagatgacaccacttctcagccctcttagcatagagagctagaaaaatatatacatggatggatagatagatactaatatgtatgcatactatactaatgtatactcaaccatctatacttaatttatgtctatgtttacatatgtatgtatgtgtttgtatgtatgtattttatatatataatgtgtttttagagatggttgtcttgctatgttgcccaggctagtcttgaactgctgggctcaagaagtcgttttacctcgtcctcccaaagtgctgggattaaaggcatcagctactgcactagacttttttttttttttttttttttttttttgagacggaattttgctctgtcacccaggctggagtattgtggtgcaatctcggctcactgcagcctccacctcccgggttcaaatgattcttgtgcctcagcttcctgagtagctgggattacaggcgcatgccaccatgcctggctaatttttgtgtttttagtagagacaggattttaccatgttggccaggcgggtctcaaactcccaacctcaagtgatccacccacctcggcctcccaaagtgctgggattacaggcatgagccactgcacccagccttgactttttttaaaaaaaataaaacccgtgagttaatagggatccttttttctccagtccaatgccaccaggttcattctattattcttcctttgattatgtgtactataacttctctttttggttttcattagctatattacttattcattatagacataaagttatttcagaattgctaatccataccctattataagaagcagatttgccaaccagagtacagtgtctatgtttaattttattaatccttagtattttttaaaaatctagaaatagaatgatacatacctttaataaaagcaagactagggacaggggtcaaacaagaagaacagacattataaaattcctgaactattcaagaatcattctctttttagaaactatagtcacttagggtcctagaataaaatagagaaagcatggcttttgtaatagtagaagagtatatttatttaatgatgtccagtgattccagaggagcagtttatgtccatttaaagcctaactccaagaaggaaatttctgtgaagatgttacagatcttctctacctttcaaattagtgtcttctctaatatttcaatttcagcttctccccacactagccacaaacaaccccaccctgtaatgaagactgaggaaagagctctgggttgcccttctgccattctggagtctcctggctaataccagaacagacaattgtgtatttacagggccaatgcaaggaccagtcagccccaggcaagggtgatattctctgataaacaggcagcaagaaatgctgagtggtaaattgttaatttttctctcctttagcataattcgttcaaatatgatttgaatatttgacctctgtatatatttttagtattaccataactggctttttacaaaaccttgtccctccctacaactaaattgaatttttattcctattcacttgtcctatgttatttgcccctttatatagttaagtgacaatattcatggttggctgtgccataaagccgtattcccgtgactttaaagtgaatagtggctagtaatggtcactcacacctgtaatcccagcatttgggaggccaatgcaggaggatcccttgaggccaggagttcgagatcagcctgggcaacatagtgagacccccatctctattaaaaattaactgaatagtacttgttaacttttgggaccaggaaccctattaaaatgtcgtttgttttgttttgttttgtttttttgtttttttttgagatggagtctcactctgtagcacaggctggagttcagtagcatgatcttggctcactgcaacctctgcttccagggttcaagtgattctcctggctcagcctcccgagtatttggaattacaggtgcccaccaccatgcctggataatttttgagtttttagtagagatggggtttcaccatgttggccaggctggtctcgaactcctgacctcaggtgatccacccacctcggcctcccaaagtgttgggattacaggcatgagccaccatgcctggccaatttttgtatttttaataaagacggagtcttgccatgttggccaggctggtctcgaactcctgacctcaggtaatccgcccgccttggcttcccaaagtactgggattacaggtgtgagccactgcgtccggcctaaatctgatgaatgaataagcatatgcacagaaaaaaacaaaaagcaaacaaaacaaaaatctcatgaaaactatgaattgtcttgcctcaaaaaaagtacacatatgtgcacatacacacagagttgttgcacgtaatttcaggggattcttgggtatctagtggtttaaggattcctaagtacttaccacatgccggacttgcctcatttacttttttaccacaaccctgttagcccattttacaaatgaaggatttgggtgaaatactgtaactcaagaccacataaaaagtaagtattagtatcaggatttgaatcctgggcaatctgatcctagagccaagctctcgaccactcttttatattgtccgccacttttttataggtaaaaggggttggaggagagaaacatatttaaaagtttaaaacttctgattcagtacgtgggtgaaaaaggtctaggctatggctttcaaagtatattagcaaaaattgttaatacaggttggtatgtctaatgaaaacgcacttcatattgtttccatctccaccagtttatgtgatattggaaggtgctaggaaaataatgcatttaatagctgagaagcaaatcaggaataggaagtaagcaaaatgcatgggcctctttcacagtccttgccataattcatccagatgctgtgccttgtgcattttcaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtaagtatgctttgctttccgaatagactgtggactctttcctctaatggacatagccatagaaatattgtacatggggaaagcaggctgtggttggattttctctaagagacaaaatcacttgagcgttatcagaaagatttaccaagttgcatttatgctgaataaactcatttgtgaccttacataattttgctaaaaataaaaagactgggcccatcttttggaatttttttccccttacagaagtcatatgtcagatttagtgccaaattcaccagttgttttcttctcttccaaaaactactacacgaagagtagatgtccaaggacttatctttggagcaggttcaagagatttagtgttatcttgtggtcaattactcagccatgcagaactaacttgactcgtggtgattcgtcttgctcactcctgcttgcctgggcccctgctcattgcagtgttagctgccagccacccagctcatggtgctttttatctctccaagaaataaagcctctgcatgtgtgtgtgtttgtgttcctttcccccttctccagctttccttcttttttctctctttcccagtttgttcttatcttttattttctcccttttctctggctattttttctccgctgacgtcttaccattctttcactaatcactctgtcctcggaagctcaaatctggatttccattcattcgtgtggtatatccaactcagtgctcatgatttcttcattactctcctgttttagacaggaacagccaccttttcttcttaaaataattaacatcctttatatcattgatactaacttttcctttctggtaactatttctgtttctcaattgttatttttcttccattttttttccttgcacatgtgttaccttctcagtgaagtcttgtctagccaccctatcaagtcagaaacccctccttactgtgtttcttccctgcattattttttgccttcttttccttattacaatttaatctgagattatgtatatatatattttcttacttatcttgttaattgtctgaatttcccactagagtttaagttccatgagggtaaagattagtcttttttgtttgtttgtttgtttactgttgtaagttcagcatttagaaatgactttacacatagttggagctgaataaacatttattgaatggacgacttcattaagttaatatacacctacagaaaaattcttaggaaatacagaaaagtataaaaaaaggaaaaacaattatatgtaactcaccactgaaaaatagccagtattaatattgatttacatcctttctctttgtatgcataagttgatagaaaattggaatcagtctatatatagttttgtattatgttttcctatgacatttaatatccttcaaaaacatgatttggaccttctcagtgaagtcttgtctggccaccctatcaagtcagaaacccctccttactgtctttcttccctgcattattttttgccttcttttccttattacaatttaatctgagatttattgaatggacgacttcattaagttaatatacacctacagaaaaattcttaggaaatacagaaaagtataaaaaaggaaaaacaattatatgtaactcacctgtgctgtggcttaccctgtaatcccagcaccttgggaggctgaggtgggcagatcacttgagcccaggagttcaagcctgggcaacatggcaaaatcctgtctctacaaaaaaaatacaaaaattagccaggcatggtgttgcgtgtccatagtcccagctacctgggaggctgaagtgggaggatttcgtaagcctgggaggtctaggctgtagtgagccaagatagtaacattgcactccagcttgggtgacagggtgagaccctatctcaaattaaacaaacaaacatgattggtggtagtggcttagtagtctatcatatggatgtaacagaatgcattcaactagtctccttgccctatatattttgtttccattttcactgttacagataacattatgataaacatctttgtgaaaaaaaaaaaaaaactctttgcatgaatttctgattatttcatttggataaattgtagaagtaaagtggaatttttggattaaatatatgaagatatttaaagttcttataacattgccacattattttaagccacctagtccagtttttaaatggtgttttaggcagaactatgtataatgggttcagaggcaaaggctatgatacattttgatccttgaacaatttattggtttaatattaactaaattgaaatgaaggattgtgttaactgtgagtctcactttactaagtttgatatgcccattagggtatcattgacttctttttctttcttgtcccctaccctattcccaggtatagtcctagtagctataaatccctatgaacagctgcctatttatggagaagatattattaatgcatacagtggtcagaacatgggtgatatggatccacatatctttgcagtagctgaagaagcttacaagcaaatggccaggttggtagaagctttcattgttattttatggcagttattagatatgataatttcttcttgctaagtcacatatattttaaagtgaatggcaaccttgtaaataattactaaataagcagccttgacaagtttgtctcaggtgacttggattattattaaataataaagtgggccaggtgcagtggctcatgtctgtattcccagcactttgggaggccaaggtgggcgaattacctgaggtcaggagttcgagactagcctggccaacatggcgaaaccccgcctctactaaaaatgcaaaaattagccgggtgtggaggcacgcacttgtaatcccagctacttgggaggctgagacaggagaattgcttgaacctgggagacagaggttgcagtgagccgagattgtgccactgcactccaacctgggccacagagcaggactctgtctcaaaaacaaacaaacaaacaaacaaacaaacccctcacatttataaagggacatagagtttttaaaaactgcctttgaaatttcatcatgatcctgtgactaggaaaagacagatgcagatgttatgttttacagatgaaaggattagtgtagtggtattaaatgacctacccaatgtcagtcagcgaatgagtaatagactagaactaaaaagcctaggagctgtaaaaaaaatctttctgaatcctagggaattaaatctaaaggaaagtgtgaaatttttttctttcaagatggggtcttgctatgttgcccaggctgggcttgaactcctgggctcaagtgatcctccttcttcagcctcctgagtagttggtactgcaggcatacactaccatgcccaactgaaagtgtgaattttaacattagtattatatgatagggcatcagttatcctgaacagcatctgcaaaatgtctcttatattaaccatggaaccctaacattttgagggtggaaaatgggagaaaaatgttactttcaggactagattatgctcttaataatataataaaatataaaactgtgaatgtgtagaagaatagtttaagtttaattcatttctccagcctacaaagcagaacacattataaatataatatgggaaacccacgagtaatttataaggtggaaagaaaactaatactgcagaggtttttattttgtcctctccagccagggagagtatacatgattggtccagcatgtgacagaattttagaattatttcagggacaaaaccctagaaatcattatgcccttttaataataaaataatattaatatggatacttctaatagcagctaacattatgtgctctgtgaagggcattatttaattgctttccatttttaactaattttattcttatagcaactttctgagtttggtattattaattttcattttacaaatgagaaaaatgaagcacagagaagttgtgtaacttttctaaggtcacgtaactaggaagaccagttttcaaattcaattagtctgacattatgaaatattaatgtattaaatataaaatgactaaacataggttagcactacaaagcatgtcatattatgccagcttctgctataaaatagtaattagtgttcaaagcttaagaaaagttattttttaagcttaaaattgagaaaattccatctattggtatgatttttttcccttaagttggaaaaatctaccagtagttgatttgtatagtatcagagcattgcagtacagtttcgacaccacttagtacaacctgagaactactgggcagagaaaaaatcacatgggtggctagactctaaaaataatctctgaaaattatatagtgctcagagaattatatgactctttggaaaacagtattcttaaatacaaaagcatagctcttaccatctttgttactggtctttcacagatagtattaggtttatatgaatatttatggctttttacctttagatttaccttggtttcctgtaattttctcttctcattattatctgttgtgactcagtcactcaaggtaatttcttaactgaagggttgttttgtcttttttcctttggcttggttttctttttcagacagctttaaaatatgcctcaattagttatggtattatatttaccatttatataaataaatctatacccataacatctgccacagcagtaaaatagagtgtatctattcaggcttacagtcagaaataactgctgcaggatcatttcttgccattgttttcttttctttttttttttttttaagacggagtcttgccctgtcacccaagctggagtgcagtggcgcaatctcagctcactgcaacctccgcctcccgggttcacgccattctcctgcctcagcctcccgagtagctgggactacaggcacctgccaccacgcccagctaattttttgtatttttagtggagacggggtttcactgtgttagccaggttggtctctatctcctgacctcgtgatccgcccacctcggcctcccaaagtgctgggattacaggcatgagccaccacgcccagccagccttaccattgttttcttgtcaaacaaagatgtcatctttctagatgcaaatcctggtgtttcacattatcaccatttctagggatccctcatgtcttcagggaaggtacaattcatcattcatgtaatagagatttattgaacaccgtccaaacgccagacactgttctgggcatgggggatacaaattaaatagacaggaattcctaccccacgaagtcaggcatgattaacaataaaactattagctgggcatggtggcgcacgtctgtaggccgatcacttaagcctcggagttcaggattacagtgatctacgattgtgctaccacactccagcctgggcaacatagtgagaccctgcctttacaaacaaaatacaaaaactagccaggcatggtggcctgtgcctttagtcccagctactcaggagtcagaggtgggaggatcgcttgagcccaggagttgaaggctgcagtgggccaagatggtgccactgcattcctgcctgggtgacagagcaagaccctatctacaaaaacaacaaaaaagtaaagttacaaaaaaattagaagaacatactgtgctggagcaagggtagaggccaggagactagttgggaggttattgccttgatccatggaaaagatgatcatttaattagcggaggtggtaaaaagtagatggattctgggtatatttttaagacagaactggcaaagccttgcttatatggggtatttgagaaaaagaggagttaaggatggcagtaaggatttggactgagcacctagaaggttggagttgctgtttattgagatgtagaagatggcaggaagagcaggttgtgtgtgttgtagggtggggagtagggggaagggagcagagttctaatttagatctttaaggttgaaaagatgtttttgacatctatcctaaaagcaaaactcatactaggaattctttccaagcagatctatgtccagtgacatcagcaataaccaggatccttgagctggatccttgactcatggcttctttttaaacatgctccttagagagtacaatgccctcataaaataccttcctagaatagccttttaattttaattgtccttgttgacttaccatggagaaacactcagtggactgccatgcctatttttttattttattcttgtttgacattcttgccagtcttttctcatgctgtaactaggatttttgttttgttttgtgttgtttccttaaaaccaggtagtgttgatggctttaatttgctatattttctctccactgtgagtgataatcagttttattgactaagtttcatttatttaaatttgcttgaaataagttatatgcaattaactttggtctagtgaaaaagacatctgtactagtcacgtatctaccaataactaatcatataagctcaaatctcctggtctccctgagtctccgttttatcatctataaaacggaacagtgtcactgatgatctagctttacatgtacaggtttctgtggtatgcatttgttatctttatgtttgatgggaactaatgcataaacattttaattgaggggagaccatggtagggagctgtgtaacaaagcagaagaagcattgtgtagactttcccctggaaatcaagagatgtggggtgtaacaacccagctctactctatgccagtcatcaggcttggacaagccttttaacctcttggtgttactatttcctccaaagagtagaatataatgtctctcctgcttactttggaggtgaaaattgtattaggtgatacacacaaaaacacttcgaaaaatactaagttctattccaatataagctgttcttatcatcatagtcatcatcattatgtggccttatgtctacatttctcttttcattgacttgagcctctcatctggttttattatttctgaattaatttattaccaggcccttccttagggtggccccttccgtcatttggttatgtggtctcagggtgtgccacggtccagcggttcactggctaactgcaaactattagagatgacaaaatctcttctgtttcagctgaaactcagctgccctgtgatgctaagtatcctatttatgcaaataggctttaagtaatacatggttcctcataaggataattttatatatgttatataaaggtgggttaacttaaattaataaatatctaccatatttgaggtctactgtgtaccaaacatggtgccaggcatgtaatcctcattatatccctggagcagatcaccactgctttacaggtgaggaaagtagcttgtccaggccatatgctaataaatggtatctaagagctgagatttgaatccagctttgagactctgaagcctttcttctttgtcatttagttttcttactttcaactacctggccctattctaacagatctattccctcacattaagatggcatagttctatttctacatcttttatttagcctagaatatcttgctccatgcttttttatctgtctgatttatatttatacttcattatcccactcagattttactttcagatgaccccagctcacagtaaatgatttctctttagaattctccattatatgagtatcttagtctgttttatactggtatataagaataccagactgggtaatttataatgaacagaaatttatttggctcattgttgtggatgcaagaaagagcaaggttgataggctacatctagttgagggtcttcttgctacgtcatcttatggtggaaggtggaagggaagagagcatgtaagacagagacaggaagggggccaagctcattctttcatcaggatgccattactgcagtaactaacccacttccattatgactgcataaatccatccatgagggcagagccctcacgacctagtcaccttttttttttttttgtaatacagggtctcactatgtcacccaggcaagggtgtagtggcacagtcatggttcactacagcctcaacctcccaggctcaagtgatcctcccacctcagcctcccaagtagttaggactacaggcatatgcagtgatgcccagctaattttttctttcttgtagagatggaatctcactatgttgcccaggctggtctcaaattcctaagctcaagtgatcctcctgcctcaccttcccaaagtgctgggattacaggcgtgagccaccatgcctggcctagtcacattttaaagtctcacctctcaacgctgttgtattgaggattcagtttgcaacatatgaactttgaggaacacattcaaaccataacattaaactgctagtttgggacttactgaatattatctaccccagaaggttgcagcaggaataaaatacagtatatattagagaactagagtatgtaaaagttataaacaaatatagttggctatttctgctctagcatctttatataatgcataggctctgtactgatggaacagaaaactcaggttgatttgagaggatctgatagccatgtgacaggcttctcaccaggaactgagtgacctcagcaagtatctctaggaaacacttgttttcatttcctgagaagtctgtctgcctctctaaagcgttcaacagtgccagcaaccatttttatagtaaatatttgtgcttcaaaaataaaattaatattataattgtaaactcattgtctagtattaactttagggtttaagcattttcttattgagactaattaaaagtaggaatcagagagacacagagagcagagcagcttgatttttatgagtgatgatgtagaaaaacttagcatctctctaacaagagagagattaaagtctcagtgaagccacatctttaagacaccacggtaaaaacacagttttgaaagaaagcattttattacactaacttaatattttctctttttaacaagggatcggataaagggagaaacaattagattggttgcctgcaaaaaagtaaagctctagattttgtttcacatggccatgtttgtttataagctaaaaagttagacctaggtgcaggtgcatgtacacttcatcaaggtacatgacaacactcaatgggtggttatcagagagttaacatcaacatagatggggatattaaatcgtgttatacattactcaggtttgaggcaagcattgcttaatttccttgttgatgacgtagatgtaattgaaagtatgtttattaagtttacagaggacaagttgatgatcttggaagatatgaatagtgtttggtatgaccatgataaactagagagattacatattttaaagggtaaaattcgaaaggaaaatctataaaataatacatttcatacaaaatgaaaactataaggaaagacccgacagaccaaatagatataaggtcactgatgaccataagaggaaaataaaggctaacagacaccctcccccaccccggctctctctctctctgtctctctctctttctctctttctctatctctctcttgctcatccttgaataattgtttcctggggtttcgagtgcttctacataatttaactccatttccttattctcacagaacctggttttctcctaatgatcatatatatgagtcaattctggtattaccctctcaattctggtattaccttctctggaaaggctttcctgacatctcctcctcacatctcctactggttccatacccttcctttctactttcatagtatcttagatagaccttttttatagcagttacttccaactgcattttaattgtgtcctttctagtctctctcaattgactatgaccctagagtcttttatttccataaagtgattagcacattgtagctgcttattatgtgtttgttaaatgaacgaatgaagcagtatttttaagagggcttttagttcacattagaccttctggaaacaggtcagaagagctcacctccactccaaagcacccagtacccagcctatttaggattattgtggaggcccttgaaaggactggccaaaccagaaatcataaatctgtcattactccattttccagctaagctgagttatctgctctttccaaacttctgattctgagccttcatttatgctatcccttttgcctggaatgtacccttcctgacttctatagtccttgcttgctttctcttactcatttttgtagaccttgttcagctgtcatctctagggaatcttccctgataacctcttcttcctcttacggccccatcacatgtattacagtcttgaattattggcctgtctttcctattagatgactgtcttagtccagtttctgctgctataacagaataccacagactgggtgatttataaagagcagaagtttatttgactcactgttctggaggctgaaaagtccaagagcacagcgctggcatctggcaaaggtcattcagtagtaggagggcacatgagcatgtgaggcagagaggaaatcagcttaaactcatccttttatcaggagcccactcccgtgatgactagctcactcctgcattcatgccattaatccattcctgaggggaggggcctcatgacctaatcagctcttaaaggccccacctcccaatatcatcatgttggcaattaaatttcaacatgaattttggagagaacattcaaaccacaacatccgtcaaccacatgaggatacagatcatgacttatttaacttttagttgaatgaagccaagccagcaaatggactatttcttctctagtgatgaggatactttaataggagctagagtttgtgggagatgccattttgaggattgttagctggtaatttaaaatattttaaatggttttgtaactttaaacaaattaaatttctttgtaaatttaaatttctttgctgtggcttcaaagagtatctcctgaagtggttgacaacagtactgtaagatattgaagtaattctttaggaataaaataatatgtttgagatttgtacacataagaattcagaggccctctattgcagattcatccttagttgtgatgctctctaatttaatgcttgatatcttcttcctctgtgttattttttaatttataagtagatattatttttaggaaatatcattcttatgttcctttccacactgttgcatgtatgaaccagcaaaaactcactgtgccttatcacgaagaacacagaagaaataatgttaatcacattgccaagtgggcagtggaacaggaattaaaagaaattaaagaatgtgtaagcagaaactcagttgtatgtaagaaaatccatttccccctgagaaagagaaagagctggagtcctttaaaaattaactgcctgtttttctttggctagtgagccttatctctcctcctttcccaggcattgtgaagaccctgtttctctagctgtgcagctgcaaagtcactagacagataaacccaagtcataaaacatgttttttcttgaaaagaaatgatgtaatgcatgtctcaattaattgaataactgtctttgtttcttacttctgtaatatgcttccccctgcacagatctcccccacaccccatgaaatgtttaaaaggtaacttaacgctttgttcagggcttggtcctttggatgttaatctgactgggctggtgcacctaaataataaatatcctcctcaaccccatcggtctctctgattccttaaaaaaaatatatatatatcctgcaacatttctggtggccagtatagggattgaacctgagaccttggtgttataagcaccagtatcgaccaaaaaatccattaattagccccctacttccatagagaccatagtttcccttatcaatcctgctataggcagcaatggcagttactttttaaaaaatttttattttacagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggaggtaagacagcgagtcttcggctttcttcctatattctcttgataagaaacatgctcaaaaaattgattgatacagcatgtctcagaaagcctggggtctccagccactaaaattaagaaaatgcttttctacatgtttataaaaaatctaggaaaagtaaaaacttggtaaggtagacatttttagtaaagcccagctatagcggaatctgttttagtctataatcctgaatttttgacctaccagcaaaattgttgcccctaaataccaggcagcaattaagtttccttctcctcattaactgactcatgtctattgttcctttccttgtaccagaagtagaagttactcatttcccccaagtcctgagttcttatttatgctccttctaaaacataagatttgttatgctcaagtatgaatgagtttcattattcctttgcccatatttcattttctgtacttagtccgacctcagttggcttaaattttaatatagctaaagttttaatttttttccagatttgaactacaaacttaaactatgatctttataagctttttgttgttgttgttgttctgtcaagcacataacacagctataggttcataaaagacagtaactgtaaggttttgacaggggaagaactatgaaaaaatgtgctttcaaaacttgaatacaccatatacaaagtagaaatgcctgtgccaatgaaaatggaactaattgtgtgagaatttgagtgttttaggatttgtagataattatctgtctattaataagatttttggaaagttatagttttatatgaagacttattaaatggagaaaaattacttttgttaaatggagagaaattaatttggacatgcagaagcaaaccttccttgttaaaaattcaaatcggcatttttttattcctgtctttttcctttgtcaagctttatttgtcacccaaacacagatggagttaaaatcggcctggtgcacctgtggtacaagtggtttttgcgataatctatgtagaggtaattgtgcttggtttgcggtgctgcgtgtgacacttcagaacagaatgccgtgacctcttatctgtagggctgctctctagagcagcaggacttctactttttgggattgaaaaacaagatatgatggggaagttcagaggcttcatgggctggatgtgctatggaaaaaaatactgggaatactttctgaaataggatgaacaggaagaaacagatgtttgcaccgaaagagagtagtgaaaattttaagcaaatgttaagattttgaaagaatgtaagctacagatacactgctggatgtcactagtgttaatactggggaaatagaatctgtggagccagtttttggtttggggtcagaaaacaacagggcttcttttcttgctgttgttgttttgactggttttggtcatgacaaattcttggtatttgacaacagttccagccattttagtccctagcattagaatatcccaaagtcttgaatgtgatggcattaggtaatcccatttcttccgggcctggaccatataatactaggatttgaagttgtctttgaagataacttaagtctagaatgaaccttctagaatttttcatgagttgagtgaactattttatgacctctttcaaaaaaaaccagctttattggtttttctgcaacacagatttgaattgtattagtaggaatatattaaaaatttggaatagctactgtcttagtccatttagtgttgctataactatagcctcagaatacctgaggctgggtaatttataaagaaagagatttatttagctcatggttctgtgggctgtacagtaagcatggctctggcatctgctaggcttctggtgagggccggcgtgctgcataacatggcagagaatgtcacagggcaagtggacacacacaaacgggaaacctgagggcctcccgacttcataacaacccactccagtggaaatgaatccagtcccgagagaactaatccagtctcacagagggagaactcactacaggagaactttaccaaggctttcactatagatttgtccccatgaccaaaacacctcctactagaccccacctcccagcaccttcacattggggatcaaatttcaacatgaattttggtggggacacgttatatccaaaccacagcagtcaaagataatacttacagtatgcaattataaagaatatgccctgcttgctgggatgaacataaaagataaagggatcagctatgctcacctgcttccttctctattatttagtctgtctaaataatttgaaattgttcatctataagaatttggattaagaaaaatttggtaaagagttgaactaattttcaataactacaaaaaagggcatctcaatttgaaagttggaaatgtgatatggagctgaagatcagttactggaagaaaacataggtaaaatattgagtatgtagtctgaaaaatttgtagctttaaatcgcttcaatactatgtccctatatcagagccctttgctgagatgtcaggaaaggcatatcggcgtctccagtgatctgctgaaactcctcataggataatgagcatcctacatggttaacattacaatccagggtctaaagagatatgcacattattctttaaaaaggaagctcctcattctcaacataggcttcttttgcaaaatgtgaatgatgtacagataattattctatttgcttcatttcatgttttcattttttcctggaaattttcatcataagatgggaatagcacactgaaacttttttttttttaagagacagggtcttgctctgtctcggcctgtcccaggctgatctcaaatgaactactgggctcaaacaatcctcctgcctcagcttcccaaagtgctgggattatgggtgtgagccactctaccaggcctggatgttaatttttttttttttttttttttttgagacagagtttcgctcttgttgtccaggctgcagtgcaatggcatgatctcagctcactgcagcctccacctcctggattcaaacgattctcctgcctcagcctcccgagtagctgggattacaggcacatgccaccacgctcagctactgtcgtattttaaatagagatagggtttcaccgtgttggtcaggctggtcttgaactcttgacctcaggtgatccacccgccttggcctcccaaagtgctgggattacaggcatgagccaccgcacccagccagttgttcttttttaatttcaataaccataattgaagattttcatctccatttagtaaagaagagtgactcatgcatcattacattaaaacagtaaaaccaagattaccaagatcacaaaatttattttttcctttagtggcttcttgctgattaaagtgaatatagtattagggagtctcttgtgaatacagtgcttatatggcagaggcaacaattgagggagtggacaaaagatactgtttatgtatagaaatttctttccctatcagtttcagaacttagaatcaaataattttattttttaaaaagaaccctagagctccactatcctagtcaatttacatttgaggatactaatgctcctcaaagagattaaataatgacaagttgataatagggcctggtctgataggtcttcgggcttctaattcatttgttctttttaccattgtttgtctatgtttaaatacattttatttgaaaacaaaaggatctgcttcaattctagccaatccctgcctcttctcacagtgtggtggtgtttcggcaggtgggccactctgacgcccagtctgagtaggtggggagagatgatatgtggaaggtggggtaagagttgaggaaggaggagaagctgtggcccacccttcctccacttgcttagttactggcaggaaagtgcttaggacagttactaatatttattgagtgtttattgagtagctgctgctacttctactacatgtaatctttcatttgctcttcggaagaatatattgtgttgagagaaaagtctgcatttataattaatctgcttttctaaataaaatagtgagaccatatacagactttttgctgtggtgttttgtaatatcaagaggggtaacatctgagtaaatgaatagataaattatctgaggctacattagatccttctgtaattttgccaggaagatattcttatttttctagaaaagcatttaaaatgttaatctaaaatatagcagtgtcctcactgccaaaacaaaataggatgtctacactctatttcagaaagtgaaaatatattttctttgattgatcaaagaatctaatgtgttgacttgtatggctgtgttactattgttttcattacttacatttgtatcactcttaaaactacattgtattttcacatctttctgtctgctgtggtttcaatttactaatcctgacataggctttacacaagtgaaagatattaatttttttgaaatttgcttattaaacatttaatatatgcattatgtaaacacttggttttctaactacatcttttttttttttgctttgccttaaaaaaatttatagaagcgagttacctaaatcagaaagacatatgtcattaaaatttttaaggttatataaaacatttagcagcaagttatattctctgtattctgtagcagatattttgtaagctagatttaactatcaaaatccaaagccaaattttactttttctggttctgaaaatggcctttaaattgagtgggtaatactaatactctactaataaatagtctaactggacctttgttgccacaggataaggtgatagaaacatcaggctaaagagaccctgaacaccagagcagcatttccaggaaatattcattggtcttaaccatcttatttatgtaaagcaggtgaagttttttggaaaaaaataaaaacctgaagcttacctaacaaagcctatgccttggcagctcccatcctcgtttgttctctttctttgctggcatgaatgttcagataacccaaaaggtgttatgaaaatattctaacctctgagttcaggtctgctgtttctgaaaatcatttttgtgagaataacaagacaaataaaaactattagtatatatctgtgtgactgtgcagtgagcaaagcatacacctgtgcctgcagtggcaaaagtggttctgttcttaaaagaatcagttttggccaggtgtggtggctcacgcctgtaatcccagcactttgggaggcagaggtgggtggatcacaaggtcaggagctcgagactagcctggccaacatggtgaaaccccgtctctgctaaaaatacaaaaattagctgggcgtggtggcatgtgcctgtaatcccagaggctgaggcaggagaatcacttgaacctgggaggcggaggttgcagggagccgagattgtgccactgcactccagcctagtgacagagcaagactctgtctcaaaaaaaaaaaaaaaaaatcaattttaaggacctgtgttctactccatcttttctctctctgagcagattctgtaaatgtcatgttatgaattacacttctaaaatcttattttctcccttgctttttagtccattggaaatgctaaaacaaccaggaatgataatagcagccgttttgggaagtatattgagattggttttgataagagatatcgaatcattggtgccaatatgagaacttatcttttagagaaatccagagtggtattccaggtaagctggccatatacacatatgcacttgtgttagattgctgtataattgttgagtccatgcttgctggtatgcattttatttcaagatactcttgagcatattatgacaatattacctccaaccacacttggactgaagcctgtaaaatggtgcctgttagaggcaagggagtaccacttaaatgctaatagtttttgggactggtcacttttaggtttgactttttcctacaggtgcttgcgggaaagcttagttgagaacaggtgctattggtttagtcttgtctctcatatttccaaatgatagggaaggcattgttccatgctctcaataagttagtttgaactcagtgcaagaaaaaaaattatcttgtcctctttccttccttcttctcctgtttcagaatatattattgtttagatagaatagtgagggttaaaaaaaaatcttcacaacccaattgtgaactactatcaaaaaaacagttgatgcatctgggtggggtttacatccacatgtatgctcttggtcccttttgattggtaagtgggagatatgggagatactatatatttccatcactagcaggcatacatttatatatttataggtatgggtttatcacacactgtcagttctgtagacctactgcttgcctcatgctgtgagatttgggtttcattagcctcaactgcatgcccactgcattgaggttcaaatacccttgacactgccatgtaacagtgtccacaatttccatagcccaggtctgtcataggtttgaaagtgtctgagaatttgagcagtctgaagttgctctggctttgactttggggctgtgcctgatttgtggccacctaaaatatagtacttgatttgcatagtaaggcaatacaaatgaagtattatatttaatatctaggtacatacagaacagtgttactatgctgatggctatttctataggttttttttgaaaagtgtctactttgataaccagaagaaagaatgggtgaaacagaggtagatctaagggaagattcaaatattagagttcaaatagtagaggtttgattgataggtaagtgagtaagcagggaggaaagatggtccttggtcagtacgtgaccaaaggctagtagtgcttaatacaaaatggtaaagcccaatccttattgtcttgtttagagacactgaaccatttctagcagtttcccagtctccagtgatatagaatgtcaaggatgtttggcttgtcaaaatgagtcacacaatcagaaaaggcatacttgtattgtcctttatgtacaaagaggacctaagcatttctgcagactcacaggcttttctagtttctgtgtgctgaaccacctggtctcctgtttaatcatgcttgtggtcattggtatactggtaatttgttcagtggcttctgtccctataataggttttcttttccagacatcagccccctgtgggcatcaaacctgaccttggccttattaatacgattcattagccaactgagtatactgtaaaaatgaaggatatagtgataaactattaggtgtatgaacaatattattgcaactgtattttttagatatatgtgtggaaaagactctcaggaaatactgaaaaattatcttagaatttatatgtgatttattttctattttataaaacagttattgatttaaaatgtataaactaaaatgatatagaagatgtacatttgtgactttcctacaaataaccacagtagatggtccagtctacaatatggcaagaatgggattattcttttttcaaagcatttggaagactgtgaatctaagaggtaccattagaaaatagtattgagtattgcaaaaaaaaatgattttagtttcccccaaaagcactgattatcttatgattgttgacatatatcaagctgttcactagttcagaaagcattactatccgatactttatgttgaatttgagcaacacacacatactcatacatatgcatatagactataaatcataagatttaataatcagaaataagtattaggaaatataggaaagtataatttatttaaccaactgagataattaaatattaaaatcttattttatgatagaattccctgaattttagattaaaatgctgtaattgaaaactcttcttatttcgaaggcagaagaggagagaaactatcatatcttctatcagctttgtgcctcagcaaagttacctgaatttaaaatgctacgattaggtatgaatatggcattaaatttattgttctggtattgttttctgttaatttccaagttcctaaatttacttgttaaaaaggagcttatctcatgttggaatacttatggataatatgataaaaagtcagcccttggcttcaaaataacccataggggtagaggaggagtaagtggctgtataaatggaacaggattggcctggaggtgattttagatggctgtttaagatgagtaatgagtacctaggggctcattctattagtctctctacttttgtatgtgtttgatatttgctttgattaaaggaaaaaaaaaattaaaggagttgatttgttagaagccagtagggtttcttatgaggggagtaaaggatttgaggaaattattctagtgtgtagattggaataaaacctttaggaaaggactatttattttaccaattaacataaataaactataaatattttaccccatttatttaattaaattttatttaatttttaattttttattaaaatacaattgaaaacacaggcagtcaaactctagatgctgtacactcaactgtgctatcaccacctctgattcagagtggacataaggttagaaggcaaggctttttcataaaccagaaaatttttatttttcttcattacaggaaatgcagataactttaattacacaaaacaaggaggcagtcctgtgattgaaggagtggatgatgcaaaggagatggcacatactaggcaggcctgcactttgctaggtaatgtcactttattcttgagctcttaagaggaatagcttttttactcaagcaacctttgtttagaatattggcttgactttttattaagtggcaagtattgctagaagatttaatattccacatagaacacatttagacagcaaatgggcaggagatttctttttgggatgatggaactgttctagaattagattgtggtaatggttgtgcaactttgtaaatttactaaaaatcattgaatgggtgaattttatggtatgcaaattagccttcaataaaactgttcaaaatatatatttggggcatcaggggagggctacttgtaattctttgcttaaatttttacaaaatctgaaacctgaagctaagtgaaacgggctcctctacaagctcgcattttgtaggagctattggtttatttgtttggttttggggatctttctgtggctgggaaatgtggctgagttggcatcatgacagaatattccattacatgtagtttattccagcattttttttctgttccaacatttctgaagcagctcagatgtcactatcttgtttctgggatttaaaaaatgttgggccttcatgtgaataaattaatctttagaacttgtcatctacaacttaaagaaaaaaaaaacctcagaatatagataactctaaaatcatatgatggcattttgagtagtaccctcaggtgagttaacttaatttaaaagcactgctaattacagtgtggaccaggaccattgtgggccttgctagaaatgcagaatctcaaatcccttctcagacctactgaaacataatctgcattttatcaaaatctattggtgattcatatgcatattaaaagtttgaaaatcactgcatttcttctcgtgctaaatctgtttgtaaatagtaaatttgtgaatttgaaaaagccatacaaagtttgcagtgagctgagatcacaccactgcactccagcctgggtgacagagtgagactgtgtgtcaaaaaaacaaaaaagaaaaagccataatgcaggagatggtaaaaaacattaattatagggtcattactgaattaccctttctaagattacatatttggaaataatttcactgcttctatttgcatgtaattatagctaattttctggagattcttatgttatttaaaaatgaagccagatctgataaaagctgaaagctgtccagctttctcatcctgccttatccttcaagttctgctctgatgctgtatttggacgcatactcatcaggctgggatatagcaccagcctaaacgcttctaatcttggcgtctctttgacttatacttggtctgtagtttaaagaagtaattaaataattactttttaaacagccttaagaagtaacagctttattgggctgtatctggagcagagataaatagaaatggtaatactattaattttaaacccagtgtgtgacaatgatgacaacaatttgtttagcacttactgtgtgtcatgtcgtgtattaagtatgctatgtgcatttaatctcatttaatcttcacatactttgaagtagtcactattattttcatatctcaaatgagaaaatggaagcatagaatactgaagctacctgtccatttgagatgataggtccatagcagagccaggtctcgagccagatcagccacagtcagcagccatgttatccatccatgatgctaaactgcctaatgtgttaatgtcaacaaagatgaaagtgttgttagctatgacacattataatatgcacaacatctggcaatattcaggaattaacaataggcttaaaattgtctgctgtaattgtttagtttctattctgaaattaatcacttgttcattcactctcttgtttcaggaattagtgaatctcatcaaatgggaattttccgaatacttgctggcatccttcacttaggcaatgttggatttacatcccgagatgcagacagctgcacaatacctgtaagttcagaataagctttagtgggatggcagttgaattatgttttagatttgtagattgtttaaagaagcaatatagtttaagtctctctatcaatattatcagaaacataattatcaaagacatatgttatccaaaggagaatctcaaactgagaataaagaaatatggattctaatctctggtgcatagtgattgtgtgtgtgtgtgtgtgtgtgtgtgtgtgtgtgtggacagagagagagagaaagagagagggttggatagatgagattagtgactataacgcagatgtggccccacaagatcagaaactcatggaagttaaagctattagggatcatatcatgcccttactgaaatgtttcaggactccccactgccttcagaagcagacccaacaccttacttggcatgatatgacatgaaagggccttcatgactgacccctgacttcctattgagcttctttctcattgtttctcacactctacatccagccatttccatgccaggctgtttctctctcctggctttgctcagattctccctgctggggtacatacattgctcttcttccctagccagctcttactcacgtctcacaggcagatctctagcatctcttcttagatacacactcacccttctgctttcctttattgtagctcaaatcacattgttctataaaggtctctcctgcttgcctttacccactaggatttgaagtccttgtggatagagccatgctattcattgtggtattcttaattaaggccttaatttaaatggtgtttattcaactcacttagttgccttttttctctggatctatagcctcttgtgtaaaaacagattctctactcctgtaagaaaagaatctatttcttgtgttttctggatatagtactttgatactatattagatgtgtgagacatgatataatataaaataaatgactttatgatttaaagagaagacttgttccataacttttttttttttttttttttgagacggagtttcactcttgtcgcccaggctggagcgcaaaggcatgcaatctcggctcactgcaacctccgcctcctgggttcaggcgattcttctgcctcagcctcctgagtagctgggaccacaggtgtacaccaccatgcccagctaattttttatttttagtagagatggggttttgccatgttggccaggctgctcttgaactcgtgacctcagatgatccgcccaccttggcctcccaaagtgctgggattataggtgtgaggtgtgagccaccacatccagccctgtaacttatttattagtccaagggccaagagctagatgggcagacagtttggtttacagaaagcttgatccttacgattttctttatgaatatttgaggtgtaattttcctaagccatgggtcctaattttagatgcatgattcctcctcccctcccccagcctcttttcctaatggtggttttgtaaaaggcaaaatgatgattctaatttaaaccctcatttcttctaatgaaacattgctagtcttttaaaaaagagctttgttgagatataattcgtatatcatactcatttaaagtgtaccattaagtggcttttagtacattcacagatatgtgcaaccatcaccacagtcagtttaaaatatttctgtgacctcaaaaagaaacccagtaccctttacttattgttacctatgtgtctatttccctacccctaagcaaccataaatctgttttctgcctctatagatttgcctgttctggacatttcatataaatggaatcatataatatgtggtttttcgtgactggcttctttcaaaatccatccatgttgtagcacgtgtcaatactttattcttttttacggctgaataatagtccattatatggagataccatattttgtttatccactggttgattgttggatatttgagttgtttcaccttttggctgttatgaataacactactctgaatgttggtatacaaactggattttttaaaaagaactctgatttctgcatcaccatctttcctctttgcccttgtgacctttccccaaatgtcaagcttctcctaatcaagaaagtcatgactaatgttatgtcacatatatcacttcattatgagtcttacctaaaatttgagtgtactgttttcctatttgagatgtctggaagttattaatatcatcttggagaaatagtacttataatgtccagaagttccttccatccagttcttgtaattctatgatttttattttctaaccggtgcttgtcaactttgttgatttgatgatagctataagtactacaatttcactatttggggtaggtggagattaagttagtttttgttttgttttgttttgttttttgtttttttgtttttttctttttgagacggagtcttgctctgtcgcctggtctggagtgcagtgatgcgatcttggctcactgcaacctccacctcctgggttcaagctattctccagcctcagcctcccgagtagctgggattacaggtgtgtgccactgtgtctggctaatttttgtatttttagtagagacagggtttcaccatgttggccaggctgatcttgaactcctgacctcaggtgatctgcctgccttggcctcctaaagtgctgggattacaggcatgagccactgcgcctggccttaaatgagctttaaaagttactggtaagacatctctatttgatagttctgccccaccttgaaggcatttgctgaacccagtgaccttgagctttgggtttcatagccaagtgagctacagaaggcaaagacacaggacccatataaacaggggaacacaaagactcctgcctaaagctgagaccctaagtggggagctagtaatcaatttgcccaccacccactccaagagtataaagaaaacttaacctgacccacactttggtgccaagtagaggcagaaaactagctccctaaaaatttataacaacaaactgactctcacacatattcattcccagactgatttcatagttcctggaaggtctcaaaaaactacatacagaaaatatagcttaaattgatcctgggctggtagtggcctaggcgcctgacagaagcaactgcaaatctactttggaggacccaccttcagtctaggcctcagtggagtcccatcagaaaagttacaagaaatattgactcacagtcaaaaatcacaagtcccccaatgaaacaaaatagaaggagctaggagaaacgacagatagcagagtcatacctgctaagaatgccaaaattaataaacagcagatttggtacaactgaagagaaaactgataagctagaaggtagatgtgaagaaattgtccaaaatgcaagataggacccaaagacagagcacttgaaacagtagttaagagagaagaaggatagagtaataatgtctaattttaatctaatgaaaattcataaaggagagaagagagagaatgaagcagacataatataccaagagatcattactaaaaaatttttagaacttgtgaaaatgactaacccacatattcagaaagtccagaaaatcccagttaggataaataaaaagaaatctattcctaagaacatcataatgatatcaaagacagaggaaacttaaaacagagagattaagagactgcccttgaagaaatagcaattaatctgatagctcacttcccagctgcagctataaaagccagaacacagtggaataatatcttcagtgtgcttagagtggaaactattaagttagaattatatatcccgttaaaatatctttctagaatgaattgaaattggaagcattttcagacaattaaaaacttatgagaggccaggcgtggtagctcacacctgtagtcccagcactttgggaggctgaggcgggtggatcacctgaggctaagagtttgagactagcctggccaacatggcaaaaccctctctctactaaagatacaaaaattagctggacatcatgcgtatgcctataatcccagctacatgggaggctgaggcatgagaagtgcttgaacctgggtggtggaggttacagtgagccaagatcgcgccactgcactccagcctggaggatagagcaagactgtctcaaaaaaaaaaaaaaaaagcttatgagaatctgctgttgccagtgagccctcactaaaggaaatattaaatattaaaggatatagtttaggcagaaggaaagtgatcccagttagaagatctaagatgcaagaagaaatgaactaagaagttagcaaaatgtgggcaaatgtagataaaatttgattaattagaataataatagtatattgatctggtaaaagatagaattcccacaagacatgtattaattacaaagggaaagatagttatcattacagtcaagaaacctggcagacattcccttaaccaagtgatcacaattgatagtaccaatatttagaccaatcaatatcacatagctttggatatgacacactgagcagagtgcaacaccacttctctggtatttctgcccaaatctaatcatgaggtaacatcatagagacccaaactgaaggagtcttcaaaaagtcaaggtcacaaaagacaaagaagaatgaagaactgttcatgttaaaggagactaatgaaacatgataactaaattcaatgcatgatcctggattgaatcctggaccataaaaattaattattttttgtagagagcactgttaggccaacaaagggaatgtggtaaaatgttaatatttagggaatctgagtgaagggaattttttgtactattcttgcaacttttctgttagtctaaaattagataaaaagtttaaaatataaaatgaatctccagtcccctaccctgccccctcacacaaaaggtagaactaaagtattggataacagaggataaattggaatgggatgtttggagttagtgttacttaattacattatgttaattataaaacaaaatagtaacaaagtaaacctttcaaactagtagagaggaaaatggattgaaaaaaatcaaaatatagcaagaaagagggagaaaaacaaatgttgaaaagtaggacaaccaaaagaacaaaataagatagaaataattaaaaatggaccaagtgctccagctaaaagatttagattgttagactggttaaaaaaattcagatataaccatggaatactacccagtcataaaaaagaatgaaatcatgccctttgcagcaacatggatgcagctggaaaacattatcctaagttatgcaaaaacagaaaaccaaatacaacatattctcacttataagtgggagctaaacgttgggtgcacatggtcataaatgggaacaatagacacaggggaatacaagagagggtaatggttgaaaaaaactaccaattggcagctatgcacactacctaagtgatggattcattcatactccaaatctcagcatcacacaatattcctttattgtgtacatgtgcacaaagctgcacatgtgccccctgattctaaaatacaagtcaaaaaaagaaaaaaaagtttcaggtatatacttttaaaagaagcattcctaaaatatagagatacagaaagtttgaaaaaaaaagtttagaaaagacatgctagctaggacaaaactggcaacactgtgcacgtattgaacaaaatagactttgaggccaaaagcagtgctagagggaaataaagtgactttgcaatgataaagattttattcactgtgcatggtgtgtgcctgtaatcctaggagactgaggcaggaggatctcttgagtccaggagtttgaggctacagtgaggtacgattgtaccaccacactctagcctgggcaacagaatgaaatctcatctctgaagagaacagattttattcaccaggaatatgaaatagtgctaaacttctatatacttaatgacatagcctcgaaagatatatagcaaaaatcaacagaaacctcaagaagagacaaatttgctatcagagtgggagattattgacttctcttaattattgataggtgaagtccaaaatgagtaaagctgtggagaatttaaaccaaacagttaacaatcttgatgtaatagaacaataaggtaacaacattcaagtagaatatgtttacagagtgctgacccacctttttttttttttaattttaagaaaaaaatttttttttttgagacggagtctcgctctgtcacccaggctggagtgcagtggcactatctcagctcactgcaacctccacctcccaggttcaagcaattctcttgcctcagcctccccagtagctgggattacaggtgtctgccactacaagcagctaatttttgtatttttggtagagacagggtttcaccatgttggccaggctggtctcaaactcctaacctcaggtgatcctcctgccttagcctcccgaagtgctgggattacaggcgtgagccaccacgcccagcctgacccacttttaaatgatgccgaattctaaatacatacatatatatggctgcttatttaagggagttgagcaggcagtggtgctgatttgtatctaaagtgattacttgggagaaagggggatgaaagaaggaaggggtgcttgagtgtgaagagtctagagatgaaggtgtcaaggagacccaggttctaatgccaactctgacatcaattgccagctgatttttgacaagctatttgttctcttgggtcctatttcctcagttatccaccagagacaatgttcaccctccctatgccccaggaatgtcagatttgactgatacatgtgattgaagatgttgaaaaatataatgtactaacatggattaaattagacaagtatttatcaaacatctactcatgcaagtctcatggaagatattctagggggtacagggatatgtaaatcatggaagtcattctaatataaaaagtcacacaaataactatcaagttacctgcttacaatccttcagtggcctaccattgcttcaaggataaagaccagctaggatatagcctctgtctgtttctgtgatttcaactcacattttctccctcattcagcttcaatccttcctattgatgatttccttcccaccacagaatgtttttgccagctgtttccttggcttggaaaatccttttctcctcctttcacccagttagcaccttccttttctcaaggcaactgtctcctccttccaaaatagaatatattactctcacatggactcagcatagtgtccttggtctttgtggtatttttcattttagggagcaatcatttgattaatacccatttccccaagtgactataagttctaggagggcagggaccatgtttgtttttgttttctggtgcatagtagcactcagtaaataattgttgactagctgactgattttttgactgaatgaatgaagatgctttaagagagatacaaacaaatactatgaagagtcaaaggaagagggaatttttgaagtgagccccagaagagattgcaaaatgctgcctggatgccagtttaatggatgaatgtgattattatcactaatcaactttgagtgatcttggtgtttgttataacaaagaaattgctgaattttatttgttaactctttgttaacattttccgagagattcttacttgatttatctggtcataggaaataactcattatcttttggcagcccaagcatgaacctctctgcatcttctgtgacctcatgggtgtggactatgaggagatgtgtcactggctctgccatcggaaactggctactgccacagagacatacatcaagcccatctccaagctgcaggccacgaatgcccgcgatgctttggccaagcacatctatgccaagctctttaactggattgtagataatgtcaatcaggctctccattctgctgtcaaacagcactcttttattggtgtgctagacatttacgggtgagtatatttggctaattggtctgccagagaacatttctttctagaacttatctagtaactctaagtgggcatttgattctgtttcctactggtaaagagaagggaaactttgcctatgacaattcaagaataccttgatgatggtgatgcaattgcgtgttgcttaaaatttaactaaaacaaaaaaaaatagttcacatctagagctaatttacttagctagtgcatagacttaattggttttcagatgctcatgtggtaaattatcactgaaattctaaaaatctaattttatttgctagtttgccttatttgggtacctgtctttagctgttaaaatccttccttcatatttgtgcctgtttcatacttaatttttcattctctggttctctttttcaaaagaacctgtaggatctctgttcctatttccctcctatatgtgtgtaacaccgtgagtcagtatattgacaagagcaatggctttattataattctgatgttccccacttgggggtgaatgagccctcaaaaactcatagtgttgaacacctctgcatgctggggcctttggaaaaaaaaaacaaaaaaaacctctctgctgcatggctgatgctcatctgctgggtacatattccttgttactgacttagaaatctttattttcactgatatggaaagaaagttttacaatgttggggaatgtcccacttctttcttcctaatgtgtatattttgaatatttttaaaaagctttttgttccttttctccccttttcatattatttttgtggttacagatttgaaacatttgagataaatagttttgaacagttttgcataaattatgcaaatgaaaaactacagcaacaattcaatatggtaagaatgttcttccttgaataatactctgctataaattattctcttgaattcctagtctttgtttaaaagcttatccctggaatgaagttgtgaattaaaattattatatggaacttagaactgacgattaatgaatggtacaacattagaaaaatgttttatgggccaggtggtattcaaggttatccttggattgcagtctgataataacgaaaatttgggacaaatagattgagagaagcaggcagtgtgttaggtaattgcttgggagtatgaagctttaagcccaaggatatctttcagtttgttattttgaagtttattgtatgtggaatcatgaccatcttaatgcttacttgctatattagcaagatgtcagaactaaaaagcagaattttacatattctcttttcagcagtctgggacattcactgggacaatggcaatgtgaatattttgagtggctcttgtgaagtagtaatattaaatatcttagaggagtattgtggttttgggagattcagagatgcttaaaaatcaggggcagcagattgtaatagtgaaggacacagagcccagaggtgaactgtgtgagttggaatcctaccctgtgtcagttatctaggagaccttgggcaagttagttgacctccctgggccttagcttcctcatctgtaaaatggagataataatagtaccttctgtgtgtggttttatggattaaatgagttggaatatgtaaagggtccataatgtgccaggcacagttctaagtgcaagagtgggagtgattcttagtgttgatgaaagaggatattaaaatgagatgcccataggaattagaagatagagctcaagggcaggaaagacacccttaataaatcctcatcttgtaaagagagaggtcaagtggtatggtttgtagttgatgcacacaaaccagatgtttaaagacactgcaagttacaaatttggttaaaaaacaaaagaggatctaaaaatagtaatatagggagaatagtggaagagcgggaaggaggtggtgtatgtgaatttagccttgtttgtgtcataacgaaatcactaggtgtttcatagtgataaatcagaaggtagttgataagcatactctttagaaatatgtaggtaaatatcagaagaaatacctaagggaattaaaaatggttgcctccagggagcgagattggggttggggagagatgggacaaggaattgctacttgtcattataaaaccttttagactgtttgattaaatattccatatactttgaaaaaacttgaaccatctttatttagcaaattaagcttcttaccacagtgaaataatgtagaagtgatcttaaaactttaggcttatgactatttccataataagatgactactaatatgatttgcatctctgcataaagaacattaataaaaacttatcagaaactaaactgagcattattgtttctcaaggtgttcctgagtttcttaatactttagttaatgccacagcctttcactctttcccattgtgtttccacacagagtgactggaatgtaaggaagcaatgccagcctctttaggaactggctagtttgtctgtttttcaagggcctcctgtctgcatgtgtgttttggtctcttgcgtctcttcctctttcctgctgtctgtctctatccacctgtttctccttctctcttcacatacccccttacattctgcatcttcgattctgcacaactgctctgccccctcttcctatccaatgtcaggttctttccttctagtctgtatacatcttctccacctcaagctttctcctttctcactcactttaaacttcctgtgaacccagcagtggttggaatgctctgctcgtcctcttaacttgcttatctcccattcattttggcttctttcagtttcaactcccactactaattgcctcattattttcttgtttcccagttcaaatacctgagagagagaatctgattaacactgttcattttttcatcagaggtctctagcaggagactgccctcatgtacccacactggtttagtcagctgtgactaggaacgtggggtctcacagtataaataacttgattgcatagggctgttacctgatctggggatgtaggtgggggcagtcagcatgagaaatcccgtggttggcatgcttagtgtttgaaggcattactatattgaccaagaatctcttgccatattgaacttcatgcccatattctttgacagttgagcatcccaaattttaaagaccccaggagcttttccaaactagacatggagatgtgtgtgagtaatatgctctatttaatgtctagagcagtgtttctattgtcaatattgagactacatataaattaatgaaatttttaaaaacagagcacattgttttggaagatactcgtaccatcagtcagggtgtcctgctgacatatggtgccctatttgccttctcattaatcaaaagaacagaagaaatttgctttcttgttagcatgacataaatattcatatggatgactgttttttgttaaagcttataatagctcgttagactgtaaacactgtaaatgaggccaggcgcggtggctcacgcctgtaattccggcactttgggaggccgagacaggcagatcatgaggtcaggagatcgagagcgtcctggctaacacggtgaaaccccgtctctactaaaaatataaaaatttagctgggcgtggtggcacacgcctgtagtcccagctactcaggaggctgaatcaggagaatcgcttgaacccgggaggtggaggttgcagtgagcccagactgtgccactgcactccagcctgggtgacagagcaagactctgtctcaaaaaaaaaaagaaaagaaaaaaaaaacactgcaaatgagccaagagtggcattacaataagtacagaatacagtgggaaagttccagacacatgaggagagtatgcattggaaatcttgtggcacgtaagtttcacagggcatggggtcctagaaaatatgggtcatttgatcatcaccacgaaagtcttttcttcccacaaaaatagcaagatttgtgaaagaaccaaaggagacaaaagagataagtaaaggaaggcagaaactccccaagaatgagtagcagtcattagcatctgtagatactagaagtggtggtgtcagctgcattggctgggcagtggctgggcagcaccctgaaacaggagctgtggcagtgattggattgcccttcccacccggactagcttggctgccattcatctttagagactaaatcacacagccctcctcagggaagcctcccctgaccagcctgtgtccaaactagatgaggactcttgctcttatagttcacgttattttcctttgtaatactactacagcttgtgattatattccttatggttatttggtttctgtccgcttcttccacttgtctccaagctccatgagggcaacatccacatcggtgttgttgcccatgtgcagtgatgggcacatggtagacagttaatacatatttttatgtgaatggagatgagaagcaatggtgaggacagtggctgaaggcttcatcggaaatagcaatggactagcagttgcagttgctaacagaatttaatgtggaaaccagaaaagtgagtcgtagactccatgactatcacagataatcagggcagtcaggagaaagaccagtcattaactaattctgagccacgtgaacttcagcaccacagtcccttaggagaagtactttgttatgctgaaagcattgcccagcatgattcagtagcctggagggcatcaacatagttgttaaatgccagctaaggcattcctgtgtcccatgttgttagcagcactctacgataacttaagaagccaaaagtacatagtgcagttttgaaaatatacataatcaaaagatcacaaagattgctacattgatcagctatttaaaatatttatatacctagatttacttgtttaccaagaatcctacgtagctgaggttttcctgttgttttatttgctttctctgtgtgtaaatcatgcttctcccgtgaggttgttgttgttgaaagccacagattatctcaaattatgttggtatcatcttgactacattctttgttacaatgatccagtaatgactgctttttttctttttcatttcagcatgtcttcaaattggagcaagaagaatatatgaaggaacaaattccatggacactcatagatttttatgataatcagccttgtattaatcttatagaatcaaaactaggcattctagatttactggatgaggaatgcaaggtaagtatgatttcctggggtacttggtttatcaaaatagatgtatcaaggtcagaagataagtgggttcaaggagagattcattagtatatcatggaatgccgtcgtggtgacaagtagggtttatgctttcattccaaagggacactagaccccaagggttctaattacaagtgaaactaggagaatttccctcctcttttcagctgattctaaattacatgaaaaattgacgttagatactaacaattttagccacttttgttattaatttgtttagtactttttggtcagcgatagaatttaaagaaatgcaagaaactgtgcagaagatattttgaataacagttctaaatagttataattgtaaaactaactagttgttccttattactgacatatttgagagggatggagttgtatctttaatatttaaagatgcaccatgttggaaaaaagcattagatccccagctttaccactgagtgatcgtaggcaaacctattctttcgctttatttctctttagtttatatgcagtaagttacattttagcacaggtgtaccctcctaagcatccagacttcctacaacattgaggatgcatgtgatgaaaaggttctcagcctcacttgagattttaaaaaatgcaaaccaaagcaaaaatggtacaccgttcttgacccatccagtaggcaaatttaaactcgataattttcatttgataatactaaatgaatattgcatatatactcatgatgaaaagcatgaattcattcaacatactttataggatatttgacaacatttatcataattttaactacatacccttgacccaggaatggaactgctgggaattccacctttgattatacttgcaaaagtatccaaggtatatacatataagaagaaaactgtggcagttgtcatagtaataacaaaaaaatcagtaacaacctagtagccataaataatgcagagaatactactgttgcaaagctgaaaaaaatgcaatgagtgtgtagaattatcctattcacatacatgccttcaaagagagttaaagaaggccgggcatgatgggcttatatctgtaatcccagcactttgagaggctgaggtgggtggatatttgagttcaggagtttgagaccagcctgggcaatatggtgaaaccccgtctacaaaaaaatacaaaaaattagctgggcatggtggtgtgcacctgtagtcccagctacttgggaggctgaggcaggataatcacttgagcctgggaggcagagtttgcagtgagccgagattgtgccattgcactccagcctgggtgaaaagagtgaaaccctgtctcaaaaaaaaaaaaaaaagaaaaaaaaaaagagagggagaaataattaagttggaggaaatggcaagaggagactactctccattttatatctttctgaattatagaaatgcttcactatgtaactacagatgttacctttatttgacagaattttttaaatttaatttttaatttttgtgggtactagttggtgtatatatttatggggatacataagattttggtataggcatgcgatgtataataatcacatcatggaaaattgggtatccatcccctcaagcatttatcttttgtgttacaaacaatccaattatactcttattcttaaatgtataattaaattattatcaaatactagggcttattcattctaattttttggtacctattaaccatcccccatttgcactccccacaacctcctgctacccttcctagcctctggtaaccatctttctattctttatcttcataggttcaattgctttaatttttagatcccacaaataaatgagaacatgtgatgtttgtctttctgtttaacagaattttaaaaacgtacataatagccctgatatttcaactttaacttgggaggcttttttgtttttctttttttgagacggaatttcacttttgtcacccaggttggagtgtaatggtgtgacctctgctcactgcaacatccgcctcccaggttcaagggattctcctgcctcagtctcctgagtagctgggattacaggtgcccaccacctcgcctggctaattttttctaattttagtagagacagggtttctccattctggtcaggctaatctcgaactcctgacctcaggtgatccacctgccttggcttcccaaagtgctgagattacaggcatgagccaccacgcccggccagcttttgttttttaaaaaacagcaacaacaacaacaaatttatttgatgatttttcatataggcagattgaactgcccaaagattgggctgggttgcccatgagaaggtctcagtcatactattcattagtaattggttgttggcctctaacaatgaaatgtggaaggaatgaactcctaaattgaattgtaaaagttattagttaaagccaaaaaaaaaaaataaaagatcttttgacagctgatgctttagaggaatcacagtatttaccttgttttctttcttcctttttcccatgaatatagatgcctaaaggcacagatgacacctgggcccaaaaattgtacaacacacatttgaacaaatgtgcactctttgaaaagcctcgtctatcaaacaaagctttcatcatccaacattttgctgacaaagtaaggaagctttatatcagtttttctttttgaatacttaaatgtggaaaaaacccaatagtcaggaggtatctttttttttcttttgctgatgtttgcattctttagggctcaagggacagcagtcttcagtgttgacatgttggttttctcttcctttaacctaaattgagttatttgtgaaataagtatggttctataattctgaaatccaggaatctctgtaaactgttttttttttaataactcgtttagctaaacctgatctctgatctgaattaacatgagattatttatagtctgtctttatcccagttaggctggaaatattcatatttcactatagaaatatgaatatgttttgttgtagatcattgccttccattctgctggaaatatgaaaaaatggtgtatgtacatactacatctctaaatgcctcaaaaattctgagtcctaaagcatagctgatctcaagggtttcagaatagcaattgtggacttgtgtcaccctctgcaattgattcactgggtcccttctaataaggcatactgtcttactgcttcacaagttctatagtgtacttagaaaatcacaagcaatgagagtaatttatatttcaaggagactgtgatgtaggctttggggtaagtttcacaggttctcctttagggattgaggactttctaagtctgccctaattccatctagaagccttgagatgaccctagggccacctaaaggttttgtcatgcaagctttgacccccttgagtggcagacaactgaagttgctggagttttggaaaagaaatagtccattctcaagtagtcctgctttaccaaatcatacaatatttccccagccttcaccttcatccatcagcagcttttcacctctgtccccatcagacactcatttgttccttctgattctcactcctgctgtaatctcttctaagaggaaacacaactgcttgatggtaacctaggttggaaggagatacaaggagtcagccttggaagagctctctggccagcatgggagaagaggatctaatctgctcacccactaactgagaggatcttttagatcacaatcagcgctaccactgtttcctaggaaaaacgatatttgaggagttttactctaaagttaacatacttcttaccaggaatggccttggtttcttggaaaagactgataataccagtttgctgagagttgatcgtatagcctgagactaataaagattcttattattgatgattataatatctattcaaaagttttatcagttaaggagatttttccatgtgttttcaggtggaataccagtgtgaaggatttctcgaaaagaataaagacaccgtttttgaagaacaaattaaagttcttaaatcaagcaaggtaactatggataggcttactctaatccaggatgtatgcaaagcattagctttttaacaataaaaatgatttttttaacaaaaatctgtttcagtttttaatttaccaaatatataacacttagtatgttagtcaaagtaatttagctgcatgtcaggtcctgttctaaatgtattgaaaatgctaactcatctaatgactcttattttatggatgaggcacctgagacacagagacttcatggctaccgagttttcaagccaaattaaaatccaggctgtcttgctgtgtctgtgcttttaactcctgtgcaatgtttctttcagttttgtgtgaaattattgcctccacagtggttctagactctgttgtgccttggtgagaggccatgagagaaaacagtctttctgccctgtcagtttgaagggaggtactagaaacgtggccttacgcactccatccagatggagactgatctctggatcatcactgagtgcagttccaggtgtggcccaaagcactttgaaattatttttcttaggcataggtactagagacactgctttctagagggaaaagaatattccagatggtaagagctacgatggctacattgtattgatgattaggttgatcccctccatcccttgaccttccatctggaaagaatggggaggggaacatggctcatgttcatcccacagagagcagagcaggaagccagtttcttaggtcagcaaaatgaatattcaggtattcagctaaaaattaaaaattttcatgtgaattcttctagattactgactggcagtctttgtttttctattttattctcagagaatctttttaacttcagtggaatagtatatgaatattttgactgttgtttttagaataaaaacctttactatcaattattttgataatataaagattacatgaagaccaaatcccagttttaaccttcagaaaataagtcgagaccaggtgttgtagctcatgcctgtaatcccagcactttgggaggccgaggcaggcagactgcttgagcccaggagtttaagatcagcctgagcaacatggcaaaaccccatgtctacaaaaaaatacagaaatttgctgggcatggtggtgcatggctatagtttcaggtacttgggaagctgagtgggaggatcacttgagcctgggaggttgaggctgcagtgagccgtaattgtgccactgtactccagcctcggagacagcgagactctgtctccaaaaaaaaaaaagagttaaagtgtctaacaggcactgggcattaactgtttatagtttacaggattgatatgtaagagaaaattcccacaatgccaatctctaagtattattcagttaaagatctttattggtttgatttataagtaatgataaaattctagttttattactttgtcaaagtaatttagctgaaacagaacattcacaggttttcatctgattcttgctgttgttgttgttgttgttgttgttgttttgagacagtgtctcactgtcacccaggctagagtgcagtgatgtgatgatcatagggctcactgcagcctcgacctccctggctcaggtgatccttccacatcagcctcccaagtagctgggactacagatgcatgccaccatgcctggctaattttttgttgagatggggtttcaccatgttgtccaggctggtcttgaactcctggtctcaagggatccacccacctcggcctcccaaagtgctgggattacaggtgtgagccaccacacctggccaggttctcattcttgaggcatctttgatcagttatctttattctgatttagttttctaattggcttttgagtccttagtcatcataaggtgggtatgcattctgacaaatcatttgcagtgactgccagtctgtgtaacattgtttccattgaagtggggacagtgtgtgatttacctaacatagcttggaggcttcctctgctgctggtctttgctgaaacccaatctaggagtatcaacttcataatttcactgcatctgatagaagccagtatcacatagtgtaaatgtgttctcttggaagtactaattttagaagattaatatctgtgttatgtgttttgagtagaattatttttgtagtaatacagtgtggagtatgtttgtgtatttatgtgttttgtcttttttttcctgcagcctctagcttacaatttgaaaaggagtttaaaaaaaaatatatatatatggaattataaacttatcagaaggtgctttatttgatatttttccaccataaagaaatcttctgtggccacatctaatatcaggaagcatataaataaattgcaacttgactaaataccactaaatttcagttctaccaaataccattaaaatgagttttaaccctctactttctgtatagctgattaataaggggaagcacagttcatctactgagtttatgcctcagatctctcatctataaaatagaatcatgatagcatctaatttatggaattgttatgaagattaaataggttgtattaaggttaatagatatataattatagttgcaaatatagcttgactaattagaagaactggttttatttatatgggatgtggcactgttgtaaagatatgtacatacatcaagatgttcctttggattcatttgaagtctctttttttccataaaatttctcccaaccatattgactaatatcatctacctacttattgagtaccagatcttttaataatctttcacattgctaacctgatagaacacaaaattgattacaggaattatttgttgaagttataaatcccttgaaaacaaatatcaaatgtacaggatatgggtagggttttaaacttttttttctgtaacccgaattatcttccaaaaattattattcataacttttaaaaccttctaatattgtagaatttgtttatgaccctttcctgctgagattttcggtgatgtttttcagttagtgctcagcacttaagttagtaggtagacaaataaagcaggtgagtagacacttgataaataacttgcaaacttggactagtgtttttctccacctgatgctaaaacagtttgtggaactgaggtaataagactttcaattactgtttttctcgtaaaataattatagttcaagcccattaatatgtttagatttgtcacttcctgtggattaggttttcaagtccgggtgcagtagttttgactttgctttcccccagacatggttgtagaattattgcatttttccatgttatttttgtatagcacttacctcaccttcctctcatattcttggctcttagcacagatactgactctttctggagtgtgactctgacagtgattacttaaggaagggaatctctgtaatatttcttttgtgaaggtttgcgttcaagtttggtttagaatgtaatttctttatattgtttctgacttagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcaggtgagttcagggagctgccgctgccacgctccttcctttctggctcatctgaaacctcagatcttccctcttcagcctcccaggtgggatcctcaggtgaggagagcctagagctttcactgtgagatcatacgacaccatccactaaaattcttctccacccagttttagacctgtgactctgcataagcctttcccgaaataattttctctacagcttaattctctcgtgcatatcgtctctcagaccaccccatctttgcttagttttctgtttgttttgtctctatatttgtacagtgcctcggtcagctccttcagaacagggccctcgcctttctttgatgtcttatgttctctgagagtgggaaatgttacatacatgcttagtgcctgaacagggagtagggctttgaatggaggctgagcgctcctcagcttgctgtcctgtgcatgggaccctgtgcctggtgtagacagaaacagggcctgacccaggtccacagcctccagtcctgatcctaggtccctaattttaactcctctctgcctatcctttgtcattctctcattcattacctatactcttctaagtcatctgctacgttttccagtatcttccatcaaaattcccactttatgtgattaaatagccttaaagcaaggttatattgttagttacatatgactaagctcataacaggtttctgtagcttcctgtggggaaaaggagtgggagtataggaatctatatttagcagagtaagcatgaaaatggtagaatttaggcaaattttaaccaaaagccctagcattcttgttttgtggcagctcctcttctgaagatgggtcaagtttataagtggcaaagttttctccattagtgtcataggaagggaatttcccattgttttacctcacctttgactttggacaaagccttgataccctcttctgccctttttcatgcagttcagaaactccctgcacctgcttatggagacactcaatgccactacccctcactatgtgcgctgtatcaagcctaatgacttcaagttcccattcacgtaagtatttctgaaccacccagtgagaaagtacatatcttataagaagtgccaaaccagccaagcaaactaatattttccttacatttttataaggaaaaaaatatttgggtaagtcttcatgccttgtagagggaaaccactagtcagtagattattttttcagtttttgtcccttttgagaatgtgagagtaaattagcagccatctgaagatttgaaaacttgaggtcaaccaagcattctggttctgttttctgttttgaatttacttcaattgatctctctgggatttttgttcatttgggcattaggtggaaccagcactggctgggataaggctgtttggcgaatgcttacctgctgcttctccactgctgaaatcatcagagggcgtctgttttcaccagcacctcctcctgcttcagataccatgcatgaagggagaatcaatttttctggagttttttttacaaaacagaaatatttttctaattttatgtatgtatttatttattttgagatagagtttcactcttcttgccctggctggagtgcaataacgcgatctcggcttaccgcaacctctgcctcccaggttcaagtgattctcctgcctcagcctcccgagtagctgggattacaggcatgcaccatcatgcccaactaattttctatttttagtagagacagggtttcatcatcttggccaggctggtcttgaactcctgacttcgtgatccgtccccactcggcctcccagtgggattacaggcgcgagccaccatgcccagcctatttttctaattttaaaagtaatacatgtacattgtaaagacagttttcaggaaatacagaatagtataaaaataaatgaaaaagcatccgtcagccgggtgcagtggctcacacctgtaatcccagcacttgggaggccagggtgggtggatcacctgaggtcaggagcttgagaccaacctggccaacatggtcaaaccctgtctctactaaaagtacaaaaattagccgggtgtagtggcgggcgcctgtaatcccagctactcaggaggctgaggcaggagaatcacttgaacctgggaggctgcagttgcagtgagccgagatcactccactgcactctagcctgcgggacaagagcgagacttcgtctcaaaaaaagaaaaaaggaaaagaaaaagcatccatcatacccagagagataactggtattaactgtcatacattgttcttgattaaccaccttcccttccctccatgctccgtgtgtgtgtgtgtgtgtgtgtgtgtgtgtgtgagagagagagagagagagagagacaaaaggaggggccttgtgctatgattgctgtttagtctttacttttaacttgacagattgtgaacactttcccttttggtaagtaaaaagtcacataatcatataatggctacagagtatcccattgtgtagacatagtatatttatttaaattagttcctactgatggccatttaagttgttccaacaatgctataataaacatcctgtgccaaacatttttgtatatttgtctgattatctcattgggataatgtgactctagaagtggaatttataggtcaaagaccaggcacacttaacaaaggttgtaatagctcccacccctcaccccctccacagtgtatgagtgcccttttccctacccccgtgccagtcctgctgtctggagattctgccttagactggagcacagttctgaaggactgctgtctttctctctgcttcatcaccaagaagtcctttctggaagaagtgggaagcaggaagaagctgctacactttggcctctgtcctggacagccctcaggaccatgaccttttatcaaccaacccgctcttccaccaccaacagaacacctgagaagatagcacaggggaggcccggatggatcgctcagaacttaactatgggagtcacaggagcaatcatttggccgaagggaaacctttctacttcctcttcagtgccagtttaacttgaagatgccatttgcctagagtaaaataaatacaaaatgtaatacaaaacaaaaatcttgttcattgatgtagacactatgtttagaacagtagtaatttttaaaaaaatataaccgtatggggcatatttaatttgtgcttcctgttagagaaatctccagggttgaccagtctttattccaggggagctctgtatactgagctaatgacttctgagagcttcttgtcaggccatgccatgaaatgagtatgggcaaagtgcaaaggagtgctgtgttgttgctgttgttttttagacggagtctcgccctgtcacccaggctggaatgcaatggcgtggtctcggctcactgcaacctctgcctcccgggttcaagcgattctcctgcctcagcctctggagtagctgggattacaggcgcctgccaccatgcctggctaatttttgtattttttgtagagatggggtttcaccatgttggccaggctggtctcaaactgctgacctcgtgatccgcctgcccttggcctcctaaagtgctgggattacaggcgtgagccactgcgcccagccatgttgtgttgttttaaatgtgctcagtggactttctttttgttgttgttgagacaaaatctcattctgtcacccaggctggagtgcagtggtgcgatcttggctcactgcaacctctacctcccaggttcaagtgattctcctgcctcagcctcccaagtagctgggattacaggtgtatgccaccatgctcggctaatttttctgtttttagtagagacggggtttcaccatgttggccagactggtcttgaactcctgacctcaggtgatctaccctcctgggcctcccaaaattctgggattataggtgtgagctacctcgcccagcacactcttatgagtttgtggtttgagttgcaggtaatgtttacagctctttatttttactgcttatcgtctcctccccattctctcatagttttccattttgatcactgctccgacttctgaaagctttcttttctgatttatccattttgctcttacgaaagaatttacaccctgactgaggagagtaatttgtggccaccagccaggttctttgtggactaacagctttgatttttatttgtaggtttgatgagaagagggcagtgcagcagctgagagcatgtggtgtcctggaaaccatccgaatcagtgcggccggtttcccctcacggtgagcctggcatttttcagatgtaagggatcctaatgggagaagatcctagttctttaagtaaactcagatggttttcttttaataggtggacttaccaagaatttttcagccgctaccgtgtcctaatgaagcagaaagatgtgctgagtgacagaaagcaaacatgcaagaatgtgttagagaaactgatactggtgagaatgatttcgcttaccgtcatctgagcagaaggccttgtggttctgaccttggaaagccccgggaacttttgtataacattttactagtccagatcatttcggggtgggatcagagaggggcacactactgtgtttaggatgctggaactagcgaggatgatagtccaccgtcaggaggcagagctgtgaggcctggacccacatttgaaacacattcttcttagacagcttgattattattgataaaagtgtacctagtacttacatctagaagacaccaggccaaatgctgtgtgattaagaaaaaataaagcttgttctcaggtaatatagtcttacttggaaagtaatactttttaaagacgagtataatatttaactgtagtgtctatatcaaatgctgaatgaatggaacaagaaatcaggggatgacaaagcgacgtccagctatgggaaggagagatttcatcaaagaggtgtgttttgagtcaggccctgagaatgggtaaggttatgcaaaaatggaaggagactattataagagggagtaagagcagggtaagcatagggtttgctcagaaaacagttttttgcagtgtgagatttgtgtatgggacagtagagaaatggttaggaaatgtaggttggtgttacagagagtcttgcagaccaggctaaagagttctccaactttactgtgacctggaatgcttgttaaaatacagattgctgggccccgccatcagaatttctgattcagtaggtctgaggttgggcccaagaatttgtatttcccgggtgatgccgatgctgtctgaggactatattttgagaactactgatcttggtcttagagaattaaagattcatgaaaagtttttaaaataatattttcacttggttaacactatcctagatggagtacctcactttgagctaattgatcataattactagctgtgaactaaatgtgatgctttttttttgttaataatattttttccttgaaagagctaaggccacttcctcagtaatgctttttttttttttttaactggggctttttgagtttgccccaattcccttctttttttttttttttttttttgagacagtcttgctctttcacccaggctggagtacagtggcatctcggctcactgcaacctccgcctcgtgggttcaagccattctcctacctcagcccccccagtagctgggattataggtgcacaccaccacacccagctaatttttgtatttttagtagaaacagggttttaccatgttggccaggctggtcttgaactcctgacctcgtgatctgcccgcctcggcctcccaaagtgctgggattacaggtgtgagccactgcgcccagcctgcccaatccccttctaacctgtgttcaggtgggaatgtagagcagaaagtaggaacaggcctattcctggtcctctcacccaggccatttcaggcctggatcagggctttgtgggaatttagttaggcagaggaggctgaaagatggaggcagggttggtgtgaggtgtgaagcgggatgcgggtaaggaccacttttctagctaggtttccaatgtaaactttattgatttaaattgaaataattgtagattttttagatatatgtggatgtgtcagattttttggtttcatatatgagataatatgagatatctactcatagggaaaaatgattttctctgttttcccttagactttcagatcacatggccaagcatggtggctcacgcccttaatcccagcacttttggaggccgtggcgggcggactgcttgaggcccagcgtttgaggccaccctggccaatatggtgaaaccctgtctccactaaaaatacaaaaattagctggacgtagtggtgtttacctgtaatcccagctactcagggggctgaggcaggagtgtcgcttgaacccagaaggcggaggctgcagtgagccgagattacagcactgtactccagcttgggagacagagcgagactcatctcaaaaaaaaaaaaaaaagaattccaggtcacagtaatgattcttacatataaattccattctttgatgcaagaatgattaatgatttgcatacttctagataaggtgaatcacaatgtaatataaattattatgtttttgtaaaaggagtttgaaaggattttttttttttgagacggattcttgctctgttgctaggctggagtgcagtggcgcgatcttggctcactgcaacctccacctcctgggttcaagcgattcccctgcctcagcctcccaagtagttgggaatacaggtgcatgccaccatgcccggctaattttttgtattttaatagagacagggtttcaccatgttggccaggatgttctcgatctcctgacctcatgatccgccagccttgacctcccgaagtgctaggattacacacgtgagccactacacccggccaatttgtaggattttaaacatatttatggggttttgttagtttgttttcagatattattgataaagccaagagctaactgtttagaaacataactcaatatgaatacccaaggattttggtttttggtttttgaattttatttcataaacgtttcttcctgccttattcttcacactggtgtttttgtcccttcagcttctcatggaatatacagcccgctgtaatccttacaacctgggtcagtcagagagagtcagcatctccatttccttgagatgtttaaaacacaaacaagcaaataataactgcctataacccacaaccaagttttgggcctcagataataattccaggtagaataattctggaaaataactcttaaactgcagtttttcttaaaatcccttctatttgctcaacttgcataggattaaaaatctggctccattagttaattgtgatgtagcccaagttttagctaatagagtcattcctttactgattctgcttttagacattttttcttttaaatttcacttatatgattattatttctgaatatacaatttcttccaaaaataggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatggtaggtctcctggggacagagtagagtgcccatctaattcactgtccaaccaaggacagttttgactggtcaccatagctgaaaagataacacctcaccttttcttagttccaagggacaacaaattaactcataggacagctaaatagaataaaatttcactcagccttatgaatgattcagatttatcttcaaaacatttacaaactgctgcttacttatgtcctcaaaatttttatttttgatacttttatattgggcttgaggaaatcatgtatcaattaaaacagtcgtgaatatgagctaggtaataatgacttcattgtataatttttgggagcaattaactgagagggtctggaagagaattacactttagtgtgattacttattagtttaattttaattgagaagtataagtagaactgaattaatcatgagcttatagcctaacaaaatcaggaaaaatatggtagatgaataatggctagatccaagaaagctggtgataactaagtatgagattactgtgtatgtctgtctgttctataaagaggcatggcctggggtaaatggatcctgttgtagaaagaatgaatttttgtgaattttgctttcttgtaaaatctggcaatgtgggccatcctactttccagagttagggagggctcaaatgagataataaatgcaaaaatactttgggaaactataaattgctatacaaatgtaagtaaatataaatgttgacttagcatgcacattattagaataatacaatggaggtactatttatgcctaaaacagtgacactctttaagtttctctaatatgtattcctgcatttttttctgattactgacaacataatgttattttctttggccagctatgctaagtttctgcgcagaaccaaggcagcaaccatcattcaaaagtactggcgcatgtatgtggtccgcaggaggtacaagattagacgagctgccactattgttcttcagtcttacttgcgaggcttcttggccagaaataggtatcgcaaggtgaggcattattttcaactttgtttattcattctattagcattaaccaaatttcacatctatacagagtaccacaggggctacaatgaaggtaggaactgtatggggacaaccagctattgaaatgcatatttatttattttaaaaaattcttttttagaaataggatctcgctctgtcaccctggctggggtgcagtggtgcagtcatagtacactgcagcctcaaactcctggcctcaagcagtcttcccactgtggcctcccaaagtgctgagattataggtatgagccactgtgcacatgcccagcctgaaatgcattttaaaatactaaataatcacatacagttattaacaaaacaatgggaaaaaaacttttacctccttctttctctttgtttatataatttgaaaaaaaagtatgttagtttactgtggctgctataataaattatcacaaacttgttaccttaaaacagccaaaattaattctctcagagttctggagaccagaagtccaaaatcattatcaatgggacaaaatcaagttgtcagcaggctgctctccttccagaagctccaggggagaatccattccttgcctcttgcagcttctggtggctgccagcattcctgtgcttgtagccacatcagtccagtctcagcctctgttttcacagcattttctcttctgtgtatctgacttgacttctcctatctgcctcttataagaataattatgatagcatttggttccacccatgtgatccaggataatcctcccatctgaagacccttaacctaatcacatctgcaaaggccctttttctgaataaatagcatttgcaggttccagggattagcacctaatttccttggggccccctattcagatgactacagagaactttgaatagatagaatatatgacaaacaggttaaaggttattccaagaatgagacaaccttggaagaatttaccatggtgaagaggaggcaaattataacattaatgtggttaaaattgtattgacagatacaatgctccaaaagtttttgacaaataatcttacatctagcaataattaatggggtcaccagagtagtcttaattatcatctgtgaccattgatgaacgatttttatctctttcattttggcaaggtttggagtctatcctacaggctatatttcaaatcagtgagaaatacaagcctggatattagagctctatggacatcaccattagaaggagcattaatggggtgatttgggtctctaagcacagacagtatatgggtgtgacctaggccctatttatttatttatttatttatttatttatttatttttatttgaagtgattttagacaacaaaaaattcgaaactggtgaggcttgaatgagtgtatttaatagctgtgttttgaagatagctactccagatctttctgctcacccctcctttatgtagtctcatgctctttctatataagcgtgagattttagggaggaaagaggtttgaagttgcttttcagatacaccaaactagttaccttcctgtgttcctcactactttccttaggaacatctgagctgggttttgaggtcactggtttagcagtggcagcctccggccagctcaggctcccactgtgactggacagggtggaaggtggtagcgtagaggcttgctcacatgtaagccaacagccatcacattagtgctccttctagctgtatttcaggtccaaggttccccttcatgagatttggagtgggggggtcttaaagagagtacaggtgttgattaatttctctcactcatgatgaaagtgagattgaaaatggaagctctgattaaatgctgtttccatttgactaaaattacaaaaatggacccatgtccaaagttacatgggagaagcaaatggaacaggaaaattggcattaatagttttatttatccagtcactgtgcctggctacctcttcttaaaattcaagaatttcttctccatctttcctagaaaatgtttacacggtgtctttttggtgctctttagcgacaacaaattcatctaataaggcaaacttttgtttgtttataagtttagggaaatatcatttttttttaggaaatgtaacataaaatcaaaagtaagattagtttgtttcacatctttttacttttacctttcattttaaagccccatccctcctacctttgaatcccaaaagtggatccttgctacatttgaaatagcaatggaaaatcctcactagaatggtattcctcaaatgtggtaaacaagagtgtcatcttttagtttctaaaaaaaaaaaaaatcaataaatcagtacaaactttttagtaccccaagtgttggcctctacagacagtttgctgcccataccccgtgtcctcatgcacgggcctaataatgcatagtgaggtggtatcagcagtcagggtggtggggatatctcttattttagtagcacatagtttacaggatgcctggttctgttaattttatagaggatcatctgttgccaacagaaatcatatactaataagaaacctaatgtattttttctttctttttatagttgtttttcttttggtaatctggtgctttttatttagacagcttccaactctatattctgcttagaattatacacataatatgtgcatatgacacatttttatgtatgtttctgaaatcaccttctaaagtctacttttcaaatcacttttaaaaataattttgtagcctccatatatctgtgataagtataatctacatagtacattgtcaattcaacttttatgtcttttcctctaggtaatgtgtggattttcagcccgacatagattgataatcatgagtgtagtccagggtcttgacattgcttgcccttatccttttctgcagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcaggtgtgtttcacaaaggggccctgagagtggagtatgcctgaagaaatccaccaggattattttcaatattgtttttctttgactttacccttcggtcttagtaaaaagtaaaattatgaccgtatttatttccataatgggcatggaagtacttatgaactcataaggtggatcacaattgcaaaaactaaggcaggaagttattattattattattattattattattattattattattattattactattatttgagacagggtctcactctgtcgcccaggctagagttcagtggcatggtcacagctcactgcagcctcaacctgctgggctcaagtgatcttcccaccacagccttctgagtatatgggactacaggcacgtactaccacacccagctaatttttttattttgtagaaacagggtctcatgttgccaggctgttgcctcaagcaatcctcctgcctcagcctcccaaagtactgggattacaagcatgagctaccatgcctggcaggaaattatttttgagaacagagatctactaatgcttcaaacctttatgaccaagagtcatattgtatgttacttatttttcaaacaccagcttgaaccaggcatactgtattttgtacttggcaatgctctatcaaaattatcatttattttcatgtggtatcatgttcattttacagatgagttggtttagcattgaaatagcaaaagcatcaggaaaatgttgatgcttctgatgaacttgcaatctgttgcagagataaaagtttgtttgattaaagatagttactaatattttagcacatgtaaatgatataaaggtaattaagaatataaaaatgctaaggagagcaaagcaaaacagggatcagaatgaaatgggatggaagattttctgagtgggagggagaaattttgaggtagtaaacataaagatttgtgagaaacgtgtgtgtgtgtagggagagggttttttttttttgttttttgttttaggacagattctcaccctgtcacccaggctaaagtacagcagtgcaatcacggctcactacagcctcaaactcctgggctcaagtgatcctcctgcctcagcctcccaagtagctaggactacaggtacacaccaccatgtctagctaatttttaaatttttttgtaaagacggggtctcattatgtgcccaggctagtcttgaactcctggcctcttgtgatcctcctgccttggcctcccaaagtgttgagactataggtgtgagccactacacctggccaacttgggattttgaggctgttttaatcattcgtacgcatcactaagctagtaaatggtttttagcaacattttgatctgttttcaaaaacaagtatagatcctcctatttctgaattaagaatcaggaaattaagaatttactatgtaactcaccctgtgactatgagaaaatcacatccatcttgcttaccacatcaaacagaattgaattaattgtgcctgttttcttctctgtttgtgtcacctagaaggtattggttgtgctattgcaaatgttgtagtattttggttggatactatatcaatgttatgatgatatagcatgaatatgatgaataaacatggttttcttactaaatacatttgatgatatgtgtatttacttattgttacttatgtgtatgtttaaagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcaggtaggaataatgtccatatccccatctactccgtacacaaaagagaggtgctgtcatcatgacttggtccgtgtgactcactgttggttttattagaaatgcagtacaaattttagttgaattactgttcattattactgtttcccaagcatttatttctcattatcaatgagtaggctgtaggtcttttagtagaactttctactctaataagaacagaggcaaagctgtatttttaggagagaatggccaagtacctactaacacttgtatattaaaaaaaaaaaaaaaaaaaaaagtcagtctggggcatagactccttttaaaaaaaaagtcagtctggggcgtagactcctttttcttcagtagggttaatgtgattaacccatttatgcctaaggttgcaattttttgaattgcaaaatcagtctttggcaatgaccttgagcagtagaatataaataactcccacatgcttagtgttctaataatggaacattagacataatatttagtacctgatggtagggatccttgttgaagcctgcattaaggctgtattaagaagtccaagcaggagaagtctaaatgtctgcacagtgattgcaaccaacagctttacgcagatggaaccctccccacaaaatgctttcagattgaccagtacttgcacgcttcaaatttgtattaacatatcaaaactttattaagtatagaagacattaagattgtcaagtagtaatgagatgtactgctgaaacatttgtaaaagtacctcaacattaggcttcctggaaaaaagtaatcgattttcagagattccgctggtattaccatctttaaatgaaaacagagttgcctgtgtcagctgtaactgctggcaagaatcctgatatggtttgtctgtactgacttctaaatgttaatatcagcacatgcagtgagaactacagcaggaacttagatgcaggtcggttaggatagggtggctggtaaaattgcagtccttccatggcattacaggttccagtaaagtaattcctcctatatctctagatctgtactctatatatagaaacagcagtgccaaaaggtgagattcttttctgttttatataatgttgttttgatacagcaagcttgttctctcagaattaagacgtgcactcaaaaagatactcttgaatgtttaagatctcttttcttccctttaagtctccccaaaccacggaagctttccagcttcggattcctcagaatctgtacagtagttaagtgtggtgggaagattctcctttccttttcaaagccaagttcttgcctttctagtctgatagaataaacacacaagcagattcagattttttctttcatttcatttcattttctcccacttctcacagagatagctgtaggcactaactttagttcagacggtgtttcctatgttgtgtaggctggtcttgaactcctggcctcaagctgttttcccacattggtctcacaaagcgctgggtttacaggtgtgagccactgcgcctggccccattagttcttttgatggaatgtagtgataggggaagaatgaaaacatttcactgtgacagtcagcttcatggtcaggaaaatgacattctcagtctgatcaaggagcccagaagttacagtagagttatgtatggttcctaaccaagagcatttatcaaaactgctggggagtttttatataaaaagggagctatccagactctgggagtgtgggctaggcacattattttgaaaaagtaccataggtgattggttgtgcacccctaccaaacaagagcctctcctgaaagcccacagagagctggggctttttttactgagagtggatgttaaggcaaggtcagtccagagggaaaagactgagccctcggaagggatacctactggactgatgtctgctgtgtgtggcacagtgtagttatccaactttcctgctccctggagccctcttttcctgtcctaaaccccctgacatgacaagagatttgcctgccagttctctccctattattaaagctcttgttttcagagttccttaaactttagcttagaaaaaggaattcagattttactcatcataagcacacactttattccaaagatgagctgagtaaattatgtactttgcaaaattacctttggttttaacttttccttcctgggaatccttatccagcaaagaactagaaagttaagagtcaacttgtgtgtgtgtgtgtgtgtgtgtgtgtgtgtgtgtgtgtgttttaaaatatacatgacataaaatttaccattttcaccatttttaagtggacagttctgtggcattaagtacattgacattgttgtaatgtcaatgcttatttaaacatggaataaaaggactagttctcagccttgtaaaactcttaaagggagatgaaagagaaattctctttcttgacatcagatgggagaatcaaaagctcttcagtgaatttcccaaactaaacatcctcatatccttcttaacctccttaatctccccacttgaatcatgggtacacataagctttgtgtgaaagcattcagaggagaaggtaatatcaattacctttgagagcaaatgctgacttagtgccaggcaattttttaatgtttaatgtaaagtaaaactttaatgttttaatgtttaatgtaaagtaaaaaaccatcaccatccttatccttcaagaaattctagtctattctggaaaagaggaaagtaaatcatttataacggatataaagagcatatacagggtcttgtagtagcacagggaaaagacagctaattgaagggggtttcaggaaggctcttgggagggagtaatgcttgagcaagtttgtaaggtgactagacataaccaggcaaagacagggagcacagaggtggtggaagtaaggaatgactgcttatggtctttatccttggtcatcaggcttcctctgtccattgcaaccatctcagtttattgtttcatttcgtagctggtatcaaatctgaaggaagaaaatactttgctgaagcaagaaaaagaagccctcaatcaccgcatcgtgcagcaggctaaggagatgacaggtaaagcttatatgcgtactacacgccaaccaacctcacaccaaagttatgtaagttacaatgtcatttgatgagttacacaacattatttagaatttaaatatttttaaaagttgaggctgtcatcagcaaatttataaagttccaagaggcaacagatcagatattttggttgaattcgttgcttgataaacttgtaaatctggtatctctaggtacaaatgtgaactccggttcagtcagtgtcatatgtaatttttttttaaaattaatttgttctgcatgtgtgatttactagttaaggcttataggattcctaatgatttagtaagaatttttgagctgatatgtgtatatttctgtgtgtgtgtgtattgtcttttttttttttttttttttgctaaatcaatggatgttattctaagattcaccactctttgctagtctaaaaaaacactaatttttaaaatagagaactaactagatatggacatttattctattttctgtttgtggggtaggttagaatggtgataagtttataaggaatccacatatatataaatatggggtaagaagatacagatctatacagtaattagtggtggaaatggaagagaaaagatggtttggaatggggatatattatatgaaaataatacattttcatatacattctgttgattacactggtattcaaaaaaggcaaaaatgttctaagattttacaatgagataacaaaacaataaagatatgttattagtaatacggatattgagaaaaaagtatacatttatgaggcaaattaatgaggccagttgttggagtgttaagtttgatatgtcagctaggacctcaacatggaggtattcagaaagcaaatccagattaaagagtagagaaaaaataagaagggagcctaaagatacccattaaaactgtggtggtaagagagactgcctcacctctcctagctgaaggggctaatactgaggaaagagaagaaaacctggaattaatgaccatactaagggatgaggtaaagaaaaggagccagaaaataaaattaagaggtgaaggagaaaacagagccctggaaagaaggctgctgggaggcagcatgtaacagaaggatccagaatgatgagaatcttctaggaaaatataaaatgttatttgaaagtgaactgtaagaacaaagaaatgacagtgagtttgccaagggaaaattttttggtaggctcagagcagcttctgcaaactggtgagaataaaaggcaacttgtagaatgttttagagagaagaaattctttcattcattcatttacaaattattaaagccctactctagggaagcactgtggtgggcaccaggaaagcagctgtgacaagacacttgtagcccttgcctcatcgtgctcacagagaaagcagtggtgaagcaatagaagcaggcagggcagattaagatttagcctcaaaatatatgggtaacatggagcaaagtggtagaagcttaatattataaatgtgactggttggctgattgagttaagacatacagctgagatttgaggttttgttactttacttcatctgcagtcaagggctaatctccaatctccagatcatgtcctagccaaaagcaaaccacagccacaaagagggctgagggtgtaggtaaatggagaaggcaaggtttcctcagcagcgcgtggggatgaccaacaagcacacaacacagctggccaggcccgagcattttatctggttagaagctgggaagtaataggacagcaggggaggttaaagtcgtagaaaacgtaagacagaactgtgagatggtaaattaagagagactctgtagagtaggacaaccgggtccactgaaaagttgccattctcttgagaaatatctctcttgagaaatatctgtgaggaggtcattttgagagagtacactactttgggcaaaataattttatgaatagaataccattggaataaaaatatgtacactttagttactagacagtgactgactagtggaagtttttcaaggatgtgctgtaaccagtgtatcaattagtggtactaaggccagagtacatggaataactcagtagatgattgttattattaataaattatttcattttttggtcattttttcttttcctaaattttactaagacactcttcatggatcacagtgatactaaaagtaaaattgcctacagagaaactggaaatcagtatacatgtttacacaattgcattctcaaggggccatctttagtatgcatatcctttttttaatttcagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtggtgagtcaaacacttttgttttttttttaatgaaaaattttaaacatatacaaaagtaaatagaatagtagaatgaacctccatatcttctgtgtacctaccacccagttccagaatgttcaacacatattcacctcccattccatctccccaacccactccatccaatggattggattattttaaagcaaatcttagaaatcatataattttattcacaagtacttcggtaaagtcaaacagtttaaagactgggctatgtgatagtataaagtcagtaaagttggatttttgtttttgtttttgtttttttttttgagatggagtctccctgtgtcaccaggctggagtgtagtggcacaatctcggctcactgcaacctccgcctcccaggttcaagtgattctcctgcctcagcctcccgagtagctgggactacaggtgcccaccaccatgcccagctaattttttgtatttttagtagaaatggggtttcaccatgttggccaggatggtctcgatctcttgacctcatgatctacccaccttggcctcccaaagtgctgggattacaggcatgagccattgcgcccggccagttggactttgttttatatattgaatggcctaatgtaaaatttacatgtagactggttttgattataattttgaagatatattcctatgaaaagaaaattcagactccatttgtaatgaattatctatttcaaggactcttctgcatttgccaatgtacctttcatacttgtaataattctgcacatcctccccattccatgtatcctgctatcaggaaacaaagagttcccaagcatccctacaagtaccagccttaaaggtaacctaattatacaaatgaccagaaatgccctgaaatatctcataaaaagccagataattcagtatctgtggagcagagtattttcttcaaattttgcttctatctggacctactgacaaagttcattacaatatgacacttaaaagtcaaaataaaagagattgtgtaatacaaaagataggctctcatcaccttgcagatgagaaaatcctgtctaaaagagaccaaaaagctaatataaatcccacattggaccattatttcaaccctcactactctgatttatgtgtgacaaagagaaattagaagtagatgcaagtcaccattataactgttcttataattgacaaatctaaagacccttgttaagcttcatcttcctagatcaccgtgctaccgttggtcccattgaaacctttcttccttcacattctgtaattcttagctttctcttgaatccttttcttctttttcagtgttcatgttccccagttccattctttggtgtgtttttgttcactctatttattagatgacaatgccaacatttatggttaatctctgtttcagttatggttagagctaagctttataacccagtaggtgtttctgagaccccctagttatttgggatgttaataagtgggattggaaaagaaattcttaggtaaaataaatgtggtaatctactaggttaaacagagataaacaaatgtcttttctggagaatttcttggattctttaatggtgcatgcaatatgaatttcagaaaataaaatgagagaagcaggtgccatacatgtatccctctctgagcatattccagagatatccatctgtgaggaggtcatgggtctctttagtcgaggaggtggccatttctagaaaggtcctccagtgacgcctcctccagcagcttgacacggctcctccttcctgctaagcaagtctgcctgctctccatctgttcccagcagtgctctagaggtagttttagttgctcaatttcttatttctcagtcatgtgtcctctccattgtatgcctgtgactcagtcattcctcttgggagacaaaatggtcagaggaagggaaaaggagaaagcagaggaagggagatcagagctcacttgcttcccactcatttcttcactagatctccttttcctagctccagatataatcaagatgacagtttttgcagaaaatatttgcccagaattgcagagaataaaaaacttgatcttttaacccatgacaattaaaatattagtgacaatatcttattttaatgtttaggtacaactaaacagctaacagatgagtacttgactaatattagactgacgctgttctgtaaatgacactctcactgcttcaatccagagctaatgaagcatttggttgtaaacagagtcgtcatatgaatggaggaaactctagggaggggacttgatacactgcctccagcgcttcccataacctatgtgatacatgggccaaagaacactaatagtgtcactcattgccagcctctagagttgttggccctagtacaagaagtactgtagcatttttctccaagaacattcggttgtccagggaatataggggcagaggcaaagaggaaggaccaatccagggctaaggagtttcaagccaatgatgaaaagatcatgaggcatgggcatccaggtttatgaagtgtttaaagataaattaattccagagaggggagggaaaccagcatgtcaatcatggggtcgttagtcttgacaaagggataaaacatgttctggaaaagaaggaatcatgggagaaatcaggagcagaagaggagggaggtgcagatcttgaaggagaacgtgatgatccagtcaaatatatatccttgtaattgaaaaacgtataaacgggggaacaaaatcctaaaaacagagaactgaaaagttaccaacaaggaagttgctgaatcactgcaatctcctaacaatcacagcagcagaagttaacattcattgaatgcttgttatgccaagccaaactctttacttccacactcttatttaatcctcacacagaccctatgagatagaaattagtaccctttttttcctgatgatgaaaataccagctagtggaagagctggtattcctgcctagctctctctcgtttcagatccagagcacttaatcactgccctgtatccaaaagttacattaaatagcaaaaagcaatgttgcttctattaatgccttaaggtattccttgtataatgatagacatatgtgggaagacagggatctctctcatttttaataagcttattaaaaatctttgtcctggtgtttatctggactacctggttttcttagtgatacaaccagtttattaaataaatgccattcctacaactgtgggcttgggctggaaactttaagcaagagtgcctgtgtctgtaaacagacagtgaatttgagtgcctttgacttcatgtgtgatgattgtcccctttagtgtgcaccccagcttctggatcgtttcagaggtgctggtgttcttggatcttcccttcacattgcagtacaggttgggttggcctgggagacttttacgtgcctctggatgagtctgctctccataagcctgggtgttggaagggaagagacaaagaagctctttgtggcttctagctcttttccagcagctggggaaaggtacaaagaaaactggacagatgagaaagctctcagaggcctttgtgaagccctcaggactgtaacactgcaagattaagccactggatcttttccacctctcctgctggggacatgctaagagcccagccttttaattccttcttccctcaagttattctctaaccccttctcctacaggagggaagggtgtgtcgttgctaaacttttctattcctcttgaactttctcaacactaatttcctaggtattacatgtcataaaaatgccacctggatgccctgaggtaataaccgagggctcttcagaggattactagagcagctttcttacctcccgtgtactgtccatcctgcccactgctcactccaaagatttaacttcacgtattaaagtgacagaagttagagctgcctgtgtgaactccttcatctttcttttaaaccatttatgcctagttaccatgcagtaaaatgattgtgcatgccatttcaatatattttatgaggtttttgtaagttttatttgattatggcactaaaagtcagtgcttggaagcttcacccagtgcttcactgagcactgcttcacccagtgtgactgaccgctcaaagctttcaacacccaaaggggactcgactaataatcagaagtggttttcatttgggcatttggttttgcaactgttcttgtcctgtcatgccagtgtacctttttctttgaagcggtgacctttttgtaattatttggtcaaaacaatatggaacaaatcacttgggcaccaatacaagtcaggaagtagggataagaaccaagtcaaggtggatgctgtcttaactatgcctagactaattatgttgcattaattatacctgggttatttgccttgcagcatgtgcctaagcctggacacaagagaacagactccacccacagcagcaacgagtctgaatatatctttagctctgaaattgcagaaatggaagacattccatcaaggacagaggtacagtttagacatctgtcactgaaagtaggatatgagcatgctgttgttaacaaggaacatttccattgcaaagcagactccaattggccataaacatagtatttgtttgaatcatttattcttcataagtgacttgtagatacaaacttatttacatttttgtatacttaagtgctgtgtacatacatacctattgcatttttttgtcaatacaaattttaattttaatttttaatgcaattttgatggtgagattttatttttataattctctttacccctaacatgatatgtttacaggaatttatttcagactgaggtaaattattttatttttacttattatttatttactttatatctgtggaccaccgctgtagacagaggtaaattatttttaaagtaagccctttgtccttgaatattataaacaccagtgccccagagtttagcaaaactgatgcctctattttatgccagtttttaccaatgtaactttcttctacaaaatgcatggaaaatagtttagaaatctgctttaatgttttgtgttttgtggtatgaaaccaaaatgatgtattactgtaactccaagagtatagtgacttttagttagattattcccaaccaattctaagatcttttaaaatatgatatagtttcaataatgggtaattcaggcacaactgtcctatttttatattatattttttgaaaatggccaaatcagaaatagactgcttctggtagaatagctagagaaattgagtgattctttcctttcttgtcttagttctacttaagaatgaagtttctgccatctcattctgttaattttgaagaaaaatgttacatagttggaatgtcatatcattggaatcatacatacaagaaggctaagtaatttgtccaggttcacagcttataaatggtagatccagcatactaactgaggcttgtctctttagaattcatgttcttaagccattatattctactgacttccatccagggattctatactgcaactctccaatcccttttctatctatagctaacattggctggggcccatggatataacagtatggccaggatatagcaggatagaggtttttccagttatctattgctatgtaataaatgatctcaagttttagtgttttttttttaaaaaacagtaatttattattactcataattctgtgggatttgactggggagttcttctgttccatgtggtggtggtcggagtgcctcatgtagctgcattctgtagagtgcttgcttctcttccctgggcctctccatgtagcctctgttcagcagcaggtaggtgggttctaagagtgacagactaaaagatgccaggcctcttagagctaggcccagaactggcccagtgttagttctgctgcattctgatcaaagaaaatcacaaggtcagcccagattcaaggcaaaggggatagattccatctcttgttgggaggaaatacttgtatgttgagaagaatcattggtgccatctttggagaataccacaaagttagactttgaagatttaaaaattaggacttctgagccttcagtagataggaaggttttaggattacatcctgttgatctcagtgggagtactcacttgcaatagtcggagggaagtacatttacaagctgcccattccagtgtagtaccactttagcagctctgctggtagggggaagccatgataaaaagggtgtgcttgccggaaaccagtctgtagctctgtggagaattcgcctgccagtcccacttgttttgcagccctcccacgcttgccgatcttcgtgggctgggatgacattgctttggaaccagtgctcctcctgcttggtgtgcacctcttctaggagcccttgactgatgatccctgttctgcttctgctgtcaagctttctcacacctttcacctctgggaagggtcaccagaactttctcagctatcattaggagttatttcagaatgactgccaggcctgtagtggtggtaattttgtgaataaattcagttattttgattttcctcagatgagagactagtgttattttttaggtcagttaaaaagcttcgctgtcttagaaaagccctgggtgacaaagtccttactaaggcaaaaagcgaaacaaaacctcagaaacttctctgtgacagatggcccaatcttccttcttgctcatggggtatagtgaggacagctctttaatttgatagcatctctttaattagatgtgtcatccgggctcagaatgggtaccatcgggagcactcttaaataattaccactctttatgcctcgagtcattttgcatttttcaaatgtaatcttttgtgatcttccaccttctattttaatattcttatccacagaattttgctcttgtccagcaatcaactagttgtttatatagtattagccaatgtctaaagagttaacccatcacattttttcttttttttttttttttgctagttctagttatcaaaacaccatcccattttaataagaggattccttttaaacaaaaagtgcccattcaaggctcaaaggaatgatttccaagtgatattttaggtataatgaatgaagtattatattcatttctagaatgaaaggttctatgacagtgtaagaaaagattaaataatttaaaatttcagggacatgtacatcattcataaatgaacaaacattaaaatatataatatggaatgtttacattgtaaataagcttcaatataagtattttacgcttaatttttatgggggacgtatagagaagaatttttatatgaatgaaattctgtggtgatttcgtgttgaggcaagatgttatatctgttctgctaagtcaggacagactttattataaagattatatacctaaaactttttctaattgttaagtattacaaagtaggcagaaagaaaaagttcaggtgtaattaatttgtggacaaatgactttgacagcctataaatgcctacttttttgttcagttgattcttctcaggttgtttttgaattggaataacacttaacactactctgaattcatgaaagaccaaaggtagctaattaatatacaattcctgaaaataaaaaaaaaaaaaaaaagtcaaagaaatgcaaattaaatcaacagcgaagtgccacttttggtctattaactgagctaatttttttttttttttaattataacggttactactgttgaaggcaaggtgatggttgctgatagaagtttaaattggcccaatttaatggacttttaagaagttaatgtttagatatttatatactggggtgtttattttagtaatattccaatagcaaaaaattagaaacaacttcaacacccatcagtaaaataatagctaagcaaatggtgacacacctgtctatatattgaaatatcatattataaatttgggaaacaatgcaatgccaagtttaaaagaccatataaaattataatgacattattattctaattctttaaatctatagatgcatagagaaaaagactaagaaaaaattgtagtttttctgtggcgataggattatggctgtgtttttcttctttgaacttttcttatttcctaaattttctgtaaaagcttattctgttctcatatcagaaaagcaaaagtaaacattctctttttaaacaattgggtagatttaccaatcatttaagaattatactttgaccatttagttaaataaatgattgttgccattctcttgctcctccagccccacttgtctctctctaacaaagggactctttatcttccacattaattctaatagtacaattatttctcttcttacctcattaaaaattaaaaccttaggtaaacatgttaaaacaattatggcatccacaacttccattatgatggttagttgtttccattctttttagctttaattagtgtacctttatttatcctagtaggtctcattgtgattctgttttggaaccagttgacacatttttaaaatgttattaggttatccttcagtttattaagaactatacagtcgtccctcggtttccacaggggattggttccaggactttcatgaataccaaaatctaaggatgctcaagtctcttatataaaatgcagtagtatttacatataacctatgcacatccttccatattctttaaatcatctctacattacttataatacctaagacaagctatgtaaatatagcattatttaatacctaagacaatatataattaaataaaacattatttagtacctaagacaaatatagaatattgtaatacccaagacaatataaatgctatgtaaacaatacagtataataactatttatttgtaataaaaagccaagttgcgcagcacaggtctatctgcagagccaaggctgggctttatgtctatttcagcagtctcttcttagtggggacacagccaagcctaaccaagcagcgttttgttaaagtagtgagggctaaactctcttcactgttttctgaagaggcagtaaatattctaacagtaaaaatgtgataatcattttcatttttattgtttgggagtttttttgggggggaatatttttgatccacagttggttgaatctgagaggatgtggaacccacagatacagaacccaaggatatggagggctgactgtatatgtttggtttatcagatttcagttttctctgtgtgatctcaatatatttatgctggcatttcatattttcaaaaatcattcttcctgattgtaaatgtagaatctgcccattgtaaacaatttaaatatgggaatgtacaatgtaaaaaatgaaaccttcccatagtacattccgtcttctgagataaccactgatggccttccaaatttttatatgcatgtgctaggtatacatttaaaagtcacatatgtttgtgttttattaacaaaaacaagatatattttctgtcctacagtttgtgtgatcatgtaatactttaagatatatttatctgctcatgttgatatacttcattctttttttttttttttgtgagacggagtctcgctctgctgccccagctggagtgcagtggcgcaatctcagctcactgcaacctccacctcctgggttcaagcaattctcctccctctgcctcctgagtagatgggattactgatgtgtgccaccaggcccggctaatttttatatttttagcagagatggggtttcaccgtgttggtcaggctggtcttgaactcctgaccttgtgatccacccgccttggcctcccaaagtgctgggattacaggcatgagccaccgtgcccggcctacttcattctttttaacagctaaaaaatatttcacagtttggctataccataatttacttaagcaactgtcctattgactgacattcagattattgtcagtttttcgcaattacaaaaaaaatgcttcaatgaacatctttttccatatatttttatatacttgtgtaagtatttctgtaggattaattcctaaatgtagatttgctaggttaaaggtatgcacatttaaattttagtaagttcggcaaaattgcccgtttcaaaggcctacttttacttccaccaatatcatatgagacactgtggctaatgcagagcattatgaatctttttagtctttgccagtctgataggggagaagtagcagctcattgttgtttaatttgcatttctctcattgttagctaggttgagcattttaaaaatatattctctagatgtttgtatttcttattctgtaagtttgcctatttttccattgagctgtttgtcattttctcattggcttttatgtcttctggcttgtcttgaccatctttgtgattcctggggtttaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggtgcgcagcacagcccatccgcagagctgaagctgggctttatgtccatttcagcagtctcttccttagtggagactcagcccagcctatccaagcaccacttggttaaagtagtgagggctaaactctcttcactgttttcggtagagcaagtaaatattttaagagtaaaaatgtgacaattaaaatataaaactttaacttttccctaggaagaagaaagaccacaaattagaggtgcagaactggaatatgagtcactcaaggtaatggggagtttctgctcaagactttgaatattttgttttggcaagaggcccattcagagcctctctttttctcagagaacatccttaagggttggagattgcaccagaggtcctagcttcagccttattcagcattacttcttgtgttgtttctttttataaattccatttcatataagctagactttagtcttaacaggaacaggagaagtagctgctgttcgaggctgtggtagtaaaggacgtggactctagcatctgccactataaaaatccaattgggtatgatggggcagaccagacataggagtaggaatctgctctccagacttctcctgcttcacacaataatgaatgaataaaaacattctctgtagtgtgaatgaagcctggattcacaaagtattagattagtggctctcaaaatatggtccctggaccagcaggatcaatgtcacctggtagcttgttggaagtgcaaattttcaggcctcacactactagacttattgaatcagaatctctgagggtgcgccccagcaatctgtgtttgaacaagacctctgggtgattctgatacacagtaaatttgggaaacatttgtagtttacacatcaaagtaatgacatttatgtgtcttctgttacagaaatgagcaataagaatctgattaccagttggtgggagaatggggaagggagagagcattcatttttacaaaagaatagattaattcatgaaagaaagggttatatattcttaaactagaaaaaagaaggactttaaatagtttttttttcttttttcttttttctttttgaaatggagtctcgctctgtcacccagattggagtgcagtggtgtgatcttggctcactgcaagcaccgcctcccaggttcatgccattctcctgcctcagcctcccgagtagctgggactacaggtgcccgccaccacgcccggctgattttttgtatttttttagtagagacggggtttcaccatgttagccaggatggtctcgatctcctgacctcgtgatccaactgtctcggcctcccaaagtgctgggattacaggcgtgagccacagtgcccagcctaaatagttttaatataacacattgaaaggactgatatagtgctacaaacctaaggttttgtctctgggaagaaacaataaaatattcaatgtttatacacaagtgtttcagtatcatcaggccttgtgtcctgtgctaaatgaggcaccatggtgcttttaagtgcctgtctgcatctgtgtttcccaaccagtatcttgtgacacttgtgtgctagtgtcggtggcactctattctgggttcctgttgccattgtttgaacagagcatggagtgggcagcactaactggtggcaggggctggctggtaagacatgaactattggagggatgaggatgtgcatatccttctggatggctggaggaaggccttcagccttgcctcctgcctcccaaggctctgcccacaatgtcacaagtgcgtcacacagaaaagaagtttgaaaaatacactatttgttgtcatttagacacaaaagggagttttaccagtttgaatgagatggtaaactttttaaattagaagttaaaagcctaacatttcaatagtctttccattctgctttataaaggaagtaagaggagactactaaagacttcagggatccacccatctgaatcattcattggaaatatcctggccagctggaccctcagatttcccatatatttatctgcaaacaaaagctaggctccatagcactggctaaactcaccccttgggactcagcaatctctccatgccagtgaacacaccctgggcaggccagaatactacatttgactctggaatttgggctgatgaagcaaacttccattgaccttgctcaattctacttgatgtcagacttccttaatttgcaaagcagggctcctggcagaacctaggaagccattcactagggtaactctgatgaactttttcagcagaattcttctaccagcttgggagaagtttgagcatccaacgtaaagttgaggatgacagcaatgaacttttctttgtcttttcatacagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaaggtaagcgcaagcacacaattaaactgggtgttcggggactggcctcaatatcttcttatcccttccctccagtttataatgcagcaaacacttaagagcatttttaatctaattgaggattcattatttttttaaaaaaatcccagtgttgtttaaaactattgtaagtataaattggaatgagcaaaaagccaggggaatcccaaatgatcacaaagtttcatctctcatgagttttaaaattaatctttttgtagtaatctggccacaataaattttaatctaaaataaaattttattaaatacaaaaatctctaaattttcttactgcgggaaggcattaaatacaactttaaaatcatttgtcaaaaatagctggtttaattggagaagtaacagatgaaccggttagaagtgacatcagtgagtggaagttacatggagatgatttctgctcactttaggcagttctgtttagtagcggggtgatgtcccagtgggaggggctgtttaaggattcaacagagaggactcctgcactgaggatatagatggccctttgaagtccttccctgccttcatttgagacccagtgctgccgtatgctgaagagagatgggcctttctgtcatttgccaccagagggaatctgagtgatcaccttgaaaacctggcctgcctccctgcccttgtgcacacagcagagcatcacaggactcaaggcagtcaagcatcccaactgtgtggtgtgtcatataaaaaaatccatgatatataatgagctggatgcctgaaaatctgagagtactcctcttagaaatgatatttctgcatgcagtttagatactgtgcctggcacgtataatcggacttgatgaaggcaactcacacctgagatcaacactggtccaaaaaatatcaaattctaaaaacaagatgtttgactaatttgggggaataaaattcctgtaatagtggagttatatagagaaatgggctttcttactttaaaataaatcacaggccaggtgtggtggctcacgcctgtaatctcaacactttgggaggccgaggcgggcagatcacgaggtcaggagatcgagaccatcctggctaacacagtgaaaccccatctctactaaaaatacaaaaaatcaaccgggtgtggtggcaggcgcctgtagtcccagctacttgggaggctgaggcaggagaatggcgtgaacctgggaggcggagcttgcagtgagccgagatcgtgccactgcgctcccgcctgggcgatagagtgagactccgtctcaaactaatcataatcataatcataatcataatcataaaccccttaagccagaaatgagaagaacccccattttggcttgccgtataggttgcaccttaccccagggctgtcacagttggttcccttggctaccactgtggctgggcctcaagaaacaaggcttgcaatctagcttgagcagagtccaaaatcaagattcctttctctagttttcttgagacaaattagtattctttcttaaaaaaatgttaattgacaaataataattgtatatatttatggggttgcaatgtggtaatctcacaagaaattttagtaaaaatcaagagaaaggaaaagaaaaatgaagcaaaggacataaaaacagtccagctaacagagcacatagttctgctatcacacattctcccttgcccggctcacgtaccccatgtgacagctgctctcctgaccctaatgggctgacccggtccaactgaggtacctaagttcctcagctcccagcctaaacatggtagcactcgtgtcccatcctaggagaaatgcccttgacactaattaagatcttccagactccccagggctgtttgtctcactcagtttctagtctgagagacacatcatgtcaccactccattgcagggcagtggtgagcaacaccctgtgagctagggaatgatccagcccaggcaggtcttgtgtattggctccacctctagagtattctgggaatcttcccttggacaaacgacttctgtgagagacataactttaactccacagacctacgataagaatttcacccacaaataacaggagggtcattctctcacatactcaaagatattttataaccagaaaaatcaaaacaattttaaaagaatttcaagcatttgttcctggaaatagaagttgtcaacatataaatatatattagtctctgttttatgacagttccaggaatgttaatgtatatatagagttaattttagagaaacaactcatggctgtttttaaattagcttttatctgttataataggaactcattgatgaaatttatttatggaactaagggtttattgttttctctgttttttgtgcttgctgacttgtgattctcaggatgacaaggtaattatacctttttttttttttagtaaatacttctatttaatcctaactttagtttacaagtatcccccaataaaggcaattgatgctttctgaccaagtctattttgatattttgaatttgtaagtgaatttccgatttgactccttctgatttgggaagtcagtagggaaacagtggttatagtaggctccagtctagattatagaggggactccatgacttctaattcataggcagctctatgactcactgccgtagttctggtaggctgtccacaggctggggagggaagcccttaacttggagtacactcaaaagcacaggctctcctgagctctcatatctaccagtggcgggcttgttggttaagggtgaaggggagcctgaggagctgagcacactgttctttgctgccattttcatctccctgagtgtagagtccacagctagaatgaaatgtggctcgttgacgaggttgcaaagtcaaatttctctaccatatcttgtttctctatgtactgagtgacagatattgctggaattttcctatatagcacaacccttttagaacttctggtcacaggcttaagagagacaaagtttgagcagtgaatcaggaacttcctgaatgctggtggcccaaatctgatcccattccccaagtgccactttttagctaaggtagtcagaatgagggaagaactggtgacttaccacccaggagagaagcatactaagaagcctttcttctcttggattagttaatttgatcaagttacctcatttgctaaaagttcacaaccataccatgtaagtcctgagataccagagcacacagatagcattatttgatgtaaacacttgggtctttgaaagttattacttatgggttttaaaaatctgagtatggccctttataaaacagaaagattttattcctttcagagaaagagaaaaaagaacctctttgtaaaacaggtactaaaatatttacaaaacatagctaaaaaaaatactctgtggttttaatgggaaagatttttaaaattcaataaaatgtaaactatttattagtatatttcatgagattatagttggtcttctcagaggaagcatttataaacttacaaaaggatagcattaagagaaaagtggtattttttttaaggatttttaaaatacacattgaaattcagaaacaagcatttgtaagtctctgattggcattaaagttatcttggaacttgtctttaagatcatggtatttgaagtgtattttattaagtctgtttcattgcaaggcctgagcttagatcatgtttactaaagaatcagacatatactatttagacaaatatgtggtccaaaagcttttgagttgaattttatgtggaaatgtttccatttagacaaagccactgggttctgaagtatattgttttttagaggctacacagcagggtttctttttttgctttaagttttgggatacatgtactgaatatacaggtttgttacatagttccatgtgtggaactatgttccattgtggtttgccagcagtgattcttatctcttactcttgtctagaaagatagagtagctgaataggagaagattttgaaattacattgcttgtcagacagatttgactaaacggagaaaattaaaaagaaaattaaaatgttggaaaaaagttattcttatataaaataattaataattctgacctgccagatgtttatttcaaaagcttaagtactatgttatgttatactagaggaaaagagaactgaatgtgagaaaaaaaacttaattttgctgaagcatataatctgaatactaccttctttttctgagtttttaatgaaaaagtgaactttatgtcagactttcagtgttttggggcatctgctcattgtaactagtcatgaagtagtagaaagaatggctttgtacattccattaaataggtgcctggttatttttctaatgctgtatatactatattatatactttataaaatatatatatatattttttcacataatgtaaaacacatatatggcccatcagtgattttatttacagggccgtgacattgtagaatcttcccacctttgtagcagagtgctagtgtttctcaggagaaaaactgaaggtacctcttctcaactacctgggccaaactcccctctgcagttacatgaggttggggctgatgctttggtgggtcacaggtatggtggagcacataaccactgccccccagttataccaaataaatgtgttttatgtccaaagcttttgagttgaatcttaatgcgtaaatgtgttatttccctctcagaatacaatgacagattccacaatacttttggaagatgtacaaaaaatgaaagataaaggtgaaatagcacaagcatacattggtttgaaagaaacaaataggtaagttgatccttcttttattcattttggtttaattatattgatctttagccttcaagccagcctcttgtacagtaaaagtgttcatacattcctttatattagacattaactggccttcaaagggaatccaaggtttccagtgtatttctagttaagatcttcattataatataaggtaatagtattgacaaaaggtgtcagggaaaatgtgctttaaatcaaagcaagattttaaaaatatttaatgtcttagctttaaggggctgccttgagaagaaaactacctgctcaggtcatacaatcttaggtagtcactttcatttgttattcaggatggttatttgtgaaggtttgtaggggcaactgcagttttcaatatttgaaacttaagagtgaaaagaagtgatgaggtatctggaatcactcagtgttggccatgtaactctaaaagggcaccatgacttctaggatagaagaatgaaggctcatatctggaattccccttggccttactaccaccctccttcccagcaaagtctattggtctggggctcttgatggatagtttcaggattggtaaacatacatactttataaactgaagaatattgccatacaaaaagaaaggtgcagtcagccctcaatatccattggatccctatctgtggagtcaaccaatggaggatggaaaatattttttaaattacatttgtactgaacatgtacagacttttttcttatttcttttctttatctttcttttttttttttttgaaatggagtttccctctttcgcctaggctggagtgaagtggagcaatctcagctcactgcaacctccgccccccaggttcaagcgattctcctgcctcagcctctcgagtagctgggattataggtgcccaccaccacacccgactaatttttgtattttttttagtagagatggggtttcaccatgttggccagggtcgtcccgagctccaggcctcaggtgatccacccgcttcggcctcccaacgtgctaggattacaggcatgagccactgcgcccggccctatcattatttcttaaacaatacagtgtaacagttatttacagagtattataagtagtctagagattacatattacaagtttttaggtattataagtaatctagagatgatttaaagtgtacggaggatgtacatggttatatgcaaatagtatgcaaattttatataagggattcgaacgtctgtggatcttgctatccaagggaggacctggaacccaatggatattgaaggatgactgtgcttcttatcttcttttatggacaagggtggagaatgcttataaaagtatttggttatacttaaattttaatttatcagtttaaattataaacatatgttatatctaagaatgtgttaatatagaaagaactgtattgtatcacaatgttcttccatccacttagctattctatcaccagtgtgcctacttcatgccaggccttgtgccacatactgggaatacagtaataagcaagataaatgcggttcctactctcactgagattataggctgctggggagacagctgagagggtttggactttattccaaagataatggaatcctctgaaaggtgttaagtaggagaatggtgtgatgagatttgatttttggaaagctagccctggctgttatgttagagaatagactgcagtagaacaaaattggaagcataaaggccagagagtattcctgtaacccagtgattatggtgacttgggcttggctggtggcagttaggattgacagaaatgggacgttttgaaagatacataagaagacgaagtcagaaagctgtttggtttattgaatgtgtgggcgagggatggagaagcctgaaggtgactccgtggtttctgctatcttggttaggtgtggtgataccgttttgtgatcgtgggactggagtgtggggaaatgcacagtgaagatgatcagtagatttatacatatggatttaaggagccaggaaaacatccagagaaagaaatctattaggcagttgagtatataaatctgtagacaggagagatgtgtgtactgagatagaaattttgaagtcatcagagtataataatacaatggaaaccgtgtaaataggtgaattctctagagagatatgaactctctagatgtaaagtagaagacaatgcctggaatttgggttatgtaaacataacaacaatatagcaggagtaagaacctggactccagagtcagtgctgggatccactacttaccagctgtgtaacctctatgggtatcttacttccaagcctctgcgtcttcctctgcaatgtggcaaatgacttgttgggttactggggaaactgaattagtacatgtggaaagaatgtagaacagcatctgacactgagcaaacactcaaaaaatattatttttatattctaagtggaaaataaatgattactaacattatcattactaattatacgtttttaataagatgtgatacatctctaatatagcagtttttccaggcatacaattaatttttgacacaaaaaagcttttaaaaatcatgtcataaaagctgagaaccttggacatgttctgatttatgttactgctataagaatttttaaaactggttttttaatgtgggaaattaggttttattaagctaaaaacgttcctacctagaggacttaaaaattcatcttgaaaaatattatgaagtttgccacacaaagacagtagctgaagtttttgttctatatgtgtcataacctctaatacaatatgtgatgtattagatcactttgctagctgaataaaacatcaaaaacagaacctctttctcaccttccagtcatttcttattttgcaggtaaagtagctctacatccttgattattttgctttaatttctatccatttacatgtgatgctacatgttactcatttttaaaaattaaccaaaaataatttttgtggtaatgtcttaaagttgtcataatgaataaaaacaaacttataaaatgttgaaatactgcatgctgctgttgaccatcgtcacctcatcagcatcctgtatccttttgtgttttgcattgttgttccttttgcatggaagatcatctgctctggattaccatgagttgaatgaggatggagagctgtggctggtttatgaagggttaaaacaagccaacaggttatatttgtctcctcaaaatggaatgttattaatttgttgtttttcttactaacagtgacctcctgactttcacccctgtatttcttgtgcattgattgtcttcttgggtaaattagtgttagtaattgtgttatttgttcaaagcttttcagtaaaactgagaacattcagccaaacaccttttttttttttcttttttagacggagtctcactctgttgcctaggctggagtgcagtggtgcgatctcagctcactgcaacctctgcctcctgggttcaagcaattgtcctgcctcagcctcctgagtagctgggattacaggcgtgcaccaacatgcctgactaattttctgtatttttagtagagacggggtttcaccatgttggccaggctggtctcgaactcctgacctcaggtgatgcgcccacctgagcctctcaaagtattgggattacaggcgtcagccaccacacccggtccaaacaccttctttaaaaaccttcactacaagatactattaaagctaaaattgaatggtggtgaatataagacacttcccttcagacactaaaatttgtgaatctctctctcccaggagttaaaagaaaaacataatctttcaattagggcacaaactattgggggagagattaagatttattactgagacagtggcttctcatatcctatagatagatctacaggatatatgtgtctatggcaatgtggctacatttttcttttcttttttttgacacagggtcttgctctgtcacccaggcttgagtgcagtagcatgatcacggcttaattcagccttgacctcctgggctcaaacgatcctcctgcctcagcctcctgagtaactgggactgtcacaagcatgtgccaccacactcagctaatttttttattttttgtagagacagggtttcacttggttgcccaggctggtgtcaaactcctgggctcaaacaatcctgcctcggcctcccaaagtgttgggattacagatttgaggtactgcgcccagcctaccttcttatatattattatcatgctgtctaaaagcaagatgaaatgcatgatttggcactctgtgtggttattatgaaattcacatttgtgaaacagcaaatcaggagagttttctgcattgctatagctcagaataattacccaaattcaacccgttaaatatgttcagaggagagaaaataaaattgaaacagcagcacctttctaacacagacattcatctgctctagtgatatttgtctttaaaatctcattaaaattctattttagtgattaaatttttaaaacactcaaatgtttgttcaaggggcttctgcttattctgctttgtttgttctcatcattaacgcttgtcattaactttggggtgttattgctgcagatctttttgaaatgttttaatcactaaaatatttttagtccactgttaacagtttgcttgcaatggcatcattaagttttacccagcagttggcaaccaagggactggaataaaagaatgtcttttctttcttcacattagttagttcttaaccataactttgcatttggaagagagtgactgtagaagcaggggtgcgtggcaaagggaggatgctctgactctggtgttctcactgccaatgcctggtctgctctgtgggcacagctggctgtatgtttgcttggaaaagcaataaccacttttttggtcctattaatatttgtgttctaaaaccacatcttgttaggattctgtttctgatatgtaagtttatgcggagagagaagatgacagatctaaaatatatataggaaatttcagaactatttgtgtggattcgggtaaatctgtatatataaggctggagtggtgttccagcctttctgtctttcagaataggagtagaatataattccctctgcctggaattagtaactgtagttctgaaggcacatttagttaatttggaagtttataatgttggcctttatagtgcagagttgttttgtggcaaaggtgtactgtctttgccaatttaaatgctaatttataaatgcaaatgcaaggcaaattaaagctgtttttttcaattgatttttttttttacatcctcatttcctatgaccctctttttttttttttgagacgaagttttgctcttgtttgttgcccaggctggagtgcaatggtgcaatctcagctcactgcaacctttgcctcctgggttcaaccagttctcctgcctcagcctcctgagtagctgggacaaaaggcatgccccaacacgcctgactaattttttgtatttttagtagagatggggtttcgctatgttggccaggctggtcttaaactcctcatctcaggtgatccgcctgcctcagcctcccaaagtgctgagattacaggcgtgagccaccacacccggcctcctatgaacctttcaagagaactaaaactctcctgtttcttagggcctctgagaactttatataatgcagaaagacacaaatgtgagagcacccgtttctatttctgcttcttgttttagtttcttgactttaatcaagtcagaagataacacagatactaaagaatatctgcttttcctactcttgcaagtgaacacgatgccttacacccgttaggcagcaactcggggtgtcgtctccccttccgacccatgtgtcctctccgcaggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttggtaaggagagctgccgggtccacatgcttcttaacctagcctgcccgacagtctagtttctttttgatcaaacacgggtttttcttgctgggaaaaactcacccctctgtacttgttacccctcttactccagcagagacagagtaaggaaaatacaaatattttggtaggaaggaagaaggcacaggttctctttatcacggagggctgcgtgctcttagacctgccctggaggcagacaaccacctgggtgcaggctgggcttttgatggcaggtgatctgcttcctccatttcagctgcagatcctctgccatcctaggtttattatgtgattgtcacaactgagactggggacaggcttcctttacctttggtccccaagcagccactgaggccatcccaggctccacctctagcagacaagtagggttagagttgaggttgagaaaggcggttggcaaaactaagccggggtttttggttgatgttggatggagctcccaggtcagggaggtgtgtgttaggattcaggtttacatattttctgttcttttaaacagaacttgtataacaagtgaggaaattgtctttttccttgtcagattctaaaccctggcatggagtctgactgttttcttttcttttttttgccttgttcctttttttttttcttttgccaaaaaaattttctaaaatatttctcagtcacataataacttttattactgatttacagttttttgacaaatatatttactatattaaaaatccttaaaaagtgataatttcatatttctatataaagtctatattgtagtgctagcccgattttgagaaaaattgtttaggattggtggtgatttgtgtcttttttaaattaacatttttaatgacctataataaaatagtatgaattttctctgaagatttaacaatctgaattatccctccattactccatttgtgataatttacattacaaacagttttctagtgtcatttattcaaccatcttttatatgaattagaagcaaaacgcaaaggtattctttttcacagtctgtctgtatgaggctccaccatgggaatgagggaggagggtgggggcagtgtgtgggctctttccaaagtgattgacatctcactaatttgtggggaaaattttctgaatcatgaaatattttttgaagtgttattttacaaagctcaagtatactgttgcttaaattaaactaacaatgctttgatgactaagtattaccaaatatactgaataatataataagttgattgattggcatacaagttctgtgctttaaattattgttttaaaatacaaggtgaaatcgtgaaataaagatgcttctgggtggcagatttccagggttttttcactaagttggtcagacatttctcttgcaaccttgtttgcaatattaatttttttggcaatttttcatagctaatacaaaaaatagactaagcccctatattctaagctaatagagcccagttaatgaatttgagtttggggaaaaccttttgtaggtcagctgcttctcctgccatcacactgactactaattcaggaggatggattcaaacataagtacaggaaatgatagactttttcaaaatcattgttttctcaatcttaattgtgcatttctataagaaacacttgagtaggatattaaagcccagcaggagacctgggcttagtgctcttgaaactctaccttgcccacctacctaccaccaacacaaaacacaaaaatgatttttctacctcatctagtgaacaggcttcacaggcctcccccgtgctgtctttcagcgaaggaagatgcacagcttcccaccagcctctccagcttcacaagctaacattgctattattctcacttttattatatttacctcccctattcttgccactgctgctggcggcaaaaaaaaaaaaaaaaaaagtgcagcaagttgtgagcatcatgtgttggggaggctgggagtaaaaaggcaggaggttggaggagggaaatgacagccttatctgggcctgctaagtgatggcatcctggccacagcctctttcctttgttcacacaagaaacatctgtacatatgtaattagaataatctatactagaaagataaaagggtaatggaaggtgacaaatcagagcctttcaagtatatatagtttcactatttgtattttaaaatattttaaaattgattttgctgaaagatagcatttccctcaaacacacagacaaaaacaaatatccattgtgcctgttttttcagtattttgaggaattatatgcagatgaccctaagaagtatcaatcatatcggatttccctttacaaacggatgattgtatgtaaaaccatagtgcttttctgctgtcttcccttgctacttatagccctctgtaactgaagagcacactgctgcctgccccctcccaggaagtctcttcaaaattttcacgaaacctgtttctccccacagctgtcttttagccagtggtgtcacctctgtcagtgtcctgagtccattgtcacgtttggtttgttattaacactaggcttacagtgtgatggaagcaaaatgtgatttgaaaggtcacgtaaaatccaagaagtacaacttaacactttgaagagatagcaactgttccctttaatggttggcctagtagctaaatctactcctgtctaaactggaaaatgaatatttgtatttggaatgcctttcttctccataacctgaataacagaccacacacattgctgactcatagcccttctaagctgttactgagcctactgttgtccactttctttttgattgagtttttaaccatgtctgtcatttgagcaaattctttattaaatagccaataatcatggacttttttttaccttcctccttaagtgtactgcttttgtttctgtttttgcataaagcattcataaatacccctttcttctgtataagcaaaattatatcacctgcaagattttatagatgccttatgccacttgccactttggtcctaggtaagcagaccactctttatcctgttctttgtgattatttttttcaacttatcttttaattcccaaaacttctgaactattcttaagtttcagggctaattttagaatttcatagggtggctctcatagagacagtgcttcacacatggggagtgtcagttcctacctaagttcaaccattctttccacaaacctttttgtgcattcatcaaaatttatttttgcctagtcagtcctcctttaaaagaaagcattctactggaataccaatacattctacaaagcattcagttgattttcccacatggagtctactggaaagactctgcagtgagcctgctgtccatcacgctgtaaaggagtttactgcgttgtatattttaacatatggcttttattgtagctgcatttcccatgcctgccaattttagccaggtggtggctccaccaatgagctcttatgtaaaactaacgtgttgtttctgtgatattgtgtctattttcctttgatgcattttagaaggcctgtttcgatttttctaatatatttctctttttgatctttaggatttgatggaacaacttgaaaaacaggataagacggtccgtaaactgaaaaaacaactgaaagtatttgccaaaaaaattggcgaactagaaggtatttaaacctttttttcaagacggtcactgagtcttggtttgagtcttggcttaaagactaggctatataagtggcctaatagaggtttgcatgcaaatattagggataataacaaaatatgacttttggcaaacctaacctcttttgagtagaaatttacatttttaaatgaggaaaaatgttcttttcatgggtagtaataatttacagattttactctgtaagcatctaatgaatatcttctatatgccagacaatgtgctaggcagtatagcataggagttaagaatgtggattctggagtcaagcttcttgggttcaaatcttagctcttctacttattaatcatatgatattgggcaagtttctgaacctctgtatgcctgtgctttcccatctgttaaattagaaagataatagcatctatctgacatggtttataaggattgaatgagctattaggttggtccaaaggcaattacttttaatggcaggaactgcaaatgcctttgcatcaacctaataagtatattacacttagaaaagttactgacgcatagtaaaaatgcttcatgcgacttagttattagtcactatcattattcttagtattagggatactaagatgagtatgatagagtctgtcctcaaagaacttacagtctaatggaggaaaaatagagaagtaaaaaagaaaaatatgaattatgatgataaagaaataagatttttaaaaacatctcatgatttctatatgatgatgatgaaaaaattccttgagaaataaccaaatatcagttgttgttattatttatatacaaatggatcttatcttttctattagtgtgtttatgtgtttatttgttaagagttataggtacagggatctagcagtgaacaaggctaaagccaaactcctttttttttttttttttttttttttggagacagagtcttgctctgtcgctgaggctggagtgcagtggtgcaatctcggctcactgcaacctctgcttcccgggttcaagcaattctcctgcctcagcctcctgagtagctgggattacaggtgcatgccaccatgtccagctaatttttgtatttttagtagagacggggtttcaccatgttggccaggctgatctcgaactcctgagctcgtgatccatctgcctcagcctcccaaagtgctgggtataggcgtgagccaccgcttccagcctaaagccaaattttaagcttatttcaatgttctcactgcttaagggattttgagacagtctttggaatagccttcaaacctgtgtgaacggttaatcattttctctcattgtcattctgcatctaattcttgcttggttcaaacagtgaagattccccatcactgaggatgttcaaaagaatctatcatgattaactccaagtgtggttttcattcctccaacatgccaggtcttgtcataactgctccttctgtttggtcatcctgcttctcctggttaagtcctgctcagcctttgagaccagagtcatatgtcacatcctcaagagtagcctttcctgattacccagacagacgttatggttctgctctctgtgtaccacaatttggccgacatcttttatggtcttcactatgtcatatttttagcaatttttctgtttgaattactggcttccataatagactctgagcttcctgagcatagaaaacatctctgtttccctttgctttcacagcacctagcatagtgtctgacctatctcataatcattccataaatgtttgttgagtgaatgagtaagtttcagaaatatttataacatggcaacatggacatttactttgtaaaggatattactctgttggatgtacaaatactgaaatatttgtttagaaatcagaaagattattttatagtcacactttatatataatcctttagcattacatgagtcatatattacattaaaatttgagcctccacatcacacactcacacacacatgagctataatgtctattagcagaacttaaaaatctttattcagagaactttttgcactttgcaccaattatatcatgagatgataatcagacagcagagtatttgtttgaaaaaaacagattttaagtgtattaacatgtgagattctttttttgttcaactcctaatgattcctttgccatactttagtaaattttgataaacagaaaagccattcattattttacataatttttattagttttctttgatatgtatattttttagttgaagagatgggttagactattttaagatattactaatcttaagccattgtcaatcagaaatcaacctcatcatttaaactatccagacagctgtaaagccataagtagcatttgagaatagcaattcatagatcaaacaaaaaaggcattataatagttcttaagaagagttacattttgagttaagtgatacatatctagaggatgaaatgaaatagatttatgtgacttgggcacttgctgagtgcagtgtacctgcttctaccccaaataaagagaatcaaggtgacacttttcatcctcgtatctgcctgttacacagaaaatacaggcaccttctaataactaaacgttgtcttatacttttctttaaatgtattgcaacacacttaaatccttttggtttaaaatagcacaactcttgcctcctcctacaagctacatttaattaaggaggctttttaaaaagccaacagacttttaaaaaaaatgctagcatatataatttttggcagaaactatatagctaaatggagagtgtttcaaaatttgatctgctttgtgctatattttcacccatcttaattttcatggaatcaagaaattaagacctgaaaggattctagaaatcaattagttatttcataagaggaaaaaactaaggcctgtaagtgacccatggttgcagcaggtgagatggcaggactagaacacataccttctaagggccactgatttctctcctttgtgtcaaattttcccacagaaatcttctacttattaggaattcatctgattgtctcaaacttgagatcaagatcttcctggtgccaaaagtaaatttttttaaaactttccaattttctttcctttttgaagacagaaaggttccctcaagtttataaagaatctagaaaatgaaactagagtcttttttcaggtcttcctagaagaatggatcattgggctcctcagtccctttgtgctgctataacaaagtacttgagactgggtgatttataaagaacagaaatttatttctcacagttctgaagggtcaagacactggcaagttcagagggtctggtttctgcttccgagatggcaggtgccttgttgctggatcctctgaaggggacgaactctgtgttcttacatggcagaaggtggaagggcaaaaggcttagctagttgcctctttatttatttatttattgagatggagtttggctttcatcactcaggctgcagtgcagtggcgtgatctcggctcactgcaacctctgcctcccaggttcaagcgattctcctgcctcagcctcccaagtagctgggattacaggcatgtaccaccatgcccggctaattttttgtatttttagtagagatggggtttctccatgttggtcagggtggtcttgaactcctgaactcaggtgatctgcctgccttggcctcccaaagtgctctgattataggtgtgagtcactgtgcccggccaacattttattttaattagtagataatattgcaaaatcaatcaaggttatgttgaactgacatctaaatttcatttgtgagctttgcaaagacttaagtccctagggagaattcagaggcagagagaaagtttttagtgagagtatggcacattctatctgacatttttatacagtaccaaaaatatcctggttagagattttgcaaaaggaaggtgaagcttccttttaaaacataaactttcttagtaaaaatatccattgtatttcacaaattctgagatgcagtgtttcccatttcaacatctctgaaattggggtgtatcttacaattgttgatgggttatagtttagttggcaatttttttagtgttacataaaatactgtatttcataaccgatagcatcatagatttgataaatcagtgggtttaaaatatgctctttgggttacatggagtccaaatatgtgcatttattgataaacctagtatgttgaacttgttttctcccagtttccccttttggaattgtacatgcggcttaaaagttactagtggcatagatggcaggggttttataattttgttttttacatgcagctgcaggtttatgatctgtagaggccactgtgtgctgcttcagaggtccttgtggtgttgtgtttaaactgacaccagaaattatgtaaaaccaaacagtttgagtctccttttctcttgcatggaagaatatactttagagttagtcccgtggctttcatactggatcatgcatatgaaaaactagattatgggagatggccgtagccctgatctgtccaatcacaatctgaccactctttagatatcatagtgttgctggatggtggtgacttcacctaaaccagattttcagcgctgatagtcccagtgtgtgctgctgcagcatgaggtggacggtgtgtcaccaggctccatgccacataagcaagagcactggcaggtactgatgttctctgtgataacctcttcctgtgggactggcttctcagaactaacccaggaaattacccagagtgacacaagaagcactactgacacctcgtggagtcagcaatattaagctttctaatgtttttgcatctgatctgcattttgtttgacagcaatctcagaactcaaacttaatctgcccttaaacaaatctcttaaccactctccctccctgtagataaaaggataaaaaacctggttactagcgtgtatctccacagtggctgtggtaactcatatgtccctttactttttgttggatttcccactcaagtctcaattttgagatgaaattggagacttttttttttaacctttagcataattctctagctgctgcccttgacaatagtgactatttttaacatctgaaagcattgtaaaccagtggttgtacttcattgattgcaactttataagtagaatttttaacattatattaaaaagaaataaaaaataataacatttaggaaatcatactacatagagatagtttatctgttcatgatttctctgggaatgaggatggcaggagaaaattaggtctttgccatatgaggcctttgtgaaaaataatacattttggaccaagtggtatgaagaaacactcttctaccagctatctgtatgtgttttgaattgattgtaatgatacatttaaagtaaatgttcttttgcttttaatggctaaagtcattgagccaagagcaagggggaattgtttctgctccttctgcccctttgtaggatattgattgttcctcctgtgaattaaagtcaaaatatgtttaaccatttctgattagtatcaattaattaacaaatctgttaaaccacttactttttggacatttaatcttattaaaaagtaagccttattacataaaaaaaagttttgagtcatgtaaggttatttgatgttaatttacagttaggcaggagtggctttcagagtaagatgaccatataattttgccatctgttcacccaattttaacagaaaaaaattattttaagagaaggcaattaagtggcaaatatggcaagtttcggttgttgtagaatgcattcaaaattataggaacttggagacctctcatgttttttatatggaaaacattttctcctcctttcttacttctcataaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctgggcaagtattttctgcattggataaaagttccttctggcacatgggttaatggtgggaaaaactagtcactaatttttgagatattcagcgtaggtttcattagtcatcatcagataccatgtattctagtgctgcagtagtgttctgaccacaccaagcactttcagtccaactgcagggacacatgcctcagacccacctacaaggattgctcaagatcaggtcttctcagccctggctgcacattagaatcacctggaagctttgaaccatactgatgtatctctctccctcttgcccagttaaatcaaaatctctagagagaagagcctggcaatgtctagtactttaaaaaaaaaaaaaagaaaaagaaaaaaccctcaaggccagcctcgggaaaatagcaagaccgcatctctccaaaaaaaaaaaaaaaaaaaaaaaaaattacccaggcgaggtggtacatgcctgtagtcctagctgctcaaaaggctgagatgggaggatcatgtaagcccaggagttcaagactacagtgagctgtgattataccactgcactccaccctgggctacacagcaagagtctttctcaaaaataataaaaagcttcttaagggattctcaagtgtaaccacagttgagcacaactgctctaggccgtttaggttcctgaatttcagtttttccttactcccctagaaaggtttgcaactaaataggtcaaggacggcagtgtaataatagggaagaaacaaaaaaaggaaaagattctaacaaaggaaggaatggacagaataaatgagatgagagtggaagaagcatttcagggcagcacactgcctttaagattgggtctgagcctgctggctttgcaagaaaactttttagagggtggtggtaaatgattagagtgtacacaccgtaagttgtgaagtgaaaatcctaaaaacctctcctttcagcctttgcacagcattcctcccgccaggtgccagggtgacagcagtgtgattggcacttatacctgatggaatgttcctggcattaaacttagtactatatatagttgcacaggtgcttaagtttcaacatgaatttcatttagcaaaaatgttaaggagccactggtttttaagcatagaattaacagatttatcaattcagcaaagaattaacagatttatcaattcagcaaatgtttaatgaactcttatcatgtgccaagcattttctaggtaatgagcaaagtgaagtacccagtcttacagagtttacattccaggggagaaataaagaaaataaaataaacaaatatatgatggagtaaaaagaataaagagtgaaggcaggtatactggtttgtgtaaaattgtcaggaaacactctttggtaaggtgatctttggacagacaccaaaggaagtaagctaacaagtcatgctaatatctgaggaaagaacattcaaggcagaaaaacagtaagcacgtaggcccagggcagggagcatacctggcatgtttaaccaacagcaaggagacccatttggagcagagtgagctggagtggggaaggggaatagggccagatcctatgctatggtgaggattttggcttttataaatgcttgacatgagaagctgcttggaggattctcagaacgagagtgacatgatctgaccaacattttccgaaagaatggccctgattgttgtatggaaaatgcagtactggggagcaagagatgaattagggaggccagttagggagctattgcagcagcccagcaggagatgatggtggcctccatgggacatctgtagctggtagaagcagtgagaagtagctggattttggatgtattttgtagatagagccaacagggtttgttgatggattggatatgtggtatgagaaaagaaaggagtcaaaaatgaggatgaggtttgtaatctaggatactggaagactagagctgctatttatttactaagatggggacaacttccaaaaaagtaggttccttagagaagcaagaatttggtttgggagaggcttagtttcatgtgcctgagcagagttgtcaagaaggtagttgatagtgagactggaattcaagggaaaagtcagcgcaggagatatcagtttgggagttgtcattatatggacatgctccacattccagaatttttctacttaaagagctattaaaatacactttttatattacctacttaccttgaatgattgaactcttacatgacaactgtgtttttatatctcacaatgcatgcctcgtgaaaattttccatgttatataaaattattattttttcttttttagaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaaggtcagttcctgttcaacaaaattctcatcatgaattgttaatgatgacagaatctgcactgattgatcttccttccttagagtttagctaagttgcttgttattaaaactttccaatttttatttacttacctatctattttgagacagggttttgctgtgtcacctaggctgaagtacagtagtgcaatctcagctgactgcagccccagtgcaatcccaggctcaagcaatcctctcagctcagcctcccaagtatctgagcccacagttgcacaccaccatgcccagctaattttttatgttttgtagagacagggtctcactatgttgcccaggctggtctccagttcctaggctcaagtgatcctcccccttcaacttcccaaaatactgagattacaggtgtgagccactgcacccagccactcagtcttgagtgaaaacttccactggaagaaacattcttccttgaacatgtctatctggcttctttcaaaacagggctcaagttgaacagtaatcaaaattaacttgacataactgcattttaattgtgcagtaaactaactttattcatggacagatatagtttgaggttttacttagaactaaacaatatttagtagagttcatatatacagggaacgtgatgctgaaattaaaatagatgttaaataagtttaagatatggctcattcatataaaaagatgtctgataaaacattacaatttttcttccaactttttctccacctcaccccataattttccctgttacctaaaatgcctggttccatgtgggaagcaacacacagatgctaatcagagaggaaagacttggaaaagacagccaagttatataactgagcagaaagcctacacaactcagtagtcactgagtcatcttgcataatccccctcttgactccagagaaacagtgagcacaggcttagttttaactcagtgttgctgtgaggagctaagatcatatgttccaggtactttgctttcggattatcaaacttaacgagagcttttagggtaaagataagtggatagtcaacatgccagtggactctttcaaatctaagacttcttttatgaacttaaaaaaaaattaggtaaaacatacataacataaaatttgccatattcaccatttttaagtgtacagttacgtggcattaagtgtgttcacattgttgcacagccatcaccatcatccatctccagagctttttcattctccccaactgaaacacagtacccattaaacactaactccccattcctccctccctcagccctggggagcgaacttttgataaatgctggttctctgttggtccctattgtgcaggtactttctgtagttaacattctacagtggttactaaagcatggagtttctaaagatttaacatttaaaaattgatgaatgtcttcccaacataattcattttatttttagtgtgttgatgcaatattgtacttagataaactataagttttgctacttcttaggccaactcctagagagagaaaaaactaaatcataaagttttctttctctcataataattgcaagaagatacttatctggtttgactattgtaccaaattctgtaaagattaaaaatgatgggcactagaacacaacactctttaataccatttaaaattaatgtgcatttgtctcacatcccagttttgaatcgtatgtttgtgttgcatacctgtttcaactttggcaactggttttttgccatcggccctaagcagcataactagccaaagatatgcagagaatccatacagtttttagcttatgatcatttctaataaatcaaaaactgcaaatagctttgagttcaacttgttttctctatgggatagagtaggaactaacatggatttattaattttgatcaaatacagcttgtttattgcaaaaaatactacttcggcaaactcaatctagtaacctcttaggtaaagagttggcattctattttaatttttttttaatttccaaagaagcaaatgttcttttattttgaagtaatatagagtatctcattttcatgtggacagaggatacccttagtgttcaaattgtatttgttgagttattttgtttaaaagtgggctgggtgctgtggctcacacctgtaatcccagcactttgggaggcagaggtgggaggattgcttgagcccaggagtttgagaccaaccctgacaacattgcgagaccctgtctctataaaacataaaaaaattagccaagcatggtggcatgttcctttagtcccagctacttgggaaggtgaggtaggaggatcgctcgagcctgtgaggtcaaagctgcagtgagccatgatcacgccactgcactccagcctgggcaagagtctctgtctcaaaaaaaaaaaaaaaaagtggggggcttagcaaagcctagagcccactaatgaaaacagatgctggattatttctagaatgaagtcttctccttaggttttaatcacctttatctggtaactcttcagtataggtgccgttacatccagctgggactattctgaggatctctgcagtttgacttgtgtagacgtcagtgaagacagtctagattggtgctttagtgacactctcccatagcccgacagtgaccagcacagtttcccaatctgcattcattgtctttgtcagcttagcccagagcatccactaggaacagttgtaatccagatttttggaagaggcagagttatttttagtcaaatctacacttaagctataggatgattttctgtgtttgggaaagtaataaaattgtatttactggcagtaaataatttatttaatttattttattcacaatcctcctacattggaagactatatacctaggtctttcagatatttacttagtggtaaagtcaggacctgaactcagtaattctgtctcagctgaaaagacttagttaggtttgatatcctctaggattttttttcttaaagtctttttaggggaatattctacaaaatttaagggcgttttgtactttcttaaaaaggtgattttatttacttaaaaaaaaatgatataatgagaaacccatctttccccatgatatatcctgtgcacttttactgcataaagccgctactaagaaaccaaaggcagatattctcatacagcttctaagaacctggattttgttgtgatatagtagtagagttattggaataaatgatttcatgcaaaaaaaaattagcttctaagaccatttgatgctaggcatctgtcctaggtaaactattctggttttcctttgcaaggttttctgagaaaaagtgcaggcaaacattgatatttttgtgacttcccatatacaaactgggattagttcatccaaatggtttagtttacaaatgcatagtccttccaagtatgtctgccatgaagcccctgggaagtattcccagccctcacatctttttcaggcacaatgagtctctcttcttcctgccacggtggcccagtcctggtgaagagccaaccagctttcccctgactgtactgcccagctcaggacttccttcttctcatttctggattcacagctcagaaattttatcttacccttaacaagatttttaatctagtctgggtttaagtgcttcaaattctttttcatattctttatcacaatatttgttattcctctttctgcttttagttctgattcccatcattaaccccacgggggacatgaatttgggctagctgtagctgggtgatttttttttttttttttttttttttttttttttttttgagacagagtctcgttctgtctctaggctggagtgcagtggtgcaatcctggctcactacaatctccgcctcctggatttaagtgattctcctacctcagcatcccaagttgctgggattacaggcatatgccaccacacccagctaatttttgtatttttagtagagacggggtttcgccatgttggccaggctggtctccaactcctgaccccaggcaatccatctgcctcggcctcccaaagtgctgggattacaggtgtgagccaccgcgcccagccgggtgaatttttttctgcttaaaggagcagctaaattcgcatcagtttaattttctatgccaaaaaagtgaatggcaagcaaagcaacaaactgatgaacctggtcgctgacattctgctagcaatgacataagacttcacaactgtaatgtgatttatttttataattgtttataatggtaactgaaagaaatgggtcttttggtatctgttcaattttttttaggttgttatttccctaaggaaaaggcaagtttagacttattctctctttcagaaaagaggtgatgattttgaaaccgtctccttctggctctctaacacatgccgatttttgcactgcttgaaacagtacagtggagaagaggtgagaaaaccttgattacaaaaccagcatgctatactttctctgacctttttaaggaaaaaatgtaaaagcacaaaatgtttaaccatttatttaggaacccaaattcagaggtggcttggaagttcttgctttgtttgatgttcactatctatgaagcagtgatttggagaatgacagtttcttctttacattgtgagaaagcatagagaaaaataaaataagcattggtcagtgaatagttaccagaagtaaaactttttgtcagtatgttttagtgggcatttcaagagctaatatcagaatagtgaactatttaaagaaattaatcaattttggcttgccacaatacattaaaaggtgatcaaaaatcggggggagggatggcattgggagatatacctaatgttaaatgatgagttaatggatgcagcacaccaacatggcacatgtatgcatatgtaactaacctgcacattgtgcacatgtaccctaaaacttaaagtttaaaaaaaaaaaagaaaattttaatattaatactcttggacaataagaggaccttaaaatcctttaactctaaaaaaaaaaagggtgatcaaaaatcatgtctttcgatttgtccaaaaaaactctattgtttttgtttgtggggatatgttcattagttgtttgatagacttcaaatatttcaaaactatgtagaatattaataatgactattaagggctgctttagtatgtgtcagacagcacttactgtatatggtgttatttatgatcattaattcttacagcatctctgtgaggtaggaattatagtccagttttacagatgaggaagccaaggctcactggggctcattgatttacccaagttctcttggccacaaggagcagagctgggatcctgggtctggcaccgctgagggcccatgaccctagccaactgccctccatgcctcccatccctttgccaggagggcagcagagaaggtgcccagcggcacttcctgagcactgacaggcagatgatgggaaacacagagatgagcaaggcctagtccctgagaagatggggccaacagaccagaatccctcagaggggtcgttgactgcatcctatcagtccccactttcggaccagtcattaagtaggtggtaaggaggcagatgcttggctgtagggagaatcctcagagtaagcacttgcctttatcacgtagcatcaggcaaacaacgtgttaaactgcaaagtgactggaagaagtgccgcccattcagttccattttaacagataccaccaaagattcccttctaacctctgactgaaaaccatggtgtgggtactacgaaatagagtaaagagaactttttgtatgtattcactagtctctgtagaaatcggtctatttcaagattatatatgtcctttgggtgtagtttttaagaataggactataaagaactgaagttaagagataatttagataatttagtgtttgacagtaaacctgctgtttcagaagtgaaacactctatttttttttttttttttttttttagttaagttcctccaatttgcttcattgacattgctattgggaagacttaaatgctaggttgccaagttaaggtattgttcaaaagctagtaagaactggagggggttatgatggaagcaaacaaacacacatcagcatttgagaatgtcagtcctggcattagtggggaagctccttggacagagcagaaaagagcatgaagatgctgatcaaattggagatagttaaactgaagagacaggttacttcatgtgtatcattaactttgccttatgactctagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattggtaaggccagggccccactgggcattgcagcctgcctatcattcatgcccatcgataagtagccaccagtggcacatgtttcagggcaggtattcatttggggagcataaagtagtaagatacagggctaaaattagccgaggaatcccagaaacccagccatagttaactgggatacatcgaaatcactgtttccacaagactgaaacagtagtatatggtttccttccctaatgtttactgtttaaattcagttgaatgcattgaattttaaaaaattgtcttaagttaccaaacattgttatcttccagcaaattatcagcaggctcccttttttttttttttgagacagagtctcgctctgtcgcccaggctggagtgcagtggcgcgatctcagctcactgcaagctctgcctcccgggttcacgccattctcctgcctcagcctcccgtgtagctgggactacaggtgcctgccaccacgcccagttaattttttgcatttttagtagagacggggtttcaccgtgttagccaggatggtctcaatctcctgaccttgtgagccactcacctcggcctcccaaagtgctgggattacaggtgtgagcccctgcacccagcctatcagcaggctcttaaggctacttccagctacactttctttccccatgcatgcattttccatgtttccacaacttcttcatttcccttctgtgggctcatagtgttccctttgctttcataggccacagttaactagctatttgagacatcaaaagctgaggaagccatgggagatggcaatgttttcttcagatgtcccttaaaacgtcattaaagcaccctaggttggcaaaaatttaggaggtaacacagataccaaggtcaacttcagccagtttttctattgctttgcctgtttctattggctgaataagaagttcgcctcaaagaagccccaatctaaatccttacccccatctcccagtcatttaacagcaacaacaaacatgccggttctagggaatctgtgtttagcacaattaaatagcaagatgaaccagacgtggcctttgctctcaaggggcttgctgtcagggagtggacatctcagaaacattctaagggaggcataagccaaatgctaagagagcacaacagggaagcagccgggccacaggtgagaagacgaattctgggagatggaggtcagcccaagggcccactgctgttgtgggaaacccagaataaggaagggcccagctctccagacccataccactcccctctcccacgttttctccaagatggttgtcagtgccctgcttttcttactgtttttgcctctggggctcagataacatggagaatgcttatcttaacccgaactgctacctaccactctcaaaagcccacccaagacacacacacttgttctatcacaaggctactgcttcttaacgcttcttattttagaaaagacaccattaagtttacttagattcatagtaaatttttgcaattaagaattattccttcagtaaagtttaaaatccggaagcccttttgtagtgaagttccttttccctctattttggcacccagatcatttttttcttttttgaaatggagtctctctctgtcacccagcctggagcccagatatgtggtctcagctcactgcagcctttgcctcccaagttcaagtgattgtcctgcctcagccttctgagtagctgggattacaggcacacgctaccacgcctggctaatttttgtattttcaatagagacggggtttccttatgttggccaggctggtcttgaactcctggcctccagtgatccacccacctcggcggcctcccaaagtgctgggattacagatgtgagccaccgtgcccagctaattttcctaagttgaatgtgcatgtgtttgtgcacatggatatgtgcacatgaaaggttcccttccacatcatctcctctaacaattgaaatactcctgcagtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtgagcaaatgccaacacctgcgacagtgtctttttgctgcccagctggcctgccagggttgtggagagctgatgacttgttttcagttcttgcatctcatgtctggtgccatgtggccaagcagcaagggagaaactggcacggagccactttcccttgcctggctggatttcaccacatctcattattgctccctgtctgtaccctgccaacaggttcttcacattcttgataggaaacccttttccactgtgaagcttgcttatttgggggagtgaagagatgatgcaaaaatacacaaagatgagatagctgcttcctctccttatgtgtgtgttttaattatacaataagaaattattaaattataataatgaagatttctaatgtttgattgctcttagaaatatatttttggaaaaatacctttttgtacctatggcaacaagaacaggtctgatagatcttttactaattcttaaaatatcccccctctatattttaagaaaagctgcacttaattttatgcccaatactcctcagcataacctcattattgtaacataatttttttgcaaatttttttttttttttttttttttgagatggagttttgctcttgttgcccaggctggagtgcaatggcgccatctcggctcactgcaacctctgcctcctgggttgaagcaattctcctgcctcagcctcccaagtagctgggattacaggcatgcaccaccacacccagctaatttttgtattttttgtagagacagggtttcaccatgttggccaggatggtctcaaactcctgacctcaggtgatccacctgtctcggcctcccaaaatgctgggattacaggtgtgagccaccgtgctgggccacaaattttttattttaaaacagctagaatattcaccaagaggagggaaaaatgatttctcctatcaaagtcttagtagttactcaatctcaggaactgttagtgttcttttcaaattttccatcctgacttacattgaagtgtagtgaattttaagacaataatgccttcctctcagatagtggagcatatttctctataagctctgcatggaaatgtggagccacctgtcgcaatattatgctggcccctatttgcctggttgctaagtgctgattgtgtgtctattgacctcagtcttaggactgctgccacttggttggctattttgtgaaacctacaatgtctttgtagtttgtctctgtcaccatttggagtctttgtctcttccagtggccctcccttgcctctctctcctttcatcccggagctttctcaggccaccatcttcatctcctaggctcttcccttaaggcttcagcacaggtatatgtggggcttttggttattcagttacctgatttggagtttgccttaagagagagtgcttcaaggattatcaagtctcaccctgcaacagcaacccagctctgaaattgtaagagaagctacaaagtgttttctggccagctccccaataaagacagagctacattatgttattctattttgtttattagcaagtctaataacttttgccataatgacttcatttccatcttccattaaagagaattacattatcttgtcatttagtcttatataatggtgattataatcctcatgactataataaatttttaagcacagctgatgagatttaagaaaattgaacaaaaatactgcctgtcattttaacataaatcctgacaaggccgcacacaaaaaaattaagacatttttgacaaaattcagcaaatttgcattctctgtatctcttttttttcataggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccaggtagagcaactttccctgttacaaaataatttaacattcatcaaagatgatctttagggaagtaaagaagtcctctacttattgcttgtatctctgagctgacttcatctgtgttcaagaagatatatgcctctaccaatcttaaagcaaggagattttgccagaaattaatacatttcagtgctaattacagtataaatatatttaatattcagcaaatatttattgagtacttacagtgttctatataacattgaaggcactgggatacacccataggcaaaacaaagtctctgctctcatggagtatacagtctatgcagcttatattccataaaatagctttctatcttatttgataattgagtggattatcaaatagtgactttgtttttagagacagataattcttgttacttcaacagatgattaattaagcctccatctcaaggcaccatatttattgctggggaagatgcttcaataaataaggaaaaattcctgccttcaaggagcttacagttcagtagggaagacagagtcgtatccaactgactctaccgtagaggttctagcaaattctgtagtaagatgcctaaaggaagtactgagggaagatagcagtattcagggaaggtcccattaatctgggcattgaatttaaggaagtggaagaatgagaagggcatttgaggattatagtgacagcatgaagcaaggcacaggcatgaacatgcccaattttcttttgcccggttattttctgtgctgactcttagactttctttctttttttttttttttttttttttttgtgacggagtctcgctgtgtcgcccaggttggagtgcagtggtatgatctccactcactgcaagctccccctcccaggttcacgccattctcctgcctcagcctctggagtagctgggactacaggcacctgccaccacgcctggctaattttttgtatttttagtaaagatggggtttcaccatgttaaccaggatggtctcgatctcctgacctcatgatccacccgcctcagcctcccaaagtgttgggattacaggcgtgagccacagtgcccagccaactgtgttaatggtgatgaacaacctgtaatacatacgaatatggcaggctgtggccagatctaattagactcaatgagatggagaccaacctgaccaacatggtgaaaccccatctctactaaaaatacaaaaattagccgggcatggtggcaggcacctgtaatcccagctactctggaggctgaggcaggagaattgctggaacctgggagacggaggttgcagtgagccaagattgcaccactgcactccagcctgggcaacagaaaaaatcagtaggccaggcgtgctggctcacacctgtaatcccagcactttgggaggctgaggcagacagatcacctgaggtcaggagttcaagaccagccaggccaacatggtgaaaccccatctctacaaaaatacaaaaattagccaggcattgtggcgggtgcctgtaatcccagctacttgggaggctgaggcaggagaatgacttgaacctgggaggcagaagtggcagtgagccaagattgtgccactgcacagagacttcatctcaaaaaaaaaaaaagtcaatcagtagacaatcagaatcaagacttgcagcttcttaatgttgaattcatgtttgcataacttcttactaagaataaagcagaactatctgacagaacaatggtcctgagatttcctcccagtttctgcaagtgtggaaagtaagaataccctggaggaagcccaactttatagaagttggctgccattcaacttctaaagaatatactttaatacttaaatatactttaagcatatttcacagagtgaggcagacctgcagtttatttatttagcaaatattagttaacaaagtggtcccactttttaaaattcaaatacttgcctccgagagactgatccctaattcagtttgtcacccacagacctgataacaacatgcccactttctagttctctggtgcttaatttattttcctatagatcagcactgtcctgcattcaacttttattttcattttgtgttaatagccacatgtggctagtgactactactgttgtattggacagcacaggtttagacaataccttgaaaatggaaatatctaccttatatagacgatgatttattttcattagaaaagagacatgaccattttacaaaaaaaaattattgaactttttaaaaaagaacttcatactctctaattgattaatttctttaggggcttttgttattcatgttatttatgatcttttataaaaatatgatttaaaaaacattcaaaagagataattgtattaatacggctaacatttttatatggagaaaagttgcagaatagtattaatagaatgaatcccatttgtataaaaataaaatgaactagaatatttatagcagctagagggggtgttcaggacatggttaacaattgccactttgggagactggaaggatggaagtgcggacatttatttttcatgttttattctcttgtgctatttgaatatcttcgaaatttacacagcttcttacaatattacacaaacattacattgatacattctcttgtaaaaattcagataaaggtaaatgtgcagaccagctcctccttccttctggtcccagcccacccctgagtagaactgaaatctgtacgcacagatccttttaattttccagattataggtacccagtgtgtatttgataatatgccaaaaactttgatcatttcatttctcacagattgtgaaagtgttgaatttgtatactccagttaatgagtttgaagaaagagtctctgtgtcgttcattcgtactatacaggtaagagctcccatcttcttctttgattcaccaacacagtcttttgaatggacattttgtaatttattgaaggataatgtgttatcttttattatcttattttacaatgcactaacttttttgataatagttaattgggaaaatgaagtgagtttaaaacaaaagtaaacattcttcattagttgagaatttgagggtagaaattttagtagaaaaaagtcttttagattcaaagaactgatgctctgtttattttttttcctaatcttctcagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctgaaagtgatgtccaggcaaaaattgacaatacatttcttgcccgaaataagaacccattatttccagtgagttactgaaaatacatttttaaagagaaagtactgattatctcccaaatgagaagtcattaactggaaatctccctagaatactttcatcactttggaaacaaagataggctctttcgtgctgtgttatctttatagcaacactcatccttaaccaactaggtaccgtgagtttacatacaggagaatgatggaaggaagggaggaaggaaaggaggagaaaaatgtgtcttcagctggcagcatttattttaaatccttagcactgagtttgaatggtataaaaagtataacttccatagatgagctgttgttaggaaggcaccaaagaacctcctctgcactaaacaggagaatggaaagaaaagtctccattgagtacatatcatgtcagtttagtaatcaattatgttgatattgttaaactggttcaaagaaataaactggcaatatgtaaagtaattcctcatttgtgtcactatgatatagagatattaaaggaatgttggtttgctaaatagtatagatgtccatttgtactatagtttactgagcattttaaattgctgctacatactgtcttcttaaaatgtaagtgatattaggcactacaataagtttctcttgtcaattctgtttacaattcaatcagatcacagttttaactggattatatgcaaatacctacagattcacctgcacaagtagcagacactggaaagtcatgtagtaatatgacaaaatgcttgacatttaggggtaggattagacaaagtggctattgttgatgtcattatttattcaggatgtattacattgatgtgctcattaattttccctgggtggatattgcgtcagggtacagtgttctgtgaagtgacttatttttaactaccagatctgattccttcagtgcatattttcaaccttgacaggttttctctcttcttaatttattaagaattaatctcggctgggcgcggtggctcacgcctgtaatcccagcactttgggaagccaaggtgggcggatcacttcaggttaggagttggagaccagcctggccaacatggcgaaaccctgtctctactaaaaatacaaaaattagccgggcgtggtggcacttgcctgtaatcccagctactcgggaggctgaggcacgagaatcgattaaacctgggaggcggagattgcaatgagatcgaaccactgcactccagcctgggtgacagagagagacactgccttggaaaaaaaaagaatctcactcactatctagagaggattgtcagaatattcacgattcaggtcttgaaactttgattatgcaaaagaaggtatataataaatatttcattatgattcagtttttaaggctttgcagcttctataagtgttctcagatgccactagataattttaaaagcatcatattagaaatactttaagaagacttatataagaaatagaagattgttgaattttacagaggatttggttcattaagacccagattctgtaagttttcattctgaaattctagttaaacatattcaccatttttcttaggaatcttatacaataaatccttcaggttgcacaaaagcaaattattagttttcattagaaactctggttctgaattacaatcataggttatataaatttaactgttagatggtctataaaaatgacaaatcttattaaaatatgtgcaatatttatggaagtcaaacagcttcatatcagtgataaagattgttattaaaagataaatactgtctgttaatttacatgggcctcaagttcctcgtttataaaataagagagttggacactgattcttaacatctcctccacatttaaaattctctcttctcagcccttagattctagagagaaaaagctgcagttactcagtaagtccattctctgatggaaagaccagtgtgtagtgcctgtcaattccttaggattaatcaaatgtaaaatcacaagtttgtgtagctgtaacctttcttaaatgtacatgatttatgtacatgcttttagaaggtcctactatatttgtattataattagtttaagtaatttttattacatcatgtattgctttattcagtttgaatacatttatttatttatttgcagtatcaaccagaaacactaccaattgcatcaaattctcccagtttttcctggttgtcaatgcggttttcaatgcacaattaagtcatagccatttggttcgtaccaaatgtgtcagaatctaacagcatccgataggctgtaagttggggagttgctaagaaaatgcaacgtggtacaggctgtccgcctcagccctggaaatctcccagacctcccccagcttcatcctgtgtagcacgactcaacgtgcaccctgaatcttctcaggtcttccaggtcatgctgtagctgtcactgccatgcagcccttttttttactccggacagctcatgtactgaagcgtcatgaaagaaaggctgtggtc

SEQ ID NO: 15087 - DNA, 19813 bp, Human
  misc_feature (1)...(19813): n = A,T,C or G
agatcatataacaacattgaaaatccactggctaaagaccaaagacagactaatggctcagctagataatagcaaatgatatgttggacttaagttgtttgattttttttttttttttttttttttttttttttgaggcagagtctcgctgtgtccccccaggctggagtgcaatggcaggatctcggctcactgcaacctctacctccctgcaacctctacctacctggttcaagcgattatccagccttaccctcctgagtagctgggactacaggcatgcgccaccacgcctggctactttttgtatttttagtagagacggggtttcaccatattggccaggctggtcttgaactcctgacttcgtgatctgcctgcctcggcttcccaaagtgttgggattacaggcgtgagccaccgtgtccggccttgagatatttttttaattcaaaagtttattcacaaacttcaacttttaagtgttttattacagatagactggtaagctacagaatttttaggactttttttttgggggggcgggctaggagggctgatttctgagaagcagagaaaaacttgtagacaggagaagccgtttctgttacagtaaaataaagctattatactattagtatccttcatgatattaagcagatacaagacccgttcttatttattaaaagaactgagggatatagtaagtatcagtttttattaaagctgtctttctcctattggacaatgagttgcgtttactgagggccagaatccttttgctcatatcaggtttgctcctgcctagcatatagtagttgctcaatatatgtttatatattaaacgaataaattggtggctttattctttctgcctaaaatattgtctggtcttatttgttaggaattctgaccacctgattttccataatgcctcatatctggtattctgggtactctgcaattaggccattaagaaactgaaagaaccaagttgcatttttttttttccaggctggctagggaaccatctactggagttgaggctattttttcctgcccttttataggatattttttaaagtatgaaatattttaagtgtacagagatcaatataatgaaccttcatatacataccacccagctctataagattctagtaatctgccatgtttgttattttaaaataaataacacattaaaacgcagataaatgattctggtctctttccttaatctccgggtaatcattatgaatttggtatttgtctcatttttttttccttttttttttttttttagttttgcaatatacatatgtacttaccaaaaaaaactattttgcatgcatataactacttatctgttctcctattttatgaagttgaggttgtttctaattttctttaccaaaaaaaaatgagcatttctctagggagtttactgtgaagaaaaatggccgggtcatagagtacgctatttatttattcatttatatgtttatgccaaattgctctgaagtttttactaatttaaactccaaccactattgtgtgaaagtttgtttttctacactcctcagacttgacattaacagagatgcatgttttttcaatctgaaatgttctcttaaggtaatcttttcctatcagtcacattaaataccttttcataggtattattcattgttcaagtttactcttataagttgaagaacattatttgcatatttgtgctgttagatttttgttcattggatattgataggcatagttaataagtaaacatgctttttaacaaactaacacattgcaggcttcttctatattcttttagatatttagatagatgttactaacgttttacccctcacaaaactcaagttctataaaaatattatgaaccttcccatacttgttggcatttcagaaatggtacaacctaatgagcctgttaccaagaatctagtgtagtgaaatctggagcccgggccaacgtgtgtgaattgctgataacatttttgtaagctatttttgattaagggtaatttgtcacttaatgaccataattaagtttaatgtaccagtagtagtttattgctaaatgcctactttgtgtcatactacaaatttgaagaaaagagtatttcctgcaatggtgactctcttctttttctcatccccccaggttgtatcagagtaagatggacggtagctttgattgtgattgtggtgagctggagccacctgatcactaacaaaagacatcttctgttaaccaacagccgccagggcttcctgttgaaataaatatatagcaacaaaggaaaaaaagaagcaaaacggaaatagtgcttaccagcaccttagaatgatgctgctcaggaccagtccaacactgaatgtatctgcactgtgaggagaatgttcatagaagcctgttgtgtgcatatttattcacatttttgttaaatgttaaatcgtttagcacggtaatctgagtgcacagtatgtcatttcattccgtttgagtttcttgttttcgttaaatgtctgcagagttgctgcccctttcttgaactatgagtactgcaatctttttaattctcaatatgaatagagctttttgagctttaaatctaaggggaactcgacaggcctgtttggcatatgcaatgaacatcaagaaaccatcttgctgtggaagcataattatttttcttctccctttttgaaagatctttccttttgatgccagttttcttccttgtttacacaagttcaatttgaaaggaaaaggcaatagtaagggtttcaaaatggcagagaaatttgaaagtctcatgaacattcatggttttgatctgggttctaggtatatggacttaaaaccattgggttgtggaggcaatggcttggttttttctgctgtagacaatgactgtgacaaaagagtagccatcaagaaaattgtccttactgatccccagagtgtcaaacatgctctacgtgaaatcaaaattattagaagacttgaccatgataacattgtgaaagtgtttgagattcttggtcccagtggaagccaattaacagacgatgtgggctctcttacggaactgaacagtgtttacattgttcaggagtacatggagacagacttggctaatgtgctggagcagggccctttactggaagagcatgccaggcttttcatgtatcagctgctacgggggctcaagtatattcactctgcaaatgtactgcacagagatctcaaaccagctaatcttttcattaatacggaagacttggtgctgaagataggtgactttggtcttgcacggatcatggatcctcattattcccataaggtatgtatagaaagccagctgagacagatctttaaactgatacacctaatcaggaataggtacttatattttctttgtatattgtggcagaatttttaatcttattaaactttacatagtgccttttttctgaaacaagtctctctgtttgaaatgaaggtggagtgggataattaaatacaaatttctaaaaatacatggttattataatgaaattttaaagtgtatggttatttattataaatgaaattctcccttagttatttaaaagtggaatatactcttctttctttgggacagaattgtggtaagaggggatgctatttcaactttaggtcttttgtttttgagacagagtctcactctgtcacaaagggtagagtgctgtggcgccatctcggctcactgcaaccttcatcccctggattcaagcgattcttgtacctcagcctcccaagtagctgggattacaggtgcatgccatcatgcccagctaatttttttgtatttttagtagacagggcttcaccgtgttggccaggctggtcttgaactcctagcctccagtgatctgcctgcgtcagcctcccaaaatgctaggattacaggtgtgagcccccatgcccagcctttttttttttttttttaagtttttagtgacaagatcttgctgtgttgctcaggctggtgtcaaacttctgggctcaagtgatcctctggcctcagcctcctgaatagctgaggctaaaggtgcatgccagcacacccaagcttatgtcttcttttgtctctttgagcctgtactattcagttctgctttgtttaaactaaatttagcttgaaatctaaattcacataaacaattggtaataagtatagccaaaaagatctcacagcaacttcgtcttagatagcaaattgccttcatacaagaatttaatatttttcaagctgaaccttggtcttttagtttggaaatgaaatcttatgtgggaccctgatgtttaaaatagagaggtggagctgctttggttgtaaagaacccctgggagccctgctttgttagctttccacagtacatgcctaagacaaatcttcatacatgttgtttcacgttaagattatttttatttttatttatttatttttttgagactgagttgtgctcttgtcaccaaggctggagtgcaatagtgtgatctcagctcattgcaacctccgcctcctgggttcaagcagttctcctgcctcagcctcccaagtagctgggattacaggcgcccgccaccacgcccagcccacattaaggtatttttacttgggccaggtacagtggctcacacctgtaatctcagcactttgggaggctgaggcaggcggatcacctgaggtcaggagtttgagaccagcctgacaacatggtgaaaccctgtctctcctaaaaatacaaaattagctgtgcctggtggtgcatgtctgtaattccagctactcgggaggctgaagcaggagaatccaggaggtggaggttgcaaagagctgagattgcgccaatgcactccagcctgggcaacaggagcaaaactccatttccaaacaaaaaagatattttgtagaaaatgagttctaggctggaagcgcggtggcccctgcctgtaatctcagcactttaggaggccggggcaggaggatcacttgaggccaggagtttgagaccaacctgcgcggtggctcctgcctgtaatctcagcactttaggaggccggggcaggaggatcacttgaggccaggagtttgagaccaacctgggcaacacagacaacttttttttcctagagaaaaagaaaaagagatgagtattacactgacgacgtccacagtgaagtattgtggatagagcactgaactaataagacttatactatataaaattgactccatttctacatccaactagctatatgacttgaagcagatctcactctctcagtcatcacacctataaaatggagttaatatctaccatcacaatctctcagggtagttttgaggatgaaataaggcaatatatgtgtaaggttttgtaaggtgctttgtaattgtaaagtagttgaataggtgatgaataggatttatagtagaggtcattaaggaggtagacattggtttataagtagcacctctggtgctcttccctactgttctgacttgaagcatacttgctctttgattatctcaagactgagtgtaaaccagctcgtcttctgaaaaatgctttgaatgtgtggcctagagttatataatttttttttttttttttttttttttaaagacagggtcttgctctttgctcactgcaacctctgtctcctgcgcttaagtgatcctcccacctcagcctcccaagtaactgggactacaggcgtgtgccaccatgccaggctaattcttgtatttttagtagaggcagagttttaccatgttgcccaggctggtctcaaattcctgacctcaagtgatccacctacctcggcctcccaaagtgctggggttaaagattaggatttttttttttttttttttgagatggagtttagctcttgttgcccagggcggagtgcagtggcacaatctcggctcaccgcaacctctacctcccgggttcgagcgattctcctggctcagcctcccaagtagctgggtttacaggcatgcaccaccacacctggctaattttgtatttttagtagagatggggtttctccggttggtcagactggtctcgaactcccgaccttgggtgatccgcccaccttggtttcccaaaatgctgggattacaggcatgagccaccacgcctggcaaattaaggattctttaatcaagttgtaagtactgttcttcagctaaagtaaaaaaagtatgttttttgtttcttttatagggtcatctttctgaaggattggttactaaatggtacagatctccacgtcttttactttctcctaataattatactaaagccattgacatgtgggctgcaggctgcatctttgctgaaatgctgactggtaaaaccctttttgcaggttagtattttgtggggggaaaaattttcccaaagagaagtaattttgcattttatctctgaagcaagattcatataagatttaaaataatttgttatgatctgtaatactaaaatgaacagataaattggcgtttttaataaaaaaattgagaaaacttattcacatattcactaaattggtcacttcataaattatcagaactcctgtttaaatataatttcatattttgtggacccataatacttgttggtaatttgtgttgatacttaagttgcataattctgtcagtatcatcacttcctggtgaaaattttaagccattgttgaaaatccaacaaatttttcttggtcccctccccctataaacaaccaaacaagtaattttttgttaagtttggtgctatttagaagtctaaagaagtgtgtgagagaggactttgtcaagatgagatgagtaatccatgaaaaatgtcttgtgtcataaagcaaagcataggtctgtataaaattatttagtatagactagagctgtaaacttagagaagctatgcatcagtgattgctggaatggaaggcattatggagtcaaacagatttttcactatttagaagtagcgaagaattttaattggggaagagagaaaatgtgttatttaagggtacccatataaataagagtataagcctggtgcattcatgaatctgagatttgtgcaagttgtcaaataataataaacatatttatgactagttaagatggggtcagaatactagaaagtatttagaaagtaggcagaggactttccatatggaaaagtaaggaatagtaggggtactgaagattttttagttggggaagtggtgtgatagtgattaaggcctttttctgtcttttgacataactttttccccctctatacccattttttttttctgagacggagtcttgctctgtcacccaggctggagtgcagtggtgcgatttctgctcactgcaagctccgcctcccaggttcacaccattctcctgcctcagcctcccgagtagctgggactacaggcgcccgccccgtcgcccggctaattttttgtatttttagtggagatagggttttaccatgttagccaggatggtctcgatctcctgacctcgtgatccacccgcctcggcctcccaaagtactgggattacaggcgtgagccaccccaccaggccctccatacccatttttagagtggttccccccaacccccagacggtgctaagagcagaaggaaaggaataggccagagtctatttacataagaaagattagtgtacataggagagcactggtgaagaaaggacagcgtgcataaatgtcttttaagtatgttaatgccagtacttagtttatataacagcaagccagctctttataatttttttctaatatttatctaaaatttctgtctgggctcagtgtctcacgcctgtaatcccagcactttgggaggctgcagcgggcagatcacttgaggtcaggagtttgagaccaggcttgccaacatggtgaaaccctgtctctactaaaaatacaaaaattagctgggcatggtggcgcacgcctgtaatcccagctactggggaggctgaggcacgataatcgcttgaacctgggaggcagaggttgcagtgagctgggatcgcgccattgcactccagcctgggcgacagagactctgtctcaaaaaaaaaaaaaaaaaatttctaagatgtatgatagttttctaaattggaattcggagggattcctggaaactaaattattaaatggattgatttttgcttaggaacaatactgtgattagaggttatgttcctgatatcaagtgccttccagcatatataaacaattctgtttgttgcggtgtgacaaattactccaaaacttagtagcttaaacaacaaacatttattaacgttttacagtttctgtgtgtcaaaatatgggagtggtttagctgggtggttctagcttatgttttctcagtcaagatgttggtaagggcagcagttaccctgaagtcttgaccaaggcaggaggatccacttctagatagcttacttacatgacagttaccaagaggcttcggttcctcaccatgtgggcttctccataggactgcttgagtgtcttcataatatggtggctggcttcctctagaaccagtgatccaaaagacagcaaggagaaagccagtatatctttctttaaaaagttgtattgttatataattcacatatcatacaatttatttaaataatatagttccatattttttagtatatttacagagttgtgtaaccattaccacaatctaattttggaacactgtcttggctcctgaaagatcctgcaaaccattagcagtcacttctcatttcctctttcccccagcccctggcatccactaatctactttatgtctctatggatttgcctactctggttgtttcagataacatttggactttgtgacaggcttctttcatgtagcaatattttggaggtttacccatgttgtggcatatgttagtacttttttcctttttacgggcaaatagtattctgctatatggatataccacatgctgtttatccattcctcagttgatggacatttgggtttccacttcttggttatgaattatgctgttgtaaatatttgcgtacaagtttttgtgtgaaaatatgttttcagttctcttgggtatatatacctaggagtggaattgctgagctgtgtggtaactgtttaactttttgaagaacagtttcccagcgcagctgtaccattttacattcccaccaccaatgcatgagagttaaattttgtctttttgagtatagccatcctatcgggtatgaagtagtatctcattgtggttttttttttttttttttttgagacagagtcttgctttgtcatccaggctggaatgcagtggtgtgatcttggctcactgcaaccactgccacccaggttcaaacagttctcctgctctcagcctcccgagtagctgggattacaaaggcttgtgccaccacgcccagctaatttttgtgtttttagtagagacggggtttcaccatgttggccaggctggtctcgaactcctaacctgaagtgatctgcccgccttggcctcccaaagtgcaaggattacaggtgggagccattgcacccggcctcattgtggttttgatttgcatttccctaataactaatggatgattgaatgtctgtccagatctattgcccattttttaaattgggttgtctttttattattgagttgtaagaattctttacataattctgaatacaaatattttgtgatttacatgtattttctcctattctgcagttttttttccctttctttatagtgtcttttgaaacaagattgattgattggttgattgattgattgattgattgattttttaagacagagtcttgctctcttgcctgggctggagtacagtggcatgatctcggctcactgcagtctctccctcctgggttcaagcaattctcctccctcagcctcctgagtagctgggattacaggcacataccactatgcccagctgatttttgtatttttagtagagacggggttcaccacgttggtcaggctgatctcgaactcctgacctcatgatccactcgcctcagcctcccaaagtgctgggattacaggtgtgannnnnnnnnnnnnnnnnnnnnnnnnnntgcacatgatacattgttatcgattcgagcctcggtaccctctgaggataattgcctgacccaaggtcatggatgttttctcctgtgttgtcttctgagagttttataggattcttatacagctgggcgcggtggctcacacctgtaatcccagcgctttgggatgcggaggcaagtggatcacctgagatcaggagtttgagaacagcctggccaacatggtgaaaccctgcctctactaaaaatacaaaaattagctgggcatggtggcgcgcacctacaatcccagctactcgggaggctgaggcaggagaattgcttgaacctgggaggtggaggttgcagtgagccgagatcttgccactgcactccagcctggccaacagagcgagactctgtattgggggtgggtgggacgggaagggattaacttttacacattcttttgcatgtggacatcctcttgtcctggcaccatttgttgaaaagattctttccccactgaattatcttgacactttcataaagaatcagttgaccacacatgtaaaatatctttttgtgaccaagtctcaaaagttacatactgtcaactttagctttatgtgttagaagtgagtcactaagtacgcttcatggtcaatgggagcggagttcagttccaccctttaaagggaggagtatcaaaagaatttttggacctttttttttcattttttaccttctcgaatgaacaagggtaaagtgtacatacatatatctatacacacacacacacacacacacatatacacatacatagatacacacatacatatatatataattttttttttccgagactgagtcttcctcttgttgcctagccaacaatcgtacaatggtgcgatcttggctcactgcaacctccgcctcccaggttcaagcgactctcctgcctcagcctctcaagtagctgggattacaggcatctgccaccacacccagctaacttttgtatttttagtagtttcacccttttggccaggccggtctcaaattcctgacctcaggtgatctgtgtgccttggcctcccacagtgctgggattacaggcaagagccaccgtgtccggccaagtggacacattttaaagccaccacagtaacgagtcagaaaaacaagccaggtgtggtggctaatacatgtaatcccagcacttttggaggctgagaccagaggatcacttgagcccaggagttagagaccagcctgggcagcatagtgagaccctgtctcgacaaaaaacaaaaatgtagctgggtgtggtggcacacacctgtggtcccagctattcaaggggctcaggtgggaggattgcttgagcccggcaggtcaaggctacagtgagctgtgatcatgccacttactccagcctgagcaacagagcaagactttgtcttagaacaaaaacaaatttaagtctatataatgaaaaatcatttggtcatgctccaagtcatagaagtgagtcagtacctactgctgctgcatggattatacaaagggtttttttgtttgtttgtttgttttggaggagtctcgctctgtcgcctaggctggagtgcagttgcatgagctcagctaactgaaacctcctcctcccgggttcaagcgattctcctgcctcagcctcccgagtagctgggactataggtgcatgcctccatgcccggctaatttttgaaattttagtagagacaggatttcaccatattggtcaggttggtgttgaactcctgacctcaggtcattacctgcctcagccttccaaagtgctgggattacaggtgtgagccactgctctcggctgtatttgtgtatttttaaatgtttgtttttaaatgttcaatgcacattcggacattaaatataggaataaaaataattggatttgttttaaaactcttaagtagcatagttttacatttaataggaatagtttgcaatgaaatgattggaaagatctagattgtagtttgtttctagttgccaggtgctttattgatttttgtcagtgacccattcaataaaaacacgaagggaaatctgagtggttattaattaggtataagttgcaaatgaacagagcaacaaaaggtaaggaccaagcactcattggaaatcagtgtatttttagcctgtgtgtcttattttttggtgcatttctcttgtgtgtccagattgtctctctataggtgttcctgtcccaggttaacacttgtacttgggcagtagatattttccctctttcctgctgtagcacttctatctcttgcatcttcactttacctcttctgctagatcacttttatcagtattcattcaaacattgatagaatttttccagtcttacaaaataatctgtcctgaccccacagtccctcagctactgccacatactactgtactcgttggatgtaaaacttctcaaaagatgcgtgcatccttgctgctcttaattcctctgcttacattctgtctttcaccctgtccagtcaggctttgtcctccaccagaaaccactctccacaggtcaccagtgatctccataatgctaaatcccttgtcaattctaagtcctcattttgagccatctccagcatttgttgcaattgatcttcacctcttcaggtgctttttcacctgtctttgggcacgccactcttgaattcttccctggcctctttccagtcacccttgccagttctctttctcctcgtgttggaagtatcccagattcagtccttgggctccctgcttctctagcttcacttagtccctgggtagtctcattctttttcattcctttaagaattatctatatctgatgatgactcctgaatttatgatgactcctgaatttatatcttcagccctgacctctcgtctgaattccaggttccttaactcaatatctccactcagatgtctaataacaaagttaacctacccagaactgggcccctgatatttcttcctcatacgttgtttttactcatgttagcaaaccagtacctccatttttcagttgcttagacaaaaatcttgtcattgtccttcatttctgttagcacagatcctgtgggctctttcttcaaactatatccagactcttaacggcttgttactgtcactcttactatccctcccccagtccagtcagccattatgtctctcctgttagaaggaccttctctttcctgcttcagtatttgctgtctttagttaccacatcgcagccagggtggtcctgttgaaagacaaggtagatcatgtcatctctgctcaaactgcatgatggctttccatcaaactcagggtaaagcaaaccctttgttctagtaccactctgacttatctcccattatctgccccaagctactctccttttgctacacttgtctaattgttgtttctttgacataccaacctgcctctgtcttctgggcttctctccatcttcctagaactcctttctttcttccatatgaatgtttggtgtattcctgacttccttaattttccacttcttagtgaggccttcctttgtctcaaaaaaaaaaaatgtcttattgttgcccaggctagagtgcagtgacatgatcttggcttactgcaacctcctcctccagggtccaagcaattcttgtgcttcagcctcccaagtagctggaactataggcatgcgccttgcctggctaatttttgtatttttggtagagatggggttttaccatgttggccaggctggtctcgaactcttgactttaaaaaagtattaacaaccctattcttcccaacagtgccatcacccttagcttactctctttttctttatagcatatgtcaccataagacctactttacagaattatctgtctttatccacaagattgtaagatccatgaaggcaggcacttggtctgttttgtttcataactgtattctcaagtgtcctgcgcatagtaggaactaaaaggaattttgaatgttcaatgaatttatagacattaaaggaaaggcaagtggaatttttattttttgtttttgagacagggtctcactctgtcatccatgctggagtacagcaaatggaatttttaaaagtcaccacctatttagcctaaagtttccccctttatttctttcattgcctaacaacctagaaatgctaactgagccctaacatagaactataaaacttcctgttttacaagtctagtccaacccttcatttcattgatgttgaaataaagtcctaagagatgttagctattgtctctgaagttatagccagtaaattagtggtacagttaagaccagaatccagatctcttgaatctcagttgctttttttttcactagtttgtgataaccttaatatgagaccaaacttaaagagtcagttccctatggaaacaaagcagcaaaaactaaatacatcagtaagcagaaattgaaatagataagtagattggtgatagtcaaagcaatgaaacctgctgatgatacaattcaaacttttccccccactggtcattataatatttaaattagtttagtatgtttattgtgaaataagtaaacattgaggaatgtgtttttttgtttgttttttaacctcaggtgcacatgaacttgaacagatgcagctgattttagaatctattcctgttgtacatgaggaagatcgtcaggagcttctcagcgtaattccagtttacattagaaatgacatgactgagccacacaaacctttaactcagctgcttccaggaattagtcgagaaggtattgtgactcgagagtaaccctcacgttaatgcctgtgtgtgaggcagaatctgtgtagggaagctggagctttttatccttagatatggggctttctccaaaatagtctttagacacttaaggtgtacgtaaaacttcaactctcattttccctttttttgtcctgttacttgggctacgatctgtttttttggttcctctgaatcactttccagagcaagtagcaagtattttgaatataggcactggggacaaaatcatgatggcattttttccctcagatatacttggaactcctgtaaatgcctggataaaaagaaagctgctgtatttaatttcagccggttttgcaggcttttcagtagttccacattcttaatcagtctttgagtctgtctgcacaaattccattgctagctcccttgctcgtaaccctgtagccactgtcacaacatccctgttcatatctaaatgagtcctctgtgggaacactttatttttattttttattgaaaaatagagacagagtcttccctgggctggtcttgaactcctgagctcaagcagcctttctgcctcagcctcccacagtggtagtattacaggtgtaagccaccacacctggccaaggagcacttttaaaatgctgaactagtaattctgaattgggaggtggagtggggaacagggtgggtgtctgcataccctctctaaggtgtgactctgctcagccaggtgaagacactgtgtgcagtgataacctggatccacttcagagtagttgtcactaatcaagaggacggtgctgttgaagcatttgtaaccttgctgtataatgctatttgaatctttttcgtaccctcattagggtggggaccatgttttaatctttgaattaaactgaatatttggccactgactggggtttattaaccattgagcaaagatccttggtggtcacatgtggcagcactgtgcttgcaagcaagtgaatgcagagtggatggagtttctgagactaaagatttatcaattgtatgctccatactactttcttcttaacagtggagttttattttgggacagagcacattctgaggcagtggcaacttggtaaaaagaatacatgttctcaccccacattctttatgatctttgaaggaaaaaagcaaacaggattaagtacatctgagtgaacgtataagactcctaggagccctactctggttaatttccctctatacttacctctcatcctttctgtagtataccatatatttctctaagcatggttcagcaccattgtagcattcctgtagtcctagctgttcaggaggctgaggcaggaagattccttgagcccaggagttcaaggctacaatgagctatgatcatgctattgcactccagcctgggcaaccgcaaagatgctgtgtcttaaaattatctttctaaagaaaagaaaagggttctttctagagtacaggttggcttgagagagaaaggccatctttctcacttagaaggcaaggataagaggatgtgtgagtgaccatagtgaagaggtagggattgagacaaatgtgaagtgggtttatctgttgagaatgataaagaagaccgagagcataaagagaaggccagatagcaaaggtcacaatgaaattgtttagtatgaatttgtaatgagccagatatgggatattgcagctagttttcatcagttttgtgtggccagggagcagagagagtagatggtggtggtgatccagggttgaaggttgatatcataaggcatagaagtgtgtggctggtgtaaatatagctttcaggctgcgtgaggaactaaggaaggcctactagactattttatgggaagaactggatttgtggttaaccagagtcctaagatgtgcaaggtcagtgtgtgaactatgctggagtgtgatgtgaagcagagatcaagaaattagtacaacagagatgttttactgttgtacttcccatcagtgaaggatgggaaagggcttttattacataccagacactatgattacatctcatttttgtaccttatgaaatatctatgtctactttatgcatgaagaaactgatgttcatcaagttttagtagcctatccagcactacagtgctagtaattgagttaagccagtgacttgcagagctaggattaaaacctatatattaggccgggattacaggcgtgagccaccacactcagccagaaaatcgtttttaagttgtaaatcaggtaagttttatttctgacaaattaactttttaattgtgtagtccatttttcccttttataagatggggacctattagtacaattaagatgctcatttcctgttgtgtagtatgtagtgctaaggtaatcacttagctagtcattgaaataaatgagatcaacatttactgtttttctaaaggtaagcaattcttttctgaaaaacttttaccttttcctctgcagcactggatttcctggaacaaattttgacatttagccccatggatcggttaacagcagaagaagcactctcccatccttacatgagcatatattcttttccaatggatgagccaatttcaagccatccttttcatattgaagatgaagttgatgatattttgcttatggatgaaactcacagtcacatttataactgggaaaggtaaattgatcctaaattagaaaaataatatttactgaactttcagtggaccatatgtagtgagtttttttaaaattatgtataagacattgtagaagtcttaaaaatttagtaatgtaaagatacaaaaattagtcaggtgtggtggcaggcgcctgtagtcctagctacttggaggctgaggcaggaaaatcacttgaacccaagtggccgaggctgccgagattatgccactgcattccagtctgggcaatagagcaagactccatctcaaagaaaaatttagtaatggtccttaatatttatatctataaatagccgttaattaaaacatttaataaagtaattactggttagatgatatatgggaaaagttaaatgctactttgaaacattttcaaagtcattaaggcatatttataaagtcctttaactgtgattttatgaatgtcaaaaatttaagatgttagatgacaagactcagtcatatccaataaagtatctccagtgtctcagtggtagttatatcttaacataaaaagtatttgattcatattagatgcaggattttttttttttttttttgagatggaatctcactctgtcacccaggctagagtgcaggctggagtgcagtgatgcaagctcagctcactgtcctgcctcagcctcccgagtagctgggattacaagtacccagctaatttttagtagaggtgggattttatgttggccaggctggtctcgaactcctgacctcaggtgatctgcctgccttggcctcccacagtgctgaaattataggcgtgaaccaccgtactcagccagtatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15088 - DNA, 9811 bp, Human
aattcaaaggagttcaacaataaaattgatttggcacttggtgcctgcagtaactggtgtactgccatatttttccaattaagaaaatatgtggcatgcgtggaatcacatatttaagcaagcaattaagttgtttatgacacggtctgttcctgtttagatcagtaattggaaatttggggacaaaaatagagattttattaagtctatggatcaacttgaaatttggacatctcctcgaagccccaaaactttgagtggcatccactgtgtagatgacatgtaatagacaaagccttcccacctcattggcagaatttgaagggtgtgttttcatatttaaatttcaatacaatatcagtaaaaatactttgctattaaattggcccataatgtttactataatgttccttcctaaagaaaggacaaatgtccacaaaactaactctgagaactagaaaatacggcaatatttaagatcaccgtagctagaatgcccggcagggccgagatctagcgactcttcttcctccaaaccagcaccaggtcttcctaaatttgtaaagtggtggagttaccgtcaaggtgcccagtgcagcctcccggccatgagtccacaactacaggcccgaactacaggttcgccagcgcgcctgacggcgaggttcaggtctgaacccccggcgggcgcagttcctgggattgttgatttccaagctcagggcaagtattaatttctctgcagaccggctcttccggaaatgatttttaacacccatgctggcctggatcctgcgctgggaagaactgcaaacagcctcgactatctaaactcagctttgacttcttaaaacccggagtctctgattcgggcgcagaggataaaggttccagggggatatatatatggtggctgtatatgctcacactagaagagctcctgtttttaaagggaggagaaggacaggaaagtggcaacggatgtgtgcaaacccagagcagaaaaattcatattttattaaacatccgagctgctggttgcatgaaaaggctttgagcaaccaatagaaaccgaggatcgcgaatattccgcttgaacctgttgatctctgtgggttaagcgtttagggtcgagtctgcgtttccacgagggagggcgaagagagaacagaaagagcggttgctttcgcccgccaccggaggctggttttccgcctcctgccttctggcccggcttgggcggcgagccctttgggcggccaacatggcgtgggcgcctgtgctcgtgcgaccccggtcgggcaggcgggacggagattacctggctgtccaggggaccttatgcagggtttggcccgagcccaggggcagcgaggggcgtctgcggatgcggctccctgtgcggcacaacaccggggtctgttgctctcgctgatacctttcggcccaattgttcctaaattagaccagcaagtttgcggtaggcagagagccagcggtggtgagagctggcctgagaacgagccagccttctgggaatggccggtgtgagaggccagtgggtggccttgccgcgcccttatgtccagactttgctctgtgagaggcctggcgctgcgcctttgatttctgtgagtgctgcggagcaagtgagtgcgaaagtgagtggaaagcatttggtgtttgctggggaaggccggtgactggggggtgaatagtgaggcggtgagtcgaggtacgtttgtgaaggaggtggtggatgactgcccaccttgccccaggcggccgctcagacttgacctttgcgcttctccgggatattcttcctccgggtgggttgagaagccggaccaggattccacgagggggaaggattctctattcttttttgcgacaaatctggtaacaggatttgctgtgctgttttcgtccgtgtgtgtgtgcgtgtgtgtgtgtgttcgtgtggatgcacgtgtggccccgctggggtgccccctccagtgtccccggagctgaaagatcgcaaagaggatgcgaaagggatggaggacgaaggccagaccaaaatcaagcagaggcgaagtcggaccaatttcaccctggaacaactcaatgagctggagaggctttttgacgagacccactatcccgacgccttcatgcgagaggaactgagccagcgactgggcctgtcggaggcccgagtgcaggtacccagctgccaggaggtcgagggcccagggagcagagagaacctggggttggaaagaggcttgggggacacactcgggaggtggtgcttctagtgtctggtgtaagatgagaaggaaagagatatctttactagaggtcttattttccaaagtagatcttagtcctatagcactcccctcctttttttttttttccatcctaacatatgttcccagaagaagaaagctgtgctgggctttctcccagagtttctataaaccacaccccccttgcctcgcactggctttaatgtggtttaatcctaatgggcctacttttataaggcttaaaaaaaaatcccacagaaaacgttttatctctggatgccttaaaagttccaaagagtattttgttctctggagttggatttccttgaaagtctgctctgcagggtctaggtttgtcaagcggatatcccaattaggtttatagatgtgcagactataaagaaaattagtaactgttaagtgcagaaatttacagtctgctgttagcggtcgatctcaaactgtgtgtgaaatagcggagaaataaacgcattttggtcactctttgttcattcatttaaccaaggcaacgaaactgaccctaaatacattagattttaaaacaaaccacatatattagtatttatatttccaaagcctgccctccagcacgtgccatacccaatgaagttaggactgaaacagattttctttattggttgtggaggcaaatgtaatagcaaaaataggctttgggggcatttaaaggagcaaattgtgtacattcacatacacatatccttctagctttagggggaacaaatttaaatgtttcagattgtatttccgctcaaataataaaatagaataaaatgatagttattattggtttgaacacatggagcagttttaggcccgcacatctgcagctgttacaaagtatcgctgtaacagatactctttcggtctctgggcacagagaccaccatctgtagcgaactatgcacaattcttaaggggcttccccacatcttgtaacgggatcaggaaaaaaaaatcagagcagtcacgttgaagaggaaaagtaataataggctgccttggtcatcacagcatcagcagcagagccttcctttttaagcctctcctgcttcgctctgtgcactgagatctccagaggctcagcaaccccttaaaaacatgatgataattattacagttatgattattagtatcttaattccaactcttctaggggaaaaaaaggcaagaagcctcaggccatgtgaattacacaaaggatgccaccctggcacaaaatccaccctctgttgtactaaatagcagagaaatttttgaagatttacattgactatgacacttgctttcaaaaacataccaatgaaagctctgaagcagtatttttactttaatggggttttaaaaactttaatttgtgagtcaatcaatatgctttattattgaaagtggaatacaaaagcaagctttatttgaattttaaaaaatctgtcatactgcctgtaaaagttgtcaagtttaagcaggtaacatccaggagaacaaagtacctaagagttacttgctttatatatacttcattctcctttcgctgagtgctcttctttttttctcttaagaagtgaactttattgttgtttcatacttttatttacattttagttattttctagatgttttcctactatcctaactgcaaacagtggctttttctaaagaagcaaattagattatcatgataatggtgcacaattattctgctactgtgtttcactctgctgcacagcagaacagagaaattctaaacttctttgtagtgaggcttttatgacactaattacctctccccaacccttacaactccttctccgcaaaggagtcattatttgctctggtgtttggtttttctttaagatgaagctaattaacattacaggctattaatgaacacattcttctcaggtcttaactgggcaaatatctaaaccattatcatgttggtatcaggtaccaagcagagttttaggccatggggactctgttatgtgacaagatgaaatcaggactaatagtaatctatcttgtgaaagtctataaaatctatctttctatttctgtagttaatttacatgtttaactttggaatttgaggctgttttatacaattcaaagattgcttgctgtatctcccaattcttgtctaaaccacgactcttttctctttgtacttttgtaatttaaaaaaatttttagtcataacatctaggttttattttttttccccctccaacctataggtttggtttcaaaatcgaagagctaaatgtagaaaacaagaaaatcaactccataaaggtatgcttcttatacaaggaacatttgatagtctgagcaaagagagaagtagtgaatattactattacaatgacagaaaaaaaggaacctcaaaaatgacaatagttcttgacttaataatcttcaaaggctgttaatggagtcctaaagtttgggagtaagttacatttatttaaattttggatgcagtttagaaagataatagtccattttcaaaggaattcgttctgtcttgtaccctttggaaccctgaaaaatgctacaaacgttaacctcacattatttttctcttgtactttttacaggtgttctcataggggccgccagccagtttgaagcttgtagagtcgcaccttatgtcaacgtaggtgctttaaggatgccatttcagcaggcaagtacagcctagtttcaagctgtttttaaatatgaaaatacctgaatgtttgcttgaactgttgaacatcacctgtctctgagcccagatgtcaatgtctgcatagttggagaatcattttgagatgacatagtggacccactaccctttaaaaacctatacggtattaaaggcctgaatgcctagtcccttctgtcctcatgggaatccctgaaggggcctgggggcagtaactggtcctttaaaaatacactaaagattgcccttagagagagaggaaggaaaagccttttgattaagattttgtcaaatccaatacagaggttagtcctaaggtatttctaaggcaaccctctagatacttttctaggtattttctacctcttagtcacattaaataactctgacagaagaaaaataaacacaagtactcccagctcatacttttgttttttcgttcttttgtttttaaatctgtttctgcaaacaaagcttcatctctggtaaagagagaagtcttggtcttcccagggctgccctgcctttgcaatcccttagccataaagaaacctttaagagtacattttaaaaggacagcctgcagcaatgatttaatcctgggaaatcccagtgctctgaactccccactttccaagcctgagggcgaaatcctttcccaaccagtgtctgaccttccctatcctcagccaggacccctgcttggcatggctgtgatgtcatgaattagctctcagtctccagtgacttggaccggggagacagataggtgtgaccatgaattgagagtcggtgttagggagatcttagctctcttggtgccacaggactctggcatcctgatgcttggctttggaaacaagagagaatgactgaagaaagagggaggggtgactttaaaaggagacctttactactcaaaaggtaatctttgggccagcagcaacaacaccgtctgggagattgttagaaattcagaatctcaggccccaacctagaccttgcgaatcagaatctgaattttaacgagatccctgggtaattgttatggcaataaaggttagaagtaccgactcacaattgtgcctattgtggtgaagatggagtaacttccctgaatgacattaaaaagttgcgtagtttgcttgttgatactccgttgttttggtagtggggtaagagatgcatggcagcatcaagagaagagggtaagggtcctcacccgcagtctttccaatataccatttcagcccagttcccaggggagacggccacattcctgcagaagggggttcccggggtccggggaaataagcctaccctaagcgagtttcggagacccaggggacactggagtatccatgtggaaccccagattcagcaacaggctgagaaggtcactgtcggaacaagatgcacagccaaatgccctctccccgtgcccaaacacaacccaactctctctctggccaagctggacgccgttaatgctctgtttctattctgttgtcaccctaggatagtcattgcaacgtgacgcccttgtcctttcaggttcaggcgcagctgcagctggacagcgctgtggcgcacgcgcaccaccacctgcatccgcacctggccgcgcacgcgccctacatgatgttcccagcaccgcccttcggactgccgctcgccacgctggccgcggattcggcttccgccgcctcggtagtggcggccgcagcagccgccaagaccaccagcaagaactccagcatcgccgatctcagactgaaagccaaaaagcacgccgcagccctgggtctgtgacgccaacgccagcaccaatgtcgcgcctgtcccgcggcactcagcctgcacgccctccgcgccccgctgcttctccgttacccctttgagacctcgggagccggccctcttcccgcctcactgaccatccctcgtcccctatcgcatcttggactcggaaagccagactccacgcaggaccagggatctcacgaggcacgcaggctccgtggctcctgcccgttttcctactcgagggcctagaattgggttttgtaggagcgggtttgggggagtctggagagagactggacaggggagtgctggaaccgcggagtttggctcaccgcaaagctacaacgatggactcttgcatagaaaaaaaaatcttgttaacaatgaaaaaatgagcaaacaaaaaaatcgaaagacaaacgggagagaaaaagaggaaggaaacttatttcttaactgctatttggcagaagctgaaattggagaaccaaggagcaaaaacaaattttaaaattaaagtattttatacatttaaaaatatggaaaaacaacccagacgattctcgagagactggggggagttaccaacttaaatgtgtgtttttaaaaatgcgctaagaaggcaaagcagaaagaagaggtatacttatttaaaaaactaagatgaaaaaagtgcgcagctgggaagttcacaggttttgaaactgacctttttctgcgaagttcacgttaatacgagaaatttgatgagagaggcgggcctccttttacgttgaatcagatgctttgagtttaaacccaccatgtatggaagagcaagaaaagagaaaatattaaaacgaggagagagaaaaataatattaacacaaaaaaatgccacagacaatgatttctctgagaaattattatggcaaaactgtctggactgctgacagtaaattccggtttgcatgttacttgtattccattgatggtgtgtctcctcccacccccttatctcccatgcactcactccattttcatcttcactatgaaaaacaataccaaaagtatctggaaattgatatatatatatccatatatatatatcatatatttgccatatatatatatatatatatatatatatatatatatatatatttgccctgtctttgatcctggggaacaaaagaaaaaagtcagaaagggaaaaaattacactcattgtcctaagaagacagaggtgggcagaatatgtggggaaaggaaaaagaaaacaagaccaccaaatgaaataatgaaggtacagcgcctcgctgtgccagacacagtaggcgctcaatcagtattagttcccaccattccccttttcttgtgttccttcttgttggtttcctgaagtcctatttgaagacagtggtttatttccccctctctatcccgtcaaattcaccttaaataacacccagctagatacaggcactaggtttgtgtaagatatgttgatacacacgaacaaagtttattttgactataatgtgtggactgactttcaacatttgcattttatctcacaaaggtgtatctattcaagtaaccttttttttttgtttgtttgtttcttttttgtttttttttttcttttggttgtttgtttcaattcatgtagctatttaaactgggataccttggactaagccagtctgtatcccaattcgctagcaagcctaagtttgtggggttttgtttttgtttttgttttaccttctaatttacaagaaagaggaaaagctcttctaactgaactttggtatgcggttgagctttgtaactatttgttctccatgaaaacaaaattatttatatttgacatatttttttctagtgtattaagttattttaaacaaaagatgttatctcatgacgtgttgtcagtacaaaatgtgtcgcctccaattctgttaaaccttttaaataagtgccaagttattaattgaagacactttgcgatcaattgaatgaaaatatcgtttcatttgatggggttcgagtcatctttgttcctgttactattaaaatatccgggatagtctttcccttttgattaatgcgtatcactctctcgaatataccaacttggaaaagcgcttgcctctgctcttacgtgccgcagtcaaggggcagtaagaagggtggctctgtggctgtcgttagcgctgagcgcatttccgccggccccctccattttatccacccagcatagaaacagggttataccaaattaatgaaagaacagataagaagtaaaataacataggatagagtaacttccttccccaagatggactctcgttattcgttttgctataattccagtctttatctggggacacttttgggaggaaggaaggagggatcctgcggagcgaaatcaacctaggtttggtatggcataatcgacaatcagtcccagttcgttgaccctctctggagcggggcaggtgctgacttcggagcgggaaaagagccgcaaaggcgggcaggccagggcactgtggagggaggattccccatctgacactcctgtttagggttggctgaagcagcttcttcattggttaaatttagaaggtggaagccagaatcgggtttaggaaaagcctggccttgaaaataatgaggagctctctctccccatgtcgtggcccccttcttctggaagaaatcccactagtaaagcccaaaggtgctgcctgtgtggggatagttggagactttgaagactcggccctgaccatgtccaaggcaggaactttccttcccgcgcgggctcttgtgatgacgggaccttccgcaaagactgaaagagtcctggagcgtcccttgggaccccccaccctcgtgctggagggtgcgtaaaacccctgcctaagccccacatcctccagcagtgttccccaccacccccacttgg

SEQ ID NO: 15089 - DNA, 9811 bp, Human; identical to SEQ ID NO: 15088

SEQ ID NO: 15090 - DNA, 25736 bp, Human
tgtcaaacattggtgttcactcaattcaggagggataaagaaaggcctaagtcttatttgtgggatctgagtttaactcctgtgactgtctttttagcaacagcaaactacttaaccccttttttttcttttttttgagacagagtcttgctctgttgcccaggctagagtgcagtggcgcaatctcggctcactgcaacctctgcctcccgggttcaagcgattctcctgcctcagcctctcaagtagctgggattacaggcgcccaccactgcacccggctaattttttttgtatttttagtaaagacagggtttcaccatcttggccaggctggtctcgaactcctgacctcgtgatccacctgcctcggcctcccaaagtcctgggattacaggcatgagccaccgcgccgggacttaacctctttaaactcggccttaacctctttaaaccttatcctctttaaattggaattcctatcccgagggattgttgaaaggctgaaacaaacaaatgtattatgaaaatgtaaaagcatgcaataaactcagcaaggggtaaccatatataaaactaagtatatttctgtgcagaatatagtccctatagtcgaataggcgcaagtgttagaaacaggctctgccatggggtccctgaatctgacttctgaatgtcaagaactttttgaaatctgatgcagaatgtcgtgctcacatgtgttggtgaattcttctgcgaaaatgattcacagtttgcttcagggtctgaaatgagttcacgacccaaaataggaaggggatcggtagggcagtgtatatagcacaccattgacgtaaccattaataactccatcttaggagaagaccccatttttacatttcataaggcatttgccaacaagcatactatactttaataaacaaataaaaaaaatagtccgcatccagccaggtaaggacacaaacaagcactctcttccattaccagttctcaccacaggactctgtgactataaaagatggggccttcggcagctcccaacagccggcttaattgacgccgtctttgcagaaggacctctcggcccaaaccaggcttcttttcctcttcttcactccctctggattggttcgttaatctctttgccccatctctttttcctcatgatgttaaatgctactttgttgtgggatgcttaacttgtaacatttatatgtggattaagtacactactatgatgcgtgagcggcttgagcctgtgtgtcaggctctgactacccagtgaccagcaagtgctgagaactgcctccttgggaactccacgcagctcgtggcttttgtgatcgaaagagcgtccacagcagcctgacatggtggaaaacacagcatgcgtggacctggttatttctagcctggcaccctgatgacaggaggttaaggcttttgatttagggagagagacctgagggtaacccaaagaaaggcctcaggtcatcgcagaggagacagaaattaccggtgggcgtcccggcctgctcctcttcttcccagagctcaaactgggcagcaggcctggctttgtctcccttctaggtacccgttgggcctggcgcggtttccaagtctccctcaatttccctccagaatcccgcgctgggagcggaagcccgcggactctcaggaagacctagatttcaaatccggggcgggggagccgggccgagcctcagggcgggaccaaagcgggaggactggcgcgggacgcgagggcgggaccagggcgtgaggacgcggggcgcgggggcggggcgcgctgcggtggggcgggcgcctcctggggcccagcctggggctgggttctcgggcgggcgggagctaggggacgggccgcagcggaggcggcgcgaggggccgacaggggcgggcgggaggcggggctggcgctggagcacatctcccggcggcgggccgcggaagcagtgcagacgcggctcctagcggatgggtgctattgtgaggcggttgtagaaggtatgaggaggctgtgcggtgactgccgccctcgctccgggccgtcagccctgcccccgctccctgcgtcctcccaggccctgcgcccgcccggggacctgcccggtctggaaggcggagtgtttgttttgccacctcgcccgggcgggggcgagcagtgaagctcgcggagcgagagacttggcccggaggcgggagcctgggccggggccggggaagccaggcagcgggttaaggcttttgatttagggagagggacctgggggtaacctaaggaaaggcctcaggtcatcggaggggagacctggcccgggggcgggaggctgggctgggaccggggaggccgggcagcgcgaggccgggccggggaggccaggcagcgggaggcctggccaggggaaccgagcccggggccgggaggtcgggcacggggcaccgagctccgagggcgggagacctggcggccggccgagtgccggaaggccgggtcaggcggcggaaggcagcggcaagctgggaaacggacggcgctaccgccggcggaggagtggccccgggaagcggtgctgcgagggctggggcggccgggtgctgactgtgagatactcgccctgggggctgatccttccaattttggacgaggcttccgtctctgctgccttccatgcctggggcctggattatcccgggttgacaatgtggtttagctcttccagagagatagttgcagggtttaaactccaattccttttcggccctgcagagtttcgtgagtgctcgcagctcatacctgtggctgtgtatccgtggccacagctggttggcgtcgccttgaaatcccaggccgtgaggagttagcgagccctgctcacactcggcgctctggttttcggtgggtgtgccctgcacctgcctcttcccccattctcagtaagtggcacccaagcaggaaaccggaaaacatcgttcgcagccccctctcgcccacccacttcttttcctgcttagtcgccaagccttgtcgaccttgtaaatgtctgccagatctgtccgcgtctctctatctctgatttcagccgtctgaccacagcagcctcttccctggtctctccacttccagacccgcctgctcctttgcagtccactttttacagcacaggcagagggatctttatgaaatgaaagtctagaaagctcgtcctttgcccttaggttaaacccagcacttaatatggctaacaaacccctgcgtgtgttgggtcctgagtgcccccacccctccttatctttagcaccggttcgatttctgcacggcaatgctgaccttcatacctagtgtctgcctgcaacacctctgcactccctttctcccgccatcacatttgattagaagagctgctacttaaatttctgttttcattaaacagtttaaggttaaatcttcctatgctgtgttctttctgcagccagcattccctaagagagatgtgtcatatcctttgcagttgcttgtttactatcttccctgctagatttgcaagcaaactccaggagggacggacttggtttatcttggtatccttagtgtcttgccccaaatgcggggcctggcataacacagtgaatgcccatccattgtatttttacttttatgccctatctagaaaaagtagacctggtttaggattattcagcaaataataattagaaaagaaatggtagaggtgacatacggagtcactgaaacgatgtaaacctgcaagatagctgaaagagggccaggcaaggtggttagaccagactgtatcaaaatgggctcagccactgtgaatgtgcgtgctgtggttacataatctctaaaaatgaaatataaagcttaaatcatctctatcacagcccgatgcttggactttggttttgctttgcctttttgcaaaagaaggtttttgaaagtgaaaattattttagtgaatggatgaacagtttattggagtatggcaataaaacctgttcaaagtaagagacattagacattgtacctagttaaatcagatttgcttttgctatcctgaataaaggccttgcctcttgccatttgaagagactggcatctgatataggcaattataatgcttctttactgttttgttttcaaacctcgtttaacacaatctcctactgcttcatccccctacaaagcagtctttattttgatgaatgatatattacattgcttctggtgcctactattagatctttaagctctgccccaaagataagaagcactggtgtttgggcctaaacaaagatgggagaattcttagatttatataatattctttctctgcatgttttgttcttaccttcacatgttgcctgtagagcttctttgcattacaataatgaaatcaagctacctgatatgtattggacacggtctggcatctgccttgttgagccacttttgaataccagtgagcatcggtataagccctgaatagagatagggtttgtctcttccactgcttgatacactcagggtctagtatagtactctgcacacagttggtgttcagtaaattgttatggtgcaaatatcaaatgaataaatgctactgaatctgagttttggcagtttcagtcttcctgacagcaggatttcttcaagcggttttaaacttgaatctgattctgcaaagtagtcatccttggtgggagtgctgaggctttaaagtcatctgtaatttttataaaaaggcatccgagatcctccattttacacttatatcatacaaatcatttagatctgtgaaggctttcccattttctccttttgtccttccaaaaacaccatcttaggacttcacctggcacagggaagacagatcgtttgcacatactaagtgcccttctttctaacttgtgtcataaactcagaggctttgaatagtggagagtgctctgtactgtcttcctggtcacgtggcccttgccagaggaaaggaaaggatggtttgtttgtatagtacaatggaacttatttcaatgtattctgtatttgattttacattcctgttctcatatttttaccttaattacataacaaatattaaaagattgacttcaccaggcccagttacaatcgccagtttgataattcttatacgtactcaaatgaattcagagaccagatgggaaaagattttgataaaacctctggtacatcacaactgaagtcttttcttgtccaaactattgtgaaacagatgttctttctgtttcatttgctaaatctggaaacgtgactgcttttgagactttgtcctctctgacaggtaataaatataatcctgatatttttcaagttgtttgacagaagtgtaatctccccagaagtcctgctggacaggcttcacttttcctttggaggaacacagagatacagggaatatgttttaatgacatatacctaacgctgaacatgaaaccagttattttacttttattattattatttttagaaacagccttgctgtgtcacccaagctcaagtgcagtggtgcgatcatagctcactgcagcctccaattcctatgctcaagtaatcctcttgcctcagcctcctgagtagctgggactacaggtgtgtgccaccatgccaggctacttgtttttactttgttatagagatggggtctctctgtgttgcccagactggtcttgaacacatgatctcaaccattcctcccaccttggcctcccaaagtgctgggattacaggcgcgagccactgtgtctggcctatttcactttagaagtaaattgaatgccacatgcgaagtttgttaaatttttttaaaaaaggaaagaaaacacaaaagtaaactacctagtcgcatcagaaatgccatagtcatttttgccattttttcattcattagaattcagtgcattatgttattttgttatctctgcagtaactttctatcatgttatttattttctttgtcttatttaaagcttctgagattatggatttttgtttccttccctgaagttaagtgttatcattcctatatagtactaagctgtctacagaatagtgggagtctgccctcttgagttgggaagatcctagtttgaatcttggctgtgcgactttaaagttcattaacttctcttagcctcagtcacctgaactctgcagtggggatccttatgcctcagagtgtcattgggaggactcacgaaaatacgcttgtactttgagttcagtacctagcctgtatgagccagcattaagagggacagtcatcacgcagcgctttgcacacagctctcacgccacatcctttggctactgttttggtaaatctttactagtaaatgtttcttaaaagcatttacattcatggacatgattcagaaactaacagttgttttttaggtctcactttgagatttaaaaacccttagggcagagaccagattttatttcttacctcagagtttccctgtaggacaggaaccagcaacagcctaatgagctgattaagaattttagagatttaaaatttaaattaggattgccagttttagagactggcacataaatgttttcatttaaggcagtgactgtttcctttaggatatgattttttatctttctaagatgagatcaccatcctcagaataatttgtaccccgctgggcactagctaatggaggtgatgtcatgctaagcagcacttcagtgagttttgcgggaaccaaagctctgctcccaggagtgtggatttggtgctttcatgtggaaaaagcggatgatgacaagtagagagcaaatgtgcgcatgtctgatgctgtaaggatttcctttaccatcatataaatttttaaagtatatcaaaataaactgataactgagaaaatatatgttgttcagatactaataatgaagttaatgaagtccactatagtatttgtccctgagaaatctttatcaaatattttaaatcctattgtaaaataatgtattttttctttcagttttagagactggcaatcctaatttaacatctccttttgaattccccaccacaggcacactttcacacattcactctttaataacaggttgtttcaaattgttaatactttatagcttaatatagaaatttcactttagaaattaatttttatttctctgccttaatgctatagatgttgtagtctgctttacttcagtattgtaatgagtagttggctaaccaccatgtaaatagggagaacattctagttttttacttgtgtaggaaaacacagcttgaaatgtctaagtatctattttagagtgaagtaaatttatactgacaatatttttttgtgtttgaagacctgactgttacagcgttggtggcaagtgttaagggatccaggaactagacaagtgattctgagacctgagttccaggtttctaagtaatatcagttggtctactgagaactttgccataaacatatgtgttcagaaatttcctttcttagcagcagcatcctgaattgaacagaattacacacacatcagcccagtaagaaacaattcatgttaagtccattgctatgccaggataaatcttttaaatcacaattatttttcctatttatattttgtcaaataagaatgttctaaaaaccaaaatttctgttttcttttttttttttttttttttttgagacggagtctcactctgtcgcccaggctggagtgcagtggcgcgatctcggctcacggcaagctccacctcccgggttcacgccattctcctgcctcagcctcctgagtagctgggactacaggcacccaccaccacgcctggctaattttttatatttttagtagagacggggtttcaccgtgttagccaggatggtcttgatctcccgaacttgtgatccgcccgcctcggcctcccaaagtgctgggattacaggcaaaatttctgttttcatttaaggcagtgactatttcccttaggatgtgatttttttatccttctaagatgagatcaccatcctcagaataatttgtaccctgctgggcactagctaatggaggtgatgtcatgctaagcagcacttcagtgagttttgcgggaaccaaagctctgctcccaggagtgtggatttggtgctttcatgtggaaaaagcggatgatgacaagtagagagcaaatgtgcgcatgtctgatgctgtaaggatttcatctaccatcatataaatttttagaagtatatcaaaataaactgataactgaggcaatgtatgttgttcagatactaataatgaagttaatgaagtccactatagtatttgtatagtatttgtatattacagtactctgaaaagctggtcactatttaaagtttccattaccagtcacaaggagagaataattttatcccacaattttattgctggcaaaagacacaagtttattaaaagtcagtatttcagtgtaagagttactagactgtttgcagaagtgttcaaaagagatctttaggtccttggttgtctgtggaagctgatcagcatttaggggttcctgagcacagactgtgaaccctgcatttggcacatgcattcagagagccaatttgaggcagactgggggctagaaaggatactgccaggagctccaggttcagcttccgaagttattaagtcttatttcccagtttttaaattagacttcattttttagagcagttttaggttcaaaccaaaattgagaagaacgtacagagacatcctgtatcccacctgccccccaacacgtgcgtagtctcccccattatcaacatcctgcaccagagtagtacattcttacaaaggaacctacactgacacgtcatcatcacccaaacgccatcgttcacaatcaagttcactcttggtgctgtttatcctatggttttggacaaatttacaaggacttgtatccaccattatattgtcacactgagtagtttcactgccttaaaaagtctccgtgcgggccgggcacggtggctcacgcctgtaatcccagcactttgggaggccaaggcgggcagatcacgaggttaggagttcgagaccagcctggccaacatggtgaaaccccgtctctactaaaaatacaaaaattagcctggcatggtggcatgcgcctgtaatcccagctactcaggaggctgaggcaggagaatcgcttgaaacctaaaggcggaggttgcagtgagccgagaccacgccactgcactccagcctgagcaaggagcgaaattccatctcaaaacaaaaaaaaaaaaaaaaaaaaattctctgtgctgtctccctccctcctagccactggcaaccactgatctttttactgtctccatagttttgccttttccagattgtcagatagttggaatcatgcggtatatatggccttttcaaactggcttctttcacttagtaataatgcatttaaagtgttcatggcttgctagcttatttctttttagtgctcagtaatattctgttctctggatataccacggtttatttattcattcaccgactgaaggacatcttagttgcttctagttttgacagttatgaataaaactgctataaacatctgtgtgcaggcttttgtgtgaacataagttttcaactcctttgggtaaataccaaagagtgcgtatttaccatatggctggatcatatggtaagagtatgtttagttttgtaggaaactgccaaactgtctttcgagttggctgtaccattttgcatttccacgagcagtgattgagaatccctgttgctccacatcctcaccagcatttggtgttgatggtgttctggttttggccattctgctaggtatgtaatgatacctcattgttgctttaattagcatttcccattatttgcagtctgtgtatctttgatgaggcccactggattttcactttagattttctatagattggccataaagtcttgaaacaaagatattttctcatggattataatgcaatatcagtaaactattatgtgttcacctacgtttccagacttgttagctaccctgtactgttctctcagttaatcaagttaaccacaatttgtttctcaaccacaggtggctaatgattttgtatgtggtctgtccgctttgaattgatgtgcatggggcaagttggtctctatgatattcatggttcaaggaagttcgagatttcctggtacctaatacatgtttattgtacatatgaaagaaaaaagggcagatagaggggaacatggtactgagcatgatagaggcaaggaagggtggctactttgataggagaatacccctatttttgtcactcttgaaacagggccaagagttgaaattggctagaacaatcctgacctttgttgatattattttatagaataatatttgttactgttttctcacttttaaaaaatgcagatgttatagaaaaattagaagatatagaggaatgttaaggagtaaataaggtgtcagtaatgccatcacccagacagccactgttaataaatatgttaatatgtgaagacatactaatatgtaatatgtactgagtgactaatggcaggtcacttagtagctgtctcgattatcagatcaactgtcatggtatggcagtgtttatgttcaggtacccgtattagttattgttgttaatccctttctgcgcccaagttataaactaaactttttcataggtatgtacgtataggaaaaaatatgctgcatataggctcagtactgtatttggtttcaagcatctactgggggacttgggaggtaccccctgcccctgccccacaggtatactactgtataattattcttctatctaaagtaagatctaatggaagataggaactttgtcttgtcttccactctgtcctatttcccaggatgatacctggcacaaagtatttgtttactgacaaactaaaagatgatttatcccaattatactcacatcttcccttgattttccagaaagcctacaggaagtaagatggtagaaaagcaaagtcttcgtagaaatgcagagcatagactggctcttggagaaggtcaaacatcaccctctcctgtggttaaattgagatggtggcactggctgtcttctatattattgctgcacctttcctcaccaggggtgcacacaaaactgggagagaggggaggaaggagcttagctttgtcttaatagaagggaagaaatgatgttttccaagagaccttgaaattggggaccttggtaaaggtttcagtttgggaagataaaaaagtcctgggatggattccaacagtgtaactgtactcaatgccactgagctgtacgcttaagagtggtaaattttatgtctatttcaccacagttttaaagattaaaatttttaaaagtgggggaagttacctaggactttctagaaggacttttgagggtgagcaagttctgttataggcttgtgtattattttggtatttctgattttatcataggagtgaggttaaagttgtattttgactggaatttttgacattgtcagggtttctagagtgtggagaaggtcactcagtattttttgtttttgttttttgttttgcctttgttcttgttttcctctatttagggaggtggattgccatgggaagtacctttgcttcgaaaagccagaaaatgcctggtagaactccagaaaagtagtaaggagctggcttcttcagaggcagcatagcagagtgggaagagggccctgtcacttagattgtgactgtcgacaaagtcacttaaccaccagaagttgggttttctgacgtttagaattttgaaaagattaaaactgagtgccttgcaaagtacctggtatatattaagtgctcaataagtgatagttgctttgattctaagaactggttcaccttgtgagatataattgtgtaatggaagaatgaaagcagaaactttagtttctacttttacatttcctgggccattttactaccctaaatgagaagctgggcttccaaaacccactttaaaagtaaagactaggccgggtgcggtggctcttgcctgtaatcccagcactttaggaggcctaggtgggcagatcacttgaactcaggagtttgagaccagcctgggcaatacagcgagaccgtatgtctacaaaaaatacaaaaattagccagacatggtggtgcatgcctgtaatcccagctactcgggaggctgaggcgggagaatttgagtccaggagatcgaagctgcagtgagccgtgattgcgccgctgccctccagcctgggtgacagagtgagaccctgcctcaaaagaaaaaaaaaaaaagaataaagattaatggagatttggaacatcttgatactgtatcttgggaatctaagcattgtagaattgtgttatgtgagttataccattgtggtgggaagtttttgatttttgttttaactgtgttgagttgcagttcttagaaatgacccgaggtgttgtcttacaaaagaaataaactgtaatctgtatcttgatctgatgagggtatgtaaatataaaaaatcgagctgtatactttctatatgctttatgtagttcactatatataattcatagctcaattaaaaagagagagagaggctaaattgtatgtaccattgcaaagaaatcattatccccagaactgactcacatacacctttaacagtagagggagaactgaggtattaatttggaaaaataatcactgggataattaatataatgcagtggttttatgactgattttttattaacttctattttctttgtattctagttaataaaggtatccatggagaacactgaaaactcagtggattcaaaatccattaaaaatttggaaccgtgagtatttaaattgaattctttataatcagagaaagatggggatgtgtaataagcaaacctcgaggagtggggcaagaggaaagagagtggtctctctctcaggccagagagaccaagtgacttcctacctcagacagctgtgtggctttgcataaactgacttttcttctctgaacctcgtctttaacatggggctaaaactttcacagaactgaagggaagatgaaaggaaaggcctagtagggtgtgtgacccatagttggaaacctagtcctggaaccaaaaggacaccacaggagaggcaggactcccaagcgccggtgctttctaccctcccgaatcgctctataggattagagggtttaggtttgggaggagtttcttgacctcttgtttatgagtttttacgactaaaatgcaatgccagttttcagtccggggacaaactgcctagttatggatgaattttaccccttttttccccgtgtctttttggaatattctgcttattaatgcttccaataactagcagatggaaaaaggaaaaagataaaactcaaattcactttttaattcttgtctgttattatttatttgggatctctcgtaatactttaaattctgaaagtttatttctgaaacccagtattgttattctcggctgccctgaatattacaaactaattttattactaaacaatatgattacagaaatactattaacaagttaccactaaagatttcacaattttgtttagcaaagggatttttctagaaagtaaacttttaaaatgcagtcccattttagagagttgttgctgtcatttaaatcattttagccagtgcagtggcttgctcctgtaatcccagctacgtgggagctgtggcaggaggatcacttgaggtggagagtttgaaaccagcctgggcaacataacgagaccctgtctctacaaaaaaacaaaaaacaattagtccaccatagtgtgtgtgcttgtagtcagtcctagctacacgccagaggttacagtgaagtaagaccccatctcttcaaaaaaatcctttgaaagtgatttacacattttcctactattttttttttctttcttttttgagacaggctggagtgcagtgatctgattatggctcactgcactcctgggctccagtaatcctcctgagtagctaggactacagacatgtgccaccatgcctggttatttttgttttttatttttgtagagatgggggtcttgctgtgttgcccaggctggtctccaatgcctggcctcaagggatcctcctgcctcggcctcccaaagtgctgggagtacaggtgtgaaccaccctgcctggccctaccttttcatgtcatgcagaacaccacttcaataacaagttgcacggaagccccagacaggtttagggttgtttcgatcctttggtaagttgccctcacagtcctggctttcacagcctctgccttttattaggagtatcccctcgtggactagctatcatatgcttgtaaagtacctacctccttaggaggcacccagagcacgtggggaaggggtgtcgggagctgggagtcataagtcccatgatccatcatctgtaggactcaaaggtcaagtcacgctttcaggatttaacttcagtctgtaaatgtgaggctgttcacctctggttaaaaatcataactgttttctcacgttgactcctttaatttactacatttaatctttttccaacagtatttttggaattgtgtataatgtgagatgctcttaaggttaagtgcatgagtatatggactgtaggtgttagtgtttggtagttcctagacctgtttttgcctgactcttggtctagatcagggatcaagcttaaggcctgtttttatcaactttcgttggaatataggcacatccattcgcttacatattgtcctaagcccgtttcaccagtataattgagcagctatggctgggcacagtggctcacaactgtaatcccagcacttttggaggccaaggcaggaggatcacttgaggccaggagttcaagactagcctgggcaacatagcgagatcctgtctctaaaaaagaaaatacagaaattagctgggcatggtggggcatgcctgtctgtagtcctagctactcagaaggctgaggaaggagtatcactggagcccaagagttcaaagttgcagtgagctatgatggcaccactgcactccagcttgggtgacagagccaggccatgtctcaaaaaaaaaaaaaaaaagaatagaattgagtagctgtaacagaaaccagatggcccacaagcctaaaacacttaatatttagcccattaaaaaaaaagtttactgaccccaatctagatagcagaggtttttttagataagtgacttccagacagatattttcaattatttacaataatgcttttatatattaataaattactaatttgtttagctcatggggtttaaggaataatttatgaattgtgataaatattgtgctttgagttatatttgcattttgttgatttcccatcatttcagggtaatttttaagatttttactcttacctcaaaggataaaatatttcacaaagttaataagtaatttttaaattataaaggtatttgatgaaattttgaagaatttagaggaaaatgtaaaacatggaagttaaaagcctgaactctgaagtccaacagatgctttccttccttcttggctgtgacacaatatttgcataacctttagcacattacttagcctcacgtcaggtcattttctcatctgtataactgttgatgtgaaattgaaatgaagacagcctggtttataacattcaacaagtgttaactgttactgtgagttataaaaattgcactaatataaacagaaggcgtggtcatttctacctttgtaaagctattatttgatttctaaacagaaagatcatacatggaagcgaatcaatggactctggaatatccctggacaacagttataaaatggattatcctgagatgggtttatgtataataattaataataagaattttcataaaagcactggtatgtgtcttacataatttttaatccttttcaaatgtttgtgccatttacatttgatataatattaaaagcagtattattgaggtattagacagtaaaccgtgacacagactagctgtgaagtagagattgggcaggacctacaggtcctctgatacactgtgaacgcgtcactcttctgcccaacttcatagcctcctcttgctggcctcctatctgtatgcttggttgcctctgccctgacttctctgtagcccttgcttctttttcttctttctgcttcctctttgatcccaatggaaggttctcaaaaaaacagttaagtggtagtatttattttttccccagaaactgcaagagatatcacaagcattgccttatttaatttatgacaacctggaaagtaacgatgagattctgaaaggttaaagacctcgcgcagtcacacagtatggcggcagagctaggtctgtgtggctccaaagcccaagctctgaatccatcttctgttctgcttcacttccttgtatcctcatgtgctctgttgcctgtcttcccttaccctacgaagctccccatcttagagagacctttcttttactctgttccttttcattcctttgatattttgtctccttcccttcttccttaaattttgaatacatgtagtttaagcttgtactcttcatttgtttccattccttcttgagtctttttccattttctgtctctactactaaaactgcttgctttaaatttaccatggccttgccaccagatccccctctcgatttctgtactatgtacaacttgaatgtagtactacatttgagaatgtttttttagaaatatagataataaaatccttcacagtgccaaaaaagctaattaatatttggtgtattgttattttttcttggcagttctttttaaagcttgattttattcataacgtataagcaatgttgtcttctgcttgtttcacttaaaggaatagcatttttcatattgctgcataattttcatatctgttataatgattatataatactgcatccccaaaactaccattcacttaatttgaataatttactgtatgaatgaacattatggctgtttcccttttaaattgatgctatgataattctttgaattggcctattaatcatattagagttaatttttaattagagaagctgtagtagatctaacgtgggccagtacctatcagagtggtggtggaaatggaaggaagccagattacactgggaagatagcagggtttgtgtcagattaattataaggagtgagaagagaatagttgaaaatggagctctaaatggcatcagttttattgcttttggctataagttgagatgccaccttcaaccattaacttaaaaacacaacaccttgtttacttttgctttacgcatatttgaaaatttacttctagatattctgcctcacatttctagttaggatacctccttcctatagaattttgcactgttggctctattgtttcaaaaaccaaaaacaagcatattattccactaccaccagcacctccccccacatatttagaccagcagtctgggttttgcccagtgagctcctttcctactttgcaatgtaaaggtcaggttctcatgagatctctggcaggctggtgttgggccaggcgccatggctcacacatgtaatcccaacactttgggaggccaaggcaggaggatccttgagcaccaaagttcaagatcagtctgggcaacacagggaaatcccatctctacaaaacagaaaaaaggtagcagggtgtggtggtgcgcacctgtagtcccagctactcgggaggctgaggtgggaagatagcttgaatctgggaggttgaggctgcagtgagctgtggttgctgtactctagcctgggccacagagcaagatcctgtctaaaaaataaaaataaataaaaattaaaaggcagccaacacatcagcaccagaagccagtgaccttgtcacacagctgagataatcaacaacattttggagatacatgtagactttctgtatttaatcttcatacccatcaaatttactcaattctgagggatgtttcccaccaagatttagcattttgaaatctaagtgcatcatgcagtcaatctgtacgttaatgtggaaggttctctaaaggagtggtagaaagcccaggagccctggatacaggcccagcatagctttgtcactttggactggtttgttaactctgctacatgtcccacatctgcacaagtgaaactagtaataatatgactctcatggtgattggaaggattagagattagccatagcagaatacctgatgaacagtaataatgtttgggggttttccttgaaggcactataaatgttgtaatgctatcttaaaattgttgggaagttagagtcagagaaacgcatttcctctgagtgtgacagatgtgtgtatgtattataggatcgtattgttttctagtcttatttttttaaactgatgattttcccatggcaacattttatctgtgaaaatgacaacatagtatatcccattatataagttagtatagcttgtctaaccaaacccttattgttagacatttgtgtttttcactacctaaaccgctgtgaaagacatcattttggctataacactgatgagcttatattatgaagtatcttataagctacaaaattgaagaaattttgttcaccatgttcaaaatagttagaattctcttaccatttaaaaggaagaatttattgtggacttctgaattgctgagtagttaatttcatttcaaagtagttattctttgttttccatacaattaaaagtaattctttctgttccaaggaatgacatctcggtctggtacagatgtcgatgcagcaaacctcagggaaacattcagaaacttgaaatatgaagtcaggaataaaaatgatcttacacgtgaagaaattgtggaattgatgcgtgatggtaagaagaaacaattagaatgaacttcattgtacaattaattttatactatggtctagcaataattaaatgtataataaaatatgagaattgtggaattatactgtacataaccctaatcttacatactttagtaagaagtttaaaaaaagttatttatgccaacttcctaaaatggtttgagatgtgttgccgtgccccaggttaggttaagatgacctcttagttttagtctcagtttcttcatcatgttcccatacagtatatctgaagttgttgaataaagtcatggattttttttccttttatttgcaaatgtctttccagtttctaaagaagatcacagcaaaaggagcagttttgtttgtgtgcttctgagccatggtgaagaaggaataatttttggaacaaatggacctgttgacctgaaaaaaataacaaactttttcagaggggatcgttgtagaagtctaactggaaaacccaaacttttcattattcaggtaatgtctaactgagtgatttggttattgacgattaagcaggggttactattctcaactgtaaattatccaaaggataatttttttcctgaagctaatgaactattgttacttttcatttatttaccacttaaaagatatagagtaaattttaattttatacttatatcaaaaagactcagcataattaacatcctttttttttttttttttttttttttttgagacagagtcttgctctgtcgcccaggctggagtacagtggcgcgatctccgctcactgcaagctctgcctcctgggttcacgccattctcctgcctcagcctcctgagtagctgggactacaggcgcctgccaccaggcccagctaatttttaaatttttttttaatagagacagggtttcaccatgttagccaggatggtctcgatctcctgacctcaagtcatccgcccgccttggcctcccaaattgctgggattaaaggcgtgagccaccgcgcccggccaattaacatccatttttacatagcatttcaattttttagaactaagttatgtgttcacacacaaatttttataaataaatatttattttctaacacccaggcctgccgtggtacagaactggactgtggcattgagacagacagtggtgttgatgatgacatggcgtgtcataaaataccagtggaggccgacttcttgtatgcatactccacagcacctggtgagaacgttacacataatgaatgttacatgtggattttaaatgaattaactgtgactgatcatagaattatacaatgaaaagtgtgtttcagagactgtcaagattttgatatccctaaagatatcaaaacttgtctatattttagggaaccttcatcaaagagaagtctcaaaaagttgtctttagccaaaagtttggctagaaaatatgcatatatagccgggcacagtgactcacgcctgtaatcctagcgctttgggaggccgaggcaggtggatcacttgaggtcaggagttcaaaaccagcctggccaacctcatctctactaaaaatacagaaaaattagctgggcatggtggcacacgcctgtaatcccagctactggggaggctgaggcaggagaatcgcttgaacctgggaagcaaaggttgcagtgagccaagatcgcaccactgcacttcagcctgggcgacagagtgagactccgtctcaaaggaaaaaaagaaaagaaaatatgcatatgtagagtagactagcacgatgtcattcattggactttatcaggtagatctccgctactaatatcaggtagaatattacgtggcaacagaggccaagtcagagcttcccctgcatcttagagaagaagagaggtacgtttctcaggagttatttgaaaggtagtaaataaaaaagataaacatgactagtatacaagaggatagatgtggagtgggagaaaagaaggtaaaaaacgatacatgaatgtgccgttaacctccacgtttttactgttctgctgcacacgtcatcatctaaataaacatttgtggattataccaccatttactcacacagctaagggtgtcggagagtttggaaactttaggtaaatgtattcttaagcagtgttgcattttaaaatatgctcaatatggtttatcttatcctctaggcatctttccaagcaaagtacctctaagttaaaagcaatgggtctaatagttaacctagaaaaaaaagtatgataaatatactattttccctttttggaccaatacttggtagtgtgtttattatactttattcagatgctctgtagacaagtaggacactcaaagcaatttgtttcttggctaagtcagtattaaaataaggtgaaatctgattggaacactgtgctacttacaatgatcctttttatacatctttacttttgcatcttaccttctgcgtgtttgctcttcttgcctattgaaaggggagtccagaaagtaaaactttcaataattcagtgttcgtgaagctggtccccggccagctttgctgaaagcagggggtgtacgcatagcacacattcgtccttcagcatcatttcttctgaaaccaaaggtgtcttttttttttttatttgtatgactaataagacttatgtaagtttatgcttatttttgcctttatgactacataataatttatagaatcaactaaaatcagctatccatggtattttgcttgtattttgccttttaggttattattcttggcgaaattcaaaggatggctcctggttcatccagtcgctttgtgccatgctgaaacagtatgccgacaagcttgaatttatgcacattcttacccgggttaaccgaaaggtggcaacagaatttgagtccttttcctttgacgctacttttcatgcaaagaaacagattccatgtattgtttccatgctcacaaaagaactctatttttatcactaaagaaatggttggttggtggttttttttagtttgtatgccaagtgagaagatggtatatttggtactgtatttccctctcattttgacctactctcatgctgcagagggtactttaagacatactccttccatcaaatagaaccactatgaagctacctcaaacttccagtcaggtagttgcaattgaattaaattaggaataaataaaaatggatactggtgcagtcattatgagaggcaatgattgttaatttacagctttcatgattagcaagttacagtgatgctgtgctatgaattttcaagtaattgtgaaaaagttaaacattgaagtaatgaatttttatgatattccccccacttaagactgtgtattctagttttgtcaaactgtagaaatgatgatgtggaagaacttaggcatctgtgggcatggtcaaaggctcaaacctttattttagaattgatatacacggatgacttaactgcatttttagaccatttatctgggattatggttttgtgatgtttgtcctgaacacttttgttgtaaaaaaataataataatgtttaatattgagaaagaaactaatattttatgtgagagaaagtgtgagcaaactaacttgacttttaaggctaaaacttaacattcatagaggggtggagttttaactgtaaggtgctacaatgcccctggatctaccagcataaatatcttctgatttgtccctatgcatatcagttgagcttcatataccagcaatatatctgaagagctattatataaaaaccccaaactgttgattattagccaggtaatgtgaataaattctataggaacatatgaaaatacaacttaaataataaacagtggaatataaggaaagcaataaatgaatgggctgagctgcctgtaacttgagagtagatggtttgagcctgagcagagacatgactcagcctgttccatgaaggcagagccatggaccacgcaggaagggcctacagcccatttctccatacgcactggtatgtgtggatgatgctgccagggcgccatcgccaagtaagaaagtgaagcaaatcagaaacttgtgaagtggaaatgttctaaaggtggtgaggcaataaaaatcatagtactctttgtagcaaaattcttaagtatgttattttctgttgaagtttacaatcaaaggaaaatagtaatgttttatactgtttactgaaagaaaaagacctatgagcacataggactctagacggcatccagccggaggccagagctgagccctcagcccgggaggcaggctccaggcctcagcaggtgcggagccgtcactgcaccaagtctcactggctgtcagtatgacatttcacgggagatttcttgttgctcaaaaaatgagctcgcatttgtcaatgacagtttcttttttcttactagacctgtaacttttgtaaatacacatagcatgtaatggtatcttaaagtgtgtttctatgtgacaattttgtacaaatttgttattttccatttttatttcaaaatatacattcaaacttaaaattaccaatgtctttgagttttttgttgctgttgtttttgatgttgtgccactaattggaagttaaaatgtttttaatcagaagcttgatttggaagagtcaaagaggaagcaccagaaccctagcctagttttttgaggtggtggcagttagatcagggcagacagatcgcttatgcttcccaagtcctcgcagaagttcctgaccctgaaatgaccacaatgccaggaagatactttgtttgcatagatctcaggccttaaatatgaccatatgtgtgaatttgaaactttttccacaagataagtgtctaatgggaagaacaacctaagaggatatacaacaagccgttgatgtttactgatggcctcctctgggcgctgggattttgacagaggaatttgctgtctttttacttcatatgcttagaaaaggaatataggaaagtggggttgtgggtggttttaaatttcttccaatatttctgtaatgaaaatatattacttttaaatcagaaacaaaataaattgtcctaactaggaaaaggagacttctgtttctgaggagtagagagtagcataaatgagttctttaaggccatatgaaagcggtggttctatagtgttgaggaaaatctggcttattctagtctccctgttaagtaaagaggtttcagatacaaaggaaaagaccagcaacccaataggaaaatgagccaaggacatgaacaaacagttcacagaaaaaagaaaacccaaatgtcccttaaattcaataaacagcttgatctgcatcataataagagaaatgcacattaaagtatctgtcgtctatcagaccggcaaaaaccccagtttggtgacatattctgttggcaagatgtgggaaatgtatactctcccgttggtgggagtatgatacggtaaaatactctgtggaggggaatctgacaatacctatcaaattattctttgaagtagcagtcccatttcttggaatccagcctacccatacacctgtgtgtgtacaaaattatatatgagcttttcatcacaacgttgttttggtgttaaaaaatggcagcaactcagctgtgaagtgttccgggaagtcagggaccccgaacggagggacctgctgaggctctgacagaggaacataaattgtgaagatttcatgaacctttatcacttccccagtcaatactcttgtggtttcctatgcctgtttttgctttgatctcttggtcccgtcatcttcgtaagctgaggatgtctgtcgcctcaggaccctgtgatgattgtgttacctgcacaaattgttcatagggcatgtgtgtttgaacagtgtgaaatctgggcaccttaagaataggataatagcgatttttcagggaacaaaggaaatagccttaaagtctggctgcctgtgggccgggcagaacagagccatatttctcttattaccaaaaatgggtaagagaaatatcactgaattctttctccagtaaggaatattaataattaacagccctgggaaaagaatgcattctggggaggggagggggcctctgaaatggccgctctgggggtgtctgccttatgcagttgcagataagggatgaaacacaccctggcctcctgcaacgcccccaggcttgctaggattaggaaattccagcctggcaaattctagtcagaccagttctctgctcttgaaccctgttaagatgtttatcaatgacaatgtgagcacagtgggacatagaagttcattagtgattccagttttgccctgaccttgtgatctcaccctgaccttctgccttgtgatctttcgtcacccttgaagcatgtgatctctgtgacccacaccttatttgtacactccctcccctttgaaaattgctaataaaaacttgctggttttacggctcagggggcatcacggaacctgccgacatgtgatgtctcccccggacacccagctttaaaatttctctc

SEQ ID NO: 15091 - DNA, 193169 bp, Human
  misc_feature (1)...(193169): n = A,T,C or G
aagagagtaagttgaaccatatgaaaattgcccaatatcagcaatttcatgtggttcaacctagtatcttcagactctgacctataaagaggttagggaatccctcatagccataacttcactccaaatttagtactgaatcttttagtactatcttttatagataaagagatcctaagatagttacagctcctctatgacagcgacccctttccctacattagcccaagcactttgtgtgtgtacttccatcatggttatttacgcattgaattgaggtggtttacaatccatttcctctgctacactgagttccttgagggtggatgttttgtctgtcttgctcatttttgtatacgtagtacctagagtgaaaagtatttgttgaatataactttaagttttcttaaagttatattttttgtggaaactaaatttttattgatttgttactggagaatgtgaagtaatcactggggtttttgcattttagaatcagtcagtggagtactgcatttgacattcttggactctcaggactagttacatgcaattatgcatacaattgtctctccaccctgccccagagaaagatctgaaagtgctctcttacctatctcatctcctttaggcatttgcttaaataccaccttctccgtgctaccttcccagatcactctatttaggactgaagccattcctccaacacctctgcttatatttttttcccatagcacacataccagcatgtaatatagtttttgttttacgtattcttttgcatattatctttcccatcctgctagaatgtaagctccatgaaggcaggagtttttgtctctattttgtccactgatgtctccccatatcaagaatagtgtttggggccgggcgtggtggctcacgcctgtaatcccaccactttgggaggcccaggcgggaggatctcttgagtccaggagttccaaaccagcctgggaaacatggcgaaacagccgggtgtggtggcgcgggcctgtagtcccagctactcgggaggctgtggtggtaggatcacctgagactgggaagtcagggctccaatgagccgtgatcctgccaccgcactccagcctcggtgagagcaagaccccgtctcaaaaacaaacaaagtggcatatagaagatctataagatttgactggagtaaaatgagaaagatctaatcgttttaatgcgctgttcacacggggtttttaacttcggcacgaacgaatgaacaaaatcttttcatatggaaccaagtgtacgggtatttggggtgtgtgcagtttccgcgggacagaatgacctgtcctggtttgggtattaacttgccttgatattgaagaacctccacattcccagtggtctctaactcattgtctgaataatttcaaggtgtcccacagttggccccacgcatagcctcaatcacgatcactcgcccccctgtcccttattgatgctcccccagggcgaccccgcaaaggcctggggaccgaatggaactgccccagtccccctccttccaagagagctggggttttctggcttcggggtcagttggaaaagagattcccacccaagtcgcagggtgggagtaggggggatgagataggagtgatgaaggaagtgtgtctaaaattctaggcctcaggcccgcagctgtccctggaggcggcggggaagcggggtggtcgggtcctgcggagggctcccagggaggccacagggggaaccaaggggcggtggctgagtgcacgagtcccgcccctccatctgttggccccctactctcaaagggaagcctgggggcggggtttgtttactccgtgcacgcactgccggcccggccaatccgtggggagcggcgccaggcgtcgcacattctgagggccaatcggcgcgcactgtgctgctccgccgccaaagctcgcgcgggggaagcggggctgtagctgggcagggagagggcggacgaaatcggtagcgatctcggctgcggcgctgccgcagctgcccggcccgcggggcgcgccctgacccttcatctttgggcaggctcgagggcgcgcgcacggttggcgttctggggcctcaaactcctgggccttgaccgggcaggccgcgtctccccgggtgtgagtccaccgggacccggccgccgcctaagcgcgggcgccacagaagcggcggcgcccgaagacgcgctcctggctcggcccgacagcctcgcttggccgccagttcttctgcagccgaaggcggtaaggtctggggcgagggcgcgggcccgcgcgcggagggcctttggacccggccgggcgcgttcctgggtaggtttccctccctgcgcacaggggcccccttgttcccccacgagtcccatctgtttagacctgggttctccaggcctggccgggtaacccgtgagtgtctgggccagagtcgaaagcagaggagggtcaccctcttagtgcatagagcaaatcgggggaggtaacgtccctgagtcacgcctcgtggaagaggggaagggctgctttctactttctcgttctcttcaaagaaggatggcttctaaatctggttttccgatttttcccttctcctttcatgactcacaggcctctgtgtccaccaggtgttttgtttgtttttaaagagtttctaagctttgtgtgcttggaagaacctcatatgccccataaaggaacttttctctgaagtagaggatcgctttttgggcccagactcctttgagaaaatctggaaagccaaggtctgtcttcacaaagaagtgtaagggttttcctaggatctcgctgagagacagtacaacgaagtggatgagcgccccagtctctcttaccagcctgtgctatctcccattgtgtgatctcggtttcttcatctgtaaattagatgcatccacctattcggtgtgtttcggggagtgaatggactaatgtatggaatgcaatcgtaagaaaatcctccacgtattaaatgccttgcattagttaggcacttttattattgactgccatggatgctggtttagaaaaagaccctatattatttcccttttagtgttgagacagtgaacgggctcattccttttccatattcactgctgaagctgcctttgagcccatgaatacttttatcttttcctcattccatctcagagggcacagactccctctcacttatttgctttctttcagtaaggctctcttttagctcagccttctccttcccctgtctccccgagatctgagttttgtgtcttttcatttgacttgcacaacctacttttttttttttctgggccatgtgttttctcttcatggcttgaatttatcttcacctaataaataatttacctgttttttttttcagctcgtgaatatatattcatctattttctatatggcataatcatgtccctgtctctctttaaaagtagatataaaaatagtttaattgatctatattgcagcttccttttccatttcattgtttagcctgttatttagctaaactttatcactatcagattactgtaattaatctttaatggcagtgtccattctcagacagcaccaggagaaaaatcaaatgcctagaccccagattctgtcacacttgtgtactggctctggatgtgtttgttatttattagaacatcttgtgcctgtaactagtctagtctaagagtagacatggtgtctgtagcgttgttctggctgtgcagttgcagtttgagcactgtggcccttacatttgttaataaaaggttcaagacttactaaactcttacttttcagttctcttcatttctaggtgtttaaaaaggaaagctgaatttttgcagtgtgtaatacttcatattctcattttgtgatcatgtaattcctcccaccctgactcttgtgaatgtgtagtccaagtggcacatggaagtttttctctggcagctaaaattcttaactgtctgagccgtgtgccctcaatataactgatgaagtgggatgtacttccttgtcatcatcttttaaactcttattgcaatatgtgttataatggatctcagaagaaactagaaggcatagattgagagttcttttagatcatagaattttaaattgtagtggattttaaagagaatcaaatacactcacctcttcatacttaaatcctttccgttttaatctgggatacatgactctaggtgtgcggcatgaatagatatgaaagtaggcttgtgaactcttggaaatattatgcaaaattatgcatatttgtatattttttggagagactatttatagtgtcatagtttctgaggcaaagatatttgatcaattctttttttttttttttttgagacagggtttctctatgttgctcaggcttgtctggaactcctgggctcaagtgatcctcccacctcaccctcccaagtagctggggttataggcacacacctcgccatgtttggacaactctaatttttataaaattatttctttcactgaactagaaattgtgtcctcactgtctcttctgtattgtgggttttcaactatttgaagatacttatattccactgagtgttagaaaatattctcagtctttaacctctgctagtgacttttgtgtcattgttttcattcacatctcctcacagaactcatagcccacttgtggatttgtttagttcatccacattcttctgacaagcatggtaccccaaattaggtattaactagtatagaagactaagttacctctctaattttaaagcatgtactttaagagtagacttgcttctttggcaaccacattacactgttactttataataatttactagttaagaagattaactttggggctaaccttcctgtgtttagatcctagctctgcagtttatcagctgggtaaccctgagtaagttatgtaaacactctgggcctaagtctcctcatctctaatatggggttaataatagtgtctatcttacacaattctgaagataattaatatatatatataagtcatttagaatgggttgtggcatcccagtactatgtatgtatgatacctattttactattggtttccttgtcaactaaaattgttgaattattttgttcatgctctctctgttcttaaagtcatactctctcaattctttaatagaatattttttggtaggactttacatgtatctatatttttattttgtaagattgcttctagtctgttgacattaaaaaaatcctgatttggtcatccaataaatatcaaatctatgcatttgataaacatacaagtttgataattttggcattgctttcatgcaaatttttcactaaaatgctgtctaggcagggctgaggtcagagttctttacctgctaaagacctctcttaaaggtgataaaaaattttattattaattctttggttcaggttggtcacccaattagaaattcagctaattttaatcatcatctacctcatatgtttccaagttctcataaggaatatgtgaggaactttgacagttgccttactaaaacccagattttatatgcttcgttttctttaccctatcattacttgtccttagtgaaactatactatattccagtagcatatgttaattactacttttttgtcttttttttcggaaaaggattatttatttatttatttatttatttagagacagagtctctctctgtcacccaggctggagtgcagtggcctcctggattcaagcaattctccttctccagcctcccgagttgctgggtctgcaggcgcttgccaccatacccggctgatttttgtatgagaaaaggattttttaattcaagtaaaaatgtggaatgctttaagaatttgtgtgtcatcattgcacaggggccatgctaatctctgatttgttcccgtttagtatatgtgctactaagggagcactgattactactttttctaagtgttcacaaacttctcttagtaatgatgctagaatcatgtctaaaattacatctaacttcagtgatcaatagttggcaggatcccatttctctttttttgaacacgagtactacatttttctgtctttagtcttctggcaacctctcctgctcaccatagttcctaaatgattgccaacagctgtgtggaattttatttggagcaatataccttgttgaaggtttacttagagtagttaggaactgtcttttatcttcatgttcatattgagctttcatttcctccagttcattgataaatttattaaatgcccattttgcacaagatatcaatgcttgttttacttgagccatcggaagagaatttttcttaataaaaatgcctgaagcaaaaaggtaatgtacatctatttctctccattcctcctattgttaatattaccgtagtctgccaccattccttctttagtgtactgcagtaatagcttcctgttaaccttccttcttccagtccttttctgtctctggtccttatgtatggcagccaaagttatctttgttttaaaaatgcatgtatgttttaaaagtcgtttctgggaggtgcagtgactcacgcctataatcccagtgctttgggaggccgaggtgggcggattgctgagcccaggagctcaagaccagcctgggcaacatggtgaaacctgtctctactaaaaatacaaaaagtagtcaggcttggtggcatgtgcctatagtcccaggtactcaggaggctgaggtgggaggatctcttgagcccaggaagtcaaggctgcattgagctgtgatcgtgccactgcactccagcctgggcaacagagtgagaccctatctctaaataaataaataaataaataggaataaataaataactaagtattttctttcctagtggcataagctgtaatctaattagaatttgatttctgagcatagtactttccaactccctttttctgtttcctctttactgtccttttaaattcaaacccctccacccctgctgccccgctttttttttttttgagacagagccttgctctattgcccaggctggcagtggtgcaatctcggctcactgcaacctccacctcctgggttcaagtgattcttgtgcctcaacctcccaagtagctgggattataggcatgtgccaccacacctggctaatttttgtatttttaatagagacagggttttgccattttggccaggatggtcttgaactcctaacctcaagcaatccacctctcttggcctcccaaagtgctgggattacagatgtgagccatcgtgcctggccatagatctcattcttttttatggccaaatagtacttcattgtatgtatgtaccacattttctttattcattcatctgttaacgaacacttaggttgcttccaaatcttagctattgtaaacagtgctgcaacaaacataggaatgcagatatctcttcaatatactgatttcctttcttttggctatatacccagcagtgggattgctggatcatatggtagctcaatttttagtgttttgaggaacgtccaaattgttctctgtagtggttgtactaatttacgttcccatcaacagtttgagaaggttcccttctctgcacatccccaccagtatttgttactgtctgtcttttggatataagccattttaactggggtgaaatgatagctcattgtagttttgatatgcatttcttcgatgatcagcaatgttgagcaccttttcgaatgactatttgccatttgtatgtcttctattgagaaatgtctattcagatcttttgctcattttttaatgggattatttgatttttttcctagagttgcttgagctctttatatattctggttataaatctcttgtcagataggtagtttgcaaatgttttctcccattctttgggttgtctcttcactttgttgattgtatcctttgctgtgcagaaactttttacttgatgtgatcccatttgtttatttttgctttggttgcctgtgcttgtggggtactgctcaagaaattcttgcccagaccaatgtcctggagattttccccaatattttcttctagtagtttcacagtttaaggtcttagatttaagtctttaatccattttgatttgatttttttttttagacagggtcttgctctgttgcccaggctggagtgcagtggcttgataccagctcactgcaacctcagcctcccaggttcaagcagttcttgtgcctcagccacccaagtagctgggactacaggcatgtgccaccatgcctggctaatttttgtatttttagtagagatggggtttcaccatgttggccagactggtcttgaactcctgacctcaagtgatctgctcgccttggcctcccaaagtgctgggattacaggcgtgagccaccttgcccagcctgatttgatttttgtgtatggcaagtgatatgggtctggtttttttcttctgcatttgcatatccagttttcccagcaccatctattgaagagactgtcttttccccagtgtgtgttcttggcatctttgtggaaaatgagttaactgtaggtgtgtggatttgtttctggattctctgttctgtccattggtctgtgtgtctgtttttattccagtcccatgctgttttggttactatagctctgtagtataattgaagtcaggtaatgtgattcctccagttttgttctttttgctcaagatagctttggctattctgggtcttttgtggttccatataaatcttaggatggttttttctatttctgtgaagcatgtcattgccattttgatagggattgccttgaatctgtagattgctttgatagcagtattgacattttaacaatattgattctttcaatccatgaacatggaatatttttccatttttttggtgtcctcttcaatttctttgatcagtgttttatagttttcattacagagatctttcacttctttggttattacctagttattcaattttatgtgtggctgttgtaaatggagttacttttaaaatttctttttcacattgttcactgttggcatatggaaatgctactgatttttgtatgttgattttgtatcatgtaactttactgaatttgtttatcacttctattaataatacttttcttgtggagtctttaggtttttccaaatataaaattgcatcatctgcaaacagggataatttgacttcttcctttccaatttgggtgccctttatatctttctgttgtctgattgctctagataggacttccagtactttgttgaataacagtagtgacagtgggcatgcttgtcatgtttcagatctttgaggaaaggctttctagtttttccccattcagtatgatactagctgtgggtctgtcatatatggcttttattatgttggggtgtgttccttctatccccagttttttgagtatcttaacttctttgcaacataaatattttatttaagacctatatgtccttttgcaacatatttcatgctcttttgactttttttttttcttgagacagagtcttgctctgtcacccaggctggagtgcagtggcatgatatcggctcactgcaacctccgactcccgggttcaagtgattcttgtgcctcagcctcccaagtagctgggataacaggtatgtgccaccatgcctggctaatatttgtatttttaatagagacagggttttgccatgttagccaggctagtcttgaactcctggcctcaactgatctgctgcctcagcctcccaaagtgctggattacaaacttaacccaccacacctggcctatgttcttttgactttaaaagaaattaaatagatcttcgttcaagatggccgaataggaacagctccagtctgcagctcccagcgtgattgatgcagaagatgggtgatttctgcatttccaactgaggtacctggttcatctcattgggactggttggaccgtgggtgcagcccacagagggtgagccgaagcagggaagggcgtcacttcacccaggaagcacaagggatcagaagatttccctttcctagtcaagggaagccgtgacagactgtacctggaaaaatgggacgctctcgtccaaatactggactttccccatggtcttagcaactggcagaccaggagattctctcccgtgcctggcttggcgggccccacatccgtggagccttgctcactgctagcgaagtagtctgagatggacctgtgaggctgcagccgggttgggggaggggtgtccgccattgctgaggcttgagtaggtaaacaaagcggccaggaagctcaaactgggcggagcctacctcagctcagcaaggcctactgcctctatagactccacctctgtgggcagggcatagcagaacaaaaggcagcagaaacttctgcagacttaaacatctctgacagcagtggttctcccagcatggtgtttgagctctgagaatggacagtcagcctcctcaaggggtccctgacacccgtgtagcctaactgggagacacctcccagtagggggcgacagacacctcatacaggtgggtgcccccctgggacgaagcttccagaggaaggatcaggcagcaataattgctgttctgaaatatttgctgttctgcagcctctgctgctgatacccaggcaaacggggtctggagtggacctccagcaaactccaacagacctgcagctgaaggacctgactgttagaaggaaaactaacaaacagaaaggaatagcatcaacatcaacaaaaaggacatccacaccaaaaccccatctgtaggtcaccaacatcaaagaccaaaggtagataaaaccacaaagatggggagaaaccagagcagaaaagctgaaaattctaaaaaccagagtgcctcttctcctccaaaggattgcagctcctcgtcagcaacggcataaagctggacggagaatgactttgatgagttgacagaagcaggcttcagaaggttggtaataacaaacttctctgagctaaagaagcatgttctaacccatcgcaaggaagctaaaaaccttgaaaaaaggttatggctaactagaataaacagtgtagaggagaccttaaatgacctgatggagctgaaaaccatggcatgagaacttcgtgaggcatgcacaagcttcaaaggccgatttgatcaagtggaagaaaggatatcagtgattaaagatcaaattaatgaaataaagcgagaagacaagtttagcgaaaaaagagtaaaaagaaatgaacaaagcctccaggaaatatgggactatgtgaaaagaccaaatctgtgtttgattggtgtacctgaaagtgacggggacaatggaaccaagttggaaaacactcttcagggtattatccaggagaacttccccaacctagcaaggtaggccaacattgaaattcaggaaatacagagaacaccacaaagatactcctgagaagagcaaccccaagatacataactgtcagattcaccaacgttgaaatgaaagaaaaagtgttaaggacagccagagagaaacatcaggttacccaaaaagggaagcccatcagactaacagcggatctctcggcagaaaccctacaagccagaagagagtgggggccattattcaacattcttaaagaaaataattttcaacccagaatctcatatccagccaaactaagcttcataagtgaaggagaaataaaatcctttatagacagacaaatgctgagagattttttcaccaccaggcctgccttacaagaactcctgaaggaagtgctaaacgtagaaaggaacaatcggtaccagccactgcaaaaacatgccaaattttaaagaccatgaatgctatgaagaaactgtatcaattaacaggcaaaataaccagctaacatcataatgacaggatcaaatccacacataacaatattaaccttaaatgtaaatgggctaaatgcccccaattaaaagacacagactggcaaattggataaagagtcaagacccatcagtgtgctatattcaggagacccatctcacatgcagagacacacatgggctcaaaataaagggatggtggaagatctaccaagcagatggaaagcaaaaaaaagcaggggttgcaatcctagtctctgataaaacagactttaaaccaacaaagatcaaaagagacaaagaaggccattacgcagtggtacagggatcaattcaacaagaagagctaactatcctaaatgtatatgcacccaatataggagcacccagattcataaagcaagtccttagagacctacaaagagacttagactcccacacaataataatgagagactttaacatcccaatgtcaatattagatcaacgagacagaagactaacaaagatatccaggacttgaactcagttctgcaccaagtggacctagtagacatctacagaactctccaccccgaatcaacagaatatacattcttctcagcaccatatcacacttattctaaaattgaccacataattggaagtaaagcactcctcagcaaatgtagaataacagaaatcacaacaaattgtctctcagaccacagtgcaatcaaattagaactcaggattaagaaactcactcaaaacctcacaattacgtggaaactgaacaacctcctcctgaatgactactgggtacataatgaaatgaaggcagaaataaagatgttctttgaaaccaatgagaacaaagacacaatgtaccagaatctctgggacacatttaaagcagtgtagagggaaatttatagcactaaatgcccacaagagaaagcaggaaagatctaaaattgacaccctaacatcacaattaaaagaactagagaagcaagagcaaacacattcaaaagctagcggaaggcaagaaataactaagatcagagcagaactgaaggagatagagacacaaaaaactcttcaaaaaatcaatgaatccaggagttggtttttttgaaaagatcaacaaaattgatagaccgctagcaagactaataaagaggagagaagaatcaagtagatgcaataaaaaatgataaaggggatatcaccaccaatcccacagaaatacaaactaccatcagagaatactataaacacctctacgcaaataaactagaaaatctaggagaaatggataaattcctggacacatacaccctcccaagactaaaccaggaagaagttgaatctctgaatagaccaatatcaggctctgaaattgaggcaataattaatagcctaccaaccaaaaaaattccaggaccagacagattcacagccaaattctaccagaggtacaaagaggagctggtaccattccttctgaaactattctaatcaatagaaaaggaaggaatcctccctaactcattttatgaggccagcatcatcctgataccaaagcctggcagagacagaaaaagagaattttataccaatatccctgttgaacattgatacgaaaatcctcagtaaaatactggcaaatccaatccagcagcacatgaaaaagcttatccaacacagtcaagtcggcttcatccctaggatgcaaggctggttcaacatatgcaaatcaataaaagtaatccatcacataaacagatccaacgacaaaaaccacatgattatgtcaatagatgcagaaaaggcctttgacaaaattcaacagcccttcatgctaaaaactctcaataaactaggtattgatggaatgtatctcaaaataatagctatttatgacaaacccacagccaatatcatactgaatgggcaaaaactggaagcattccctttgaaaaccagcacaagacaaggatgccctctctcaccacttctattcaacatagtgttggaagttctggccagggcagtcaggcaagagaaagaaataaagggtattcagttaggaaaagaggaagtcaaattgtccctgtttgcagatgatatgattgtacatttagaaaaccccatcgtctcagcccaaaacctccttaagctgataagcaacttcagcaaagtctcaggatacaaaatcaatgtgcagaaatcacaagcattcctacacaccaataacagacagagagccaaatcacgagtgaactcccaatcactattggtacaaagagagtaaaatacctaggaatccaacttacaagggatgtgaaggacctcttcaaagagaactataaactgctcaaggaaataaaagaggacacaaacaaatggaagaacattctatgctcatggataggaagaatcaatattgtgaaaatggttatattgcccaaagtaatttatagatttgatgccatccccatcaagctaccaatgactttcttacagaattggaaaaaactacttaaaagttcatatggaagcaaaaaagagcccacattgccaagacaatcctaagcaaaaagaacgaagctggaggcaacatggtacctgacttcaaactatactacaagtaaccaaaacagcatggtactggtaccaaaacagagatatagaccaatagaacagaacatttacaaccatctgatctttgacaaacctgacaaaaacaagaaatggggaaaggattccctatttaacaaatggtgctgggaaaactgactagccatatgtagaaagctgaaactggatcccttccttacaccttatataaaaattaattcaagatggattaaagacttaaatgttagacctaaaaccataaaaaccctagaagaaaacctaggcagtaccattcaggacataggcatgggcaaggacttcatgactaaaacaccaaaagcaatggcaacaaaagccaaatagacaaatgggatctaattaaactaaagagcttctgcacggcaaaagaaactgccatcagagtgaacaggcaacctacagaatgggagaaaattttttttcatcagagaaaatttttgcaatctacccatctgacaaaggactaatatccagaatctaaaaagagctcaaacaaatttacaagaagaaaaaaagatcctatcaaaaagtgggcaaaggatatgaacagatacttctcaaaagaagacatctatgcagccagcagacacatgaaaaaatgctcatcatcactggtcatcagagaaatgcaaatcaaaaccacaatgagataccatctcacaccagtcagaacagcgataattaaaaagtcaggaaacaacgtgctggagaggatgtggagaaataggaatgcttttacactgttggtgggagtgtaaattagttcaaccattgtggaagacagtgtggcgattcctcaaggatctagaactagaaataccatttgacccagcaatctcatcactgggtatatactcaaaggattataaatcatgctactataaagacacatgcacatgtgtgtttattgcagcactattcacaatagcaaagacttggaaccaacccaaatgtccatcaatgatagactggattaagaaattgtggcacatataccccatggaatactatgcagccataaaaatggatgagttcatgtcctttgcagggacatggatgaagctggaaaccatcattctgagcaaactatcacaaggacagaaaaccaaacaccatatgttctcccttatagttgggaactgacaatgagaacacttggacacagggcaggaagcatcacacaccagggcctgtcatggggtgggaggctgggggagggatagcattaggataaatacctaatgtaaatgacgagttgatgggtgcagcaaagcaacatggcacatgtatacctgtgtaacaaacctgcatgttgtgcacatgtaccctagaacttaaagtataataataataaaaaagaaaaaagaaattaaacatatgtaggctaaaaggaaatatggacgtcaagaaatgacatatagttttaaggttttgatgacagaagagaaaaatgctagaagttttcccaaaggtaggaaaaataaaaacataatagttctgggcacagtggcacagcctatagtcccagctacttgtgaggctgaagtgagaggattgcttgagcccagggattcaaggctgtagtatgctatgatcctgcctatgtatagctactgctttctagcctgggcgatgtagtaagaccccatatcttcaaaacaaaacaaaaactgtaatagcaataatagtgacaatgtctgttgttagtcacagagcaggagtaccatgtctggaaaaacgattgtacttcatggaaatgctgtggctaatgatgctgttatgaacaagggatattggtatgtctggtaaattgaatatggagccagaaaagttactgtgtttgagaataaaagtgatagtacatgtctctgtcatcaaactaggaaatgtagcacagacagattttttttctttttgcttaactgtaggtatataataaagtgttctgacaaactgttaaacagagccttgatagactatgtatctaggtttgtctgttgtctttctatctacctatctatgtgttaatattaggagcttctgacttatttaatacttcttcctgtttgtataaaattaactgcagtaattaactcagattggctgtgagcaaaaacagaactattacagtaatttgacttactaatttatgtaaaacattttctgccttttaaaaatcatcttaattaatgcaagggtagagtaattatcagcccaccaactatttatttattaggattcccattgctgtaggcagaataaagcaatttttcatattgtgactaatggcaattttgattaattttgcgcaattagcttacatctatcttaagtaaccagtctgcttttggtaaaattttcatgtctgaaataggaaactctcagtttatattttctttttcttttttttttttttgagatggggtctcgctctgttgcccaggctggagtgcagtggcacggtctcggcccactgcaacctctgcctctcgggttcaggcgattctcctgcctcaggctcctgagtagctgggattacaggcatgtgccaccacgcccagctaatttcgcccacctctgccttcggtgtagctgggactacgtggaactccttcttctatatttttttcagccccactttcagtgtgcttccactgtacttagagggagttgctgttgccttcataatgcttcctccttttcttcttcttctttttttttttcttttctggagacagagtcttgctctgtcgcccaggctggaatgcagtggcgcgatctcggctcactgccacctccacctccagggttcaagtgattcttctgccttacagttgtgagccaccgtgccctgccctcaattttaaaatattcttaaaaagaaaaatcttcctcctatttttagtcccactaagccagaggtaaaaccatggtttaaaaaacaaaacaaaaccagaacacttttgaggctgggtgtggtgactcacacctgtaatcccagcactttgggaggctgcggtgggcagatcacttgaggttaggagtttgagaccagactggccaacatagcaaaatctgtctctactgaaaatacaagcagattagccaggtgtgatggcacgtgcctgtagcccagatacctaggaggctgaggcacaagaatcacttgaacctgggaggcggaggctgcagtgagccaagattgtgccactgtactccagcctgggcaacaaaaaaccaaacaaacaaactgcttttgggcctggtgcagtggctcatgcctataatcccagcactttgcagggctgagggaggcaggaggtttgagcccaggagtatgagactagtgaaaccccatatctactaaaaatacaaaaaatattagcggggtgtgatggcgcacacctgtagtcccagctacccaggaggctgaggcaggaggattgcttgaggctaggagatcaagtctgcagtgagctgtgattgtgccactggactccagtctgggtgacagggtaagactctctccaaaacatcctcaaaaaatacttgtatttgaaatttgataattcaaaaagttatacatatagtattataattacacagcttgatgaatttgtctattcatgcacctgtgccacagtgttttagttacagaagctttatagtaggttttaatgtctggtaagtctagtctcgttttgtagtttttctgttttagtactttcctgttattcttacatgtttgttttttcatgtcaatatcagcttgttcagctccataaaatggtttgttagtatttttattatcattatattgaatttataaattaacttgggagaatttatatctttataatgttgaattgtcttatccaagaatatcatatatttttctattgttcatcttcttttagtttcttttgggagtattttaacattttcctcatacggtttttttttttaaagctttattgagatacaattcacatgtcataatatccttttttttttttttttgagatagcgtcttaatctgttgcccaggctgaagtgcagtggtgtgatcttggctcactgcaacctctgcctcccgggtgcaagcgattctcctgcctcagcctcccaagtagctggaactacaggcgcttaccaccatgcccggctaattttttgtattttttctagagacggggtttcattgtgttagccaggatggtcttgatctcctgacctcgtgatctgcccacctcagcctctcagagtctcaaagtgctggaattacaggtgtgagccaccacacccagccctataacattgttttttaaaagatgtataaagatgtggttgtttagtatatttacaaatatgtgcagccatcatcactacctagttccagaacattttcatcactcttaaaaaaaccccatactcattagcagttacttcccatccccttctcttcccagccttggaaactactaatctatgttctgagtctatggatttgcctattctgaatatttcatttaagtggaatcatatagtatgtggcttggcataacattttcaaggtttatgcatgctgcagagtatatcaataatcatccctttatattgcaaaataatgtttcatatatgccatatttgtttatcagttggtggacatttggattatgtatacttttttactattttggtaatattgctatgaacatttttatacaaggttttgtttagactttttttttttttttttttgagacggagtcttgctccattgcccagacgagtgcaatggcgcgattttggctcactgcaacctctgcctcccgggttcaagtgattctcccacctcagcctcccgagtagctgggattacaggcatgtgccaccacgtccagctaacctttgtatttttagtagagatgggattttgccatgttggccaggctggtctcgaactcctgacctcaggtggtctgcccgcctcggcctctcaaaatgctgggattacaggcatgagacatcgtgcccggccagacatgtgtttttaattctttctgataggcgttacgcatttcttactacatttattactaagtattctttgttggtgttggattttctttaccattatatactccaagtgtttattaatttttgtattgatctgtattaatttgttgctaatcataaatttacttacaatttaacatatgggtccttgttgacattgtttgggagataattctttggtagacagggtgtactctcgcattttgggagcagatttctgcctatgtctcttagatcaaacttacagagttactcacattttatgtgccctgatttcagtttttgtctctttattactgagaggtgtgtattaaaattgtcttgtatgattgtggatttcttagtttctccttgtaaaatagtcagtttttgctttatatgtttataaattatgttatgaaatgtattcaaatttggattatttttgtctatttgtgtcttcctgctaaatactacctttctttaatcactatcttctttatcctcaataatattcttactctaaatacaatttgtctatgtttatagagacacgtcatcttttttcaatttgttactttctatgggtatactttaggcatgtttcttgtaaatagcaattgtattttgttttcccttttttttttttttttgagacgtagtttcgctcttgttgcccaggctggagtgcaatggcgtgatcttggctcactgcaacctccgcctcctgcgttcaagcgattctcctgcctcagcctcccgagtagctgagattacaggcgcccaccaccacatttggctaattttttgtatttttagtagagatgaggtttcaccatgttggccaggctggtcttgaactcctgacctcaggtgagccatccccttcggcctcccaaagtgctgggattacaggcatgagccaccgcgccctgcccatcttaaccatttttaagtacacagttcagtgttaggaagtacattcatattgttgtgtaaccatcaccaccatccatcttcagaacttgcatcttgcaaaactgaaacgctgtaccaattaaacaataattcccgggatcgcattaggagatatacccaatgttaaataatgagttaatgggtacagcacaccaacatggcacatgtatacatatgtaacaaacctgcacgttgtgcacatgtaccctaaaacttaaaagtataaaaaaaaaaaaagaaatagtaaatacggtaaaaaaacaaacaaacaataattcccattcctccttcctcccagccactgataaccaccattctactttctgtctctgtgaattagattactctgggtacctcatatgtggggaatcatacaatatttgtcttttgtgactggcctatttcactttgcataatgtcctcacagttcatcaatgtagcatatgtcagaatatcatgccttattaaggctgaataatactctatgtatatgttacattttgatgatccatttatctgtcagtggacacttgtgttgcttctacattttaaccattatgaataatgctgctgtgaatatggttatgcaaaaagctctttgagaccttgctttcaatttttttggagtatatacccaaaagtatatgggtatatgctacatcataaggtaattttatttttacgtttttgagaaactgccgtattattttccacagtgactgtaccactttacattcctaccagcagggcacaagtattctaatttcactacacccttgctaacacttgttattttctgtttgtttgatggtagccatcctaatgagtgtgaggtggtatctcattgtggttttgatttgcatttccctaatcattagggatgttgagtatcttttcacatgcttctttggggaaatataaatttaaatcctttgcctagttttaatttttttgtaaaagatgggatcttgctatgttgtccaggctggtttggcctgctgagtaactgggaccacaggcacaagccaccatttcctgtagtcccaactactcaggaggctgaggcaggaggatcacttgagcctagtttttaatctggttgtttgggttctttttttaaaaattgttgcattataggggttctttatatattctagatatgaaacccttatcaaatatatgatttgcaaatattttcccccattcagtgggagcatttttactctgttaatactatctttttttgtgtggaatttcaaatttttcattgtctagtatgtctgtctttttattgcctgtgcctttggtatcattctccacctttttttaagatctctttatttgtaatgttttgctgtgtctaggaaagttatttttgttttttctttaattgggagtcattgtcatttctgaatctgaggatttttagctgttacttcctccagcaacccccagtttctagagtctgtagctaggcagagacattttcttgttattcctttgctgttggttgatttttttttttaaccagcctcccctgtccattcttgcactgagaatgtgtaaaaaatggtgaaaccctcaataccagctctgcgcttcatgcagacaaggtttctgaggccttgtctactttaagggcattaaaagccaaaaatcttagttactcatattgacaggttcctccagggttgctgaaagctttactcttttgtgagctcagcatttgacagactaatttatccagcatttctagatgttttattaagatgacattttcatattagttactgtgttgccaaaaaaaaagaaagttgcatttcttttttataattaatttatttcccttttctcctctttttcctttggaattccatgtagttggacctcctggatggaagaactcttctcaagcttttctactttaaaaaaaaatttctttgttttactttgtgggagaattcctacccttcctttgcttctttctcctccccaaatcccctgcttctgttctacttcccctccctccctctctttcttttttccttccttctcttttttctttctttctttctattttgtctgttaatttggtgtctcctgttttgttatcttggcctctttatttcatgttagagattttcctcagttgtttagtaaactttggccatctgttcagattaaagaccgaatcaataaaaagctgagtaaaaactctttgtccatgggagttgttaagtgtaagccttacacagggtgattgagtgcttgcaggtcttttctcttggatcactttccctcgcagagggatctcctagtcccaggccgattgttttgcgttctggaagctggtttggggaagaggcctgaggtccactgtacagcatgtaaatcttcatttaatctttttgtgagatgatataatacacaacccttttgtgtacctagtttctatgtccttaaaaggtaaaccatttgtttcttgctgggatgcagaaggggcattttctgtctttctttcttttttgagacagggtgttgctcttgcccaggctggagtgcagtggtgtgattatagcttgtaacctcaagttccggggcttaagcagtcgtcccacctcagcctcctgagtagctaggactatggacagacatgtgccgctacactctgccttttttaaaaaatctttttgttaagatgaagtttcactgtgttgcccaggctgatcctgaactggcctcgggtattccttccactttggcttcccaaagcactggaattgtaagtgtgagccactgggctcagccagaaggggcagtttcttagctacatgggttaagactttattcaaactttcaatcaagtctttttattaacagccccaactgagattgttactttcagatggcttcaattcttaagcctttgtgatgagatatatgtaagatatattttaattatgtatatataacttataaatggtttgggaggctgaagtgggagaattgcttgaggccaattcaggaccagcctgggcaacacagtgagatcccatctcaacaaaaagttttattaaaaaagcagaatactgaccgggtacagtggctcacttctgtaatcccagcactttgggaggccgaggtgggcagatcacgaggtcaagagatggagaccatcctggccaacatggtgaaaccccatccctactaaaaatacaaaaaattatttgtatttttacaaaaattacaaaaatttgctgggcctagtggtgcacacctgtaatcccagctactggggaggctgaagcaggataattgcttgaacccgggagttagaggttgcagtaaaccgagatcttgccactgcactgcaggctggcaacacagcgagactctgtctcaaaaaaaaaaaaaaaaaaaaaagcggagtgtagtgaaacatgtctgtctgtagtcctagcgactcagaaggttgaggtgtgagatatagatacctgtaatatctataatatgttaatatataatattaatatatatcttatagataagttatataattaagatatatcttatagatacatatatctgtatgtctctagggatatagatatatctgatcatctatatataattatataggtagatacatctaattacatatacattacatcttatagatatctataagatatctgtatatataacatatatgtttttgatgggtttatccttttttatctttttaacatcattttactgtaatttttttttttttttttttgagacaaggtctcactctgtcacccagactggagtgcagcggcaagaccttggctcactgcaacctccgccttccgggttcaagcgattctcctgcctcagcctcctgagtagctgggattacaggcacgccaccactgcctggctaatttttgtattttcggtagaaacggggtttcaccatgttggccaggctggtcttgaactcctgacctcaaatgatctgcccgcctcagcctcccaaaatgctgggattacaggcatgagccaccatgcccggccaattttactgtaatttcaagaagggatggatagagacctgtgtgttcatatttaaccaaagaaccttatagtacattttaattatgttattttcatgtaaaaataatattattataaactcaggagttttttctgtgtgcatttctactaatggttattgcagtttcagaactatagaaaggcatccaaaagggcaataagagacataaagaagaggaaaaataggttaataacaaagaataggaggctcagatacatgtatcagagggactttgatgaagtaacgtcgccaccttctggcttttaaaaaaactgtgttgtttctgtaataaaatctgggaatgtgtagtcccagctactcgggaggctgaggcaggagaatcgcttgaatccgggaggcggaggttgcagtgagccaagatcgtgccacttcactccagcctggtgacagagagagactacatctcaaaaaaaaaaaaaaaagaaaagaaaaaaattctgggaacaccatgactggtaagtagctaatttgcatcctgtgtcagatttagtggatttggtgttgtttagttgttctctatactattgaagaaacatactttttttgacataggatttgattacaatataacaaagtcttttcaagccccctaagaaagggttctatctaaaatatcttaaaatatgtctgttactttaggttatttctgcttgcattaagaaaacaaatattgtttctatgtgaaggaaaatatacaatttaaaaaattaagttaatttgttgcatagatagtttgtgttcatggtacaaaatacaaatgatatgagaggccatgagtcatcctactattttgtaagaattaataaaaaagaaaagaaaattaaaatgtttttctctcagctagccagttcctttgccttgagagaatctttttatacagatggtaatgtactacacatacttctttataactttctttttttcacagaacagtttatactggaggtcactctatatcaatacacaatgagctgcctcattttttttaggccatgatgtgtttagctagtctactattgatacgcagttatgggttttccaatcttttgctatataaatgacactgtagtgagtatccatatagatatatgtgtgtgtgtgcgtgtgtgtgtatgtgtatgatttcatatgactctagaaaaagctcatagaaggatgtataaatttctatttgtgttggatatggtgacactgccctccataaaagattatgcctgtttattcttccaccactaacgtaaggcaaactctgttttccctcatgtttctcaggacaatgtattggtatcagtcttttcatcttgtcttgaaaccttattttacatttctcttatgagtgggctgaacgtatttttatatgtttagaagcaatttgtgggattttttgtttgtttctttgagatagagcttcactttgtcacccaggctggaatgcagttacatgataatagctcactgcagccttgaactactgggctcaaatgatcctcctgcctcagcctcccaaatagttgggacagcaggcacatgccaccacgattggctaatttaaaaaaaatttttttttttcggtaaagatggaatcaccttatgttgtccacactggtctcaaactcctggcctcgagcaatactcccaccttggcgtcccagagcactggagttacaggtgtaatctacaatgcccagctcatttgtgttttctgttatatattctttgcctactttttctttaggctgtcactcttctacttatttttaggagctcatagttcacaaggtagaagttaactttctatagtataagttgcagatacaatttttccagtttattttcttatgatttacatagtgatgttttctttaaatgtaaaaaaaaatgtgcattttttgtagtcatatcagtctttactttgaagacttttctgggcttggtttcatatttagaaagatcttccacactcagaaaattaaaaaatttaacttccgtgttttcttctcttaccaaaaaaattacgttgaattctatgggctatctgaaatttattttgagtgaggtataaattatggctctaactaattttttctatatgattactcagttgtcacttctttattgaaataattcacccaatgcattcatacctcactgatttgaagtgtcagctaaatttctttgtggatttaggtcttttcctatacttttctgttccctctatctgtatgctttttcacttatcagtgtatgatattttaattattgtgactttacaacttgtttaaataattggatgaggtcaatccttctgtgtttccataattttatggctattcttgcttattttaccacattaacttttgaatcagttgagcaaattaaaaggaaaagatattgttaattttattgtgattcattctattcatagattaatttgggggcagttagtattgttatgattttgcgttttgtcactcaagaacctggcatttttttccatttgttttttgtatccctatgtatttcttgctgagtttcttcctgatgtttttttcttgtttttttctatgtaaatgagttaattttttccattatgtctttacatagttgttattagaagacatggttcttgtgtataagtaagctgctaatttggggggattaattttgttatcggtcatctccagttgaatctcttggggttgctctgtaaacagttgtaatcatatgtaaataataatagttttactgcttcagttctgctttatatacttctatctttcatctggttgtgttggttagtaacctatagaacactgttaaataatagtggtgagtgataatagtagaaatcatttctttcttttatttaatgggattgtttctttagtgatgcataatgaaaaatatatccatagattcttgagaggaatttgacaaaattacatatacattcttggtaaaatataatcctattaagtaattattcatcacttttcattatttcatcattttgcatgccatagctttacataaatgggccgggtgcagttgctcaagcctgttatcccagcactttgggaggcctagggaggtggatcatttgaggtcaggagttcaagaccagcctggtcaatgtggcaaaaccccatctctaataaaaatacaaaaattgctgggcgcgatggctcacgcctctaatcccagcactttgggaggctgaggcaggtggatcgcgaggtcaggagatcgagaccatcctggctaacatggtgaaaccccgtctctactaaaaatacaaaaaatcagccgggtgcagtggcacgcgcctgtagtcccagctactcgggaggctgaggcaggagaatcacttgaacccaggaggtggaggttgcagtgagctgagatcatgccgctgtactccagcctgggcgtcggtcagagtgagactccgtctcaaaacaacaacaacaaaaattagcagggctgtagtggtgcgcgcctgtaatttcagctactcagcaggctgagacaggagaattgcttgagcttgggaggtgaaagttggttgcagtgagccgagatcgcgccactgcactccagtctgagcgacggagagaccctgtctccaaaaaaaaaaaaactttatataaacgtaatcatactgaatgtgttagtttttaaattctgttacatttataaggtttatccatgttgttgcatgttactgcaattaattaattttaatagctatttaactatagctatttaactatactctgcccagatctcttcatattagaatacccattctccacctgcttaggctcacagctgcatcccttattgggaattgcccttggccctgaatactgtcttgcccaaggttatgcttcctcccagaggtgtccctgtggccagtaactgtgtgttgcttggatataagatccaacctaacttgtctctatttgggacaactccaaagggctctggagctccatgttgtatcagctgaggccccatttgcaatatcattggttcaatttcttccctaagtccaatcctgctgccttcacttgttataggtatatctccccagagcacttcccaggaaactttctgcatgatagtctccctctcagaatctgttttggaggaatgattctaacacagttggtattggaagtgatcctaggtagcagactaaattttagagataggtttctaaattttagagatagggattttagagataggtttcttgctggctggttggcagtgaggaccccgtctctggtggtaggtagagtacagatagtgtaagtttgcactgaatttatcgttatgtgggacccaagtgagcaggtaaacttttgatgcactgttatttaaactggtatctgtagacctggttataatgttatggattttcttgagtttaagatactctggtctgtattattctattatgccttttatttatttcatttaaatcagtgagtttttagttctttgggatcaaggatcctttatgctgacttcctaccaaagtagggtttaagagaatcctcatagtgtgtgaagatctccactgttttctcgttaaccagagggaaagttggcatggttgaacttgttctctgaggtcttaatagacaggtggctgtaactgataggtgttttctttccccttctttagattgcctaggtcagactagaacctcagaaatgtctacaatgaagttttttttttttaacttcgtatttttagtagagacagggtttctctgtgttggtcaggctggtctcgaactcctgacctcaggtgttccgtccgcctcagcatcccagaagtgctgggattacaggtgtgagccttttttaaacttcatatcctaatcatatgctactccttgaaagagtcttctaaactgtatagtcaatctgtatagcctatggaagcacaagggaggacctcttctttgctcacctgcttacaaaagaattagaagccactttagctggtttaatacaatagttggattgaccgtaaagtgcttaggtttctgtgttaactcttctagtttgatggcattttcatctcatagttcttaattctgtaattttaactaattatctctattactaatttaactcgagttagaacctgattcccaccctttagctgaattagaagctgttcctttgtgcttccatagtgccccgaatatctgtctagtgtcgtagtattttagcatgttatactgtatgcatttgtcttgctcatttgtttgtgaacttcttgaagggtgggactccgttatgtctcttgggtagagcacaatgctgggtacatgatgggcattgactaaatgtttgttgaataaataaatagcctgactctcattagtccccatcacccctcagttgctggttaaaacttctgactttttaaaaattcattcaatgtgagtctttcacaaatctccctggtgaatatccataccttaaagctggcacacacacgtctagttcttttctctgtcatcataaactattgctgtctcctgcttgcagctgcctctttcattgagttcccaatatctgcagatggctctgtctgatgagctcatgggagaatttaattttccgttctacaatccaaataaattagtctgctataaccccagagctgctggtaaagcagtcgttgcagctttagaattctgatgccaaaaaggggttatatgcacagtgaatgaatagtgccatggggttatgaacagtggttgttcccatcactgcagctgcttgggtgaggcatcagaaaccccttcaagtgtactactgctacagttagctataaaggttttcccagcaccttcagctgccatggtctccacctcagttctctttacatcttattagtaaaatatcttaggaaaaagctataagcaaagatactgtgtaatagctatatggagagtttgacaaacatgctggatagttgcttacaacatttcagtcacctgattctattactaataaaatattttttactgatgacttggctggtaaatggcatgtttatctaatttatgggttcatgcttattactaatgattgcatcccttgatgtgaatctttcagtttttcttgttcatgttagaataattgcatttatctgttaagaaaacgtaacactatatcattgatatgttttctttctttttttcttttttttgagacgtagtctggctctgtcgcccaggttggagtgcagtggcgcgatcttggctcactgcaagctccacctctcgggttcacgccattcttctgcctcagcctctggagtagctgggactacaggcgcccaccaccaagcccagctaattttttgtatttttagtagagacaggatttcaccctgttggccaggatggtcttgatctcctgaccttgtgatctgcccgtctcggcctcccaaagtgctgagattacaggcatgagccaccacgcccagccttcttttttcttttcttttctttttttcttttcgatggagtcttgctctgtcgcccaggctggagtgcaatggtgcaatctcggctcactgcaacctccgcctgccaggttcaaacaattctcctgcctcagcctcccgagtagctgggactacaggcgcgcaccaccatgcccagctaattttttgtatttttagtagagacagggtttcaccatgctggccaggcttgtcttgaactcctgacctcgtgatccgcctgccttggcctcccaaaatgctgggattacaggcgtgagccgctgcacccggtctctttttcttgttttagagacagggtgttgctatattgcccaggttggagcacagtgactgttcacaggcaaaatcattgtgtagtacagcctcaaactcctgggctgtaatgatcctcccatctcagcctcccaagtagctgggactacaggtgtgtgccaccacacccagctactttaatatattttctatgttgatcaaatggtaattctatatttaatttttgtaggaattgccattctattttccacagcagtcaaactgttttttgatggccttgaaactctaaggacagcttggcaggatataatatctttggtttacatttttttcccttaagtttcttgaaagtgctgttctactgttgtcttgctttgtatgttatttttgagaaatacaatgttagtctaattcctttgcttttgtaaataatttatctttttgctcggatacactgagagttttttctttaaataattttataaggatatgtgtgagagttgatcattctgagtcagttttctcaaatatctggtaggatctttcattgtatagattcaagtattttatttctggaatgttttcttggaatgtactttttttttttgaaacagtgtcttgctctttcacccagtctggagtacagtggcgcaatcttggctcactgcaacctctaccttctgggttcaagctgttctcatgcctcagccacccaggtagctgggattacaggcgcctgccactacacccagttagtttttttgtatttttagtggagatgggtttcaccatgttggtcagctggtgtcaaactcctggcctcaagtgatccacctgtctcgacctcccaaagtgttgggattacaggcgtgagccactgcacccagccagaatgtacttttaatattagttctgttccattgttttgatttttttaattagggacaccagtaatactaatgttcaacctcctttgcctatcattcatttcaatcaatttctctctgttttttttaaaattttattttcttcattattttcttgctctttgttcagtgtcttttattaagttttcgttcagtctgttctttctacataccttataatttagtttttatttttggttcaatgccaaagtaaagcaaaataaaaaataatttaataatttaactttcatttcttatatgatgttccttttgtttgtttctttctatttctttaatcagctcttactcatttctttctgtttttgtccattttggtacttagtttttgtacttccgattcaaggtcttcttcatatcctcaaattcttgtttaaaatatttaatccagttcagaggattgtgttacagttgtttttcaacctcacggtttgtttttatggagaaaatcatcagcagaaaagcttttgtttgtattttctgactttgcagtacatttgtatgcatatggtctgcttgtttgtttttaatcattttgtggacagagttcctaatttgagagtgcttcttctgccagtgtgctctcttttgtgaaggttcttttctgaatttgtagtgatgatggtaagaaaagggggagaggaagagttgttccttgattctattaatattttgtttctgcaagctctttaatcctccccccagccccttgccttttcttcttttgagacaaggtctcactctgtcacccaggctggagtgcagtggtgcgatctcacctcactgcaacctccgcctcccgggttcaagggattcttttgcctcagcctcccgagtagctgggattacaggcacatgccaccacacccggctaatttctgtatatttttgtagagacggggtttcaccatgttggccaggctggtctcgaactcctgacctcaagtgatccacctccctcagcctcccaaagtgctgggattacaggcgtgagccactgtgcctggcctaatttcctcctcttatcgcctgtttttttcattcattaccttgtttacaagagaaagcgcttctttatatatgtatacctggttctcccccagaagcactgtttctaggaggctgctgcttctggtccagaagtttctagacacaagacacacttcaccaggtctattagctatcaagtcctaacctcctaacctctgtttagcatttttgtatttattgtttaactctctttctggggctggttttgtctgtgctttttgcaaatcccctttgcccctctgctctttctcacagagtctttttcacctcccttcactctccctatacatccacaggcttgcagaggtaaggaagtggggtttcttttgctatttgctgctttttttttttttctgcttgacttataggtaatttgaaggttgctgtgttttctgtctcctagcagtgctaatgttgatggcctagatcctttgtgggttttaaaaattcttgtggtttattttatgtttgttcagggaaggtgaggaggagaattggagtcagattacctccattgttctacaaacctggaaaggttcaaaaatctttttcgggccgggtgcagtggctcatgcctgtaatcccagcaatttgggaggtggaggcgggcagatcacttgaggtcaggagttcgagaccagcttggctaacatggtgcaacctcgtctctactaaaaataccaaattagccaggggtggtggtgcacacctgtaatcccagctacttgggaggctgaggcaggagaatcgcttgagcttgtgaggctaaggttgcagtgagccaagatcacaccatcgcactccagcctgggcaacagaacgagactctgtctcaaaaaaaaaatccttttccagatgactaattttacacctgaaaaatccaagagtcaactgaacttacagtaaaattactttaagcagtaaaagaattaagttgtgtaatggaatataaaattagtaaaaagaaaaacgtaacttatatgcatacagctaggaaaatataatggagaaccccataagttacaggaacaacagcaaaaaggaaacagagaaaaaactcaaaaccaaaaaataaaatacctaggtgtaactataatagtgtgcaaaacccattgtgttactttcctaggaccaccataacaaaatgccacaaactgggtggcttaaaacaacagaaacttatttcctacagttctgtatgctgcaagtctgcaatcaatttgtcagcagggccgtgctccctgtaaagcctctaggagaggatcctttattgcttcttccagtttctggtagccctgggcattccttggctgtggccacataattccaatctctgcctctgtctaggaaactgccttcttccctctgtctgcatctcttgtttcttttttcctcttaagagaataccagtggctggactctggctcacacctgtgatcccagcactttggaaggctgagttgggaggatcacttgaggacaggagttcaagaccagcctcggctacatagtgagactctatctctaccaaaaattttaaaaattagcccagtgttagggtatatgcctgtatacccagctacttgggagttaaggcgggaggattgcttgagcccaggagtttgaagttgcaatgagctgtgattgcaccactgcattccagcctgggtgacagagcaagaccctgtctcaagaaaaaaaaaaaaaaagttgcaaaatgaatacagagaaatcccatttacccgtagcccaacttcccccaagtggtaacatcttatgtaattgtagtacattggccaaatcaggaaattgacattggtacaatataattgactggactacagatcctacttggatttcactagtttttgcatgtgcccattttttggtgtgtctttgtgtatagttctgtgacatgttattagatgtatagattcgtatagccaccaccacaatcaagatacaaaactgttctgttactgcaagaaggtagcactattgtaacatttaacagcaatagtaaatctatcattgttaaatgaaaaaaacaacatcatagtatgatactattgaacaagactaaaatttaaaaagactaaaaacaacaaaagtgtatttctctacatgcaggtacttatatgaaaatgcatggaatgggccgggcgcggtggctcacgcctgtaatcccagtactttgggaggccgaggccggcggatcacgaggtcaggagatcgagaccatcctggctaacacggtgaaaccccgtctctactaaaaatacaaaaaattagccaggtgcagtcgtgggcgcctgtagtcccagctactcaggaggctgaggcaggagaatggcgtgaatccgggaggtggagcttgcagtgagccgagatcgcgccactgcactccagcctgagcgagagagcgggactctgtctcagaaaaaaaaaaaaaaaaaaagaaaatgcgtggaatgagctctgtgcaaggatatttaccaaactgataacaatgaagtttagaaatgatatttgaggtgttcagatgcggagattttctttatctgtatggactttttaataaccagaatgttttcatgtatctataatttaaatgtttttaaaagaatatatataagaacacaaatataaatgtcagtgaattctgttaatggtattcatctgctagttagaattgtagtggaagtggaggggcaggaattaaggaagacttgctttgtattgtattttcttctgcactgttgagtttttttttcttatgagcatatataatttttttattgaaagaatttttttatggaaggctttataggacatcttgaaaactggcagtaacagaataatgtatatgacttgcttatgtacattttcctatatatacctttacatttaaatatacatctatgcatatacatgtacctgaaagtgtctgtacaaatatcattaggttcttatctttcaatagtaagatttagagtaatttttattttcttctttgtgctcttctatagctttggattattttgtagtgagcacatacatcattcaactttcctttccctttccaaaggtgtttttaagaaggtaggaaaaaaagaaaaaaaaaacctgtatcctgcttgaaaattgagaaaaatgatgacagcttttgcagttaacctttagttagtataaaatttcacgatctccatcatatcctgtggagtctgatagggggttgtgattgttagggattttcaatatatggtacatgaaaaaaataaagtggatgaggagcatatgcaaacaaggcaattgtttatttttctataaggctttttttagtcatctaaaactatttaatactttatattcttaaacatttatacatacagataacacaaatatcctatattttttaaaaccttaaattactttaaaatgaaaactgcttaggacatgtctttttatgatatgatggaacatgtatatagtaacatttatttaaacttcattatacattttgcttctctgtgaccttgggcaagttacttaagctgactcaattttcccttctataaaatggagataactatacctttttttttttttgagacggattctcgctttgtcgcccgggctggagtgcagtggcgcgatttcggctcgctgcaagctccacctcccgggttcacgccattctcctgcctcagcctcctgagtagctgagactacaggcgcccgccatcacgcctggctaatttttttgtatttttagtagaggcggggattcaccgtgttagacaggatgatcttgatctcctgacctcgtgatccgcccgcctcggcctccgaaagtgctgggattacaggcgtgagccaccccgcccggccctattctgtagagttattttgaggaattgcttattaaataccatgatgacgctgattatacagttgtttcattttcatttgaatatagattaggtatttgtataagtacagtcgtattctaaataagcattagaaatggtgctattttcttctccaattgcttccttttgaatgccccatttttgtcatcttggaatcttttgttggtcacagtaatcacattttaatgactcagattgaacatttcatgcttgcatatagttcattatacaacagtttgtctataaacatatattaataccaaataatatttcaaaaagtcggccgggcacagtggctcactcctgtaatcccaccactttgggaggctgaggcggggcggatcatgaggtcaaaagatcgagaccgttgtggccaacatggtggaaccccgtctctactaaaaatacaaaaaaaattagccgggtgtggtggcacatgcctgtagtcccagctactcgggaggctgaggcaggagaatcgcttgaacccgggaggcggaggttgcagtgagccaagatcatgccactgcactccattctggtgacagagcgagattccatctcaaaataaataaataaataaataaaaaataaatgtcatctagcttgttttgatggttcaagtaaagataagtcttaacatttgtgatgctaatctaaagctttgttaaactggaaatgagactttgctaagcagcatatgtgtaacaggtgatctgatccatgtagtcattgtgcatgagtgaattaatggtttaaaatttgacttgtactgcttgataaaagaatgtttctattaggttcttggcagggtctcagaatgtgattttattcttagtttgtgtgctctcatctaatattgcttctttgggtagggacagaagtaagtttttgccctcagtcttttgttttcagtaattaagaacaaataatacatattgataatctgttaatattgcataatatatttgaaatgaaagtagcctttaggtgttattgtagaacatgtcaatccagttttggctgggtgtggtggcacgtgcctgtagtcccagctactcaggaggctgagacaagaggatgtcttaaggccagaaatttgagaccagcttgggcaatatagcaagacctctgtctcaatttaaaaaaaaatcaatttgccagggagtgacagaagaattctacctcagtgaatttatttggtgagatagcactctgtatccaattttcttttagtattaagctgcttgttgtcaatcactttgtcaatgtgttcacctgtaacagtgttagcccatttgctccctattaccacgtctttctgctaagtataattggctcctagcctgaaaatcaaagcacatatactaagaagtttatgctaaataaaacgtataagatgagggaaggcctaaggacttgagttactaactagtacatggttttgtgaaagctgcgttgagctctggggaattttttttgtttttcttatttctgagctgagaatcttgttacagaggtttaaggtggtttgactgctagataaatagatagtgaatagaaacttatttggtatagtcaagaaatgagtgagcatttcagttactgaagaattacaagatatggctaatattactggtttttaaagaattagaatgcaaataatttttacttaatctttggtgaatttggttctgtctttggttcagatgctgtagctctctacttaaaatcattctgaggcttcccactcatctgatttaatttttttttttttagacagagtcttgctctgtcgcccaggctggagtgcaatggcaccatctcagctcactacagcctctgcctcctgggttcaagtgattctcctgtctcagcctcccaagtaactgggattacaggcacgctccaccacatccagctaatttttgtatttttagtagagatggggtttcgctatgttgtccaagctggtctcaaacttctgagcgcaagtgatcttcctgcctcagccccccaaagtgctgggattacaggcgtgagccaccacacccggccaaatctgataaaaattttgaaaaatcagtatcctgcatggtctggcttcctacctcatctcttagcagcccgttgccttgccctttgtttttcggcacgtattattaggaccttccttagaccctggaacctcccacatacttttcttcctttgatctttccggtgctgttttctttgagtagaatatatccctctctctttgccagtggtttactcagtttgtgtgtttttttttctttttttggtgagctcagctcaaacttgacttcttcagagaagtcttctgtaaaaccaccagagttcaagtcctctattttacatgtttatatgaatctttttttttttttttttttttgagacagagtctaactctgtcggccaggccggagtgcagtggcacgatctcagctaactgcaacctccgcctgctgggctcaagcaattctcctgcctcagcctctgagtagttgggattacaggcatgtgccaccacacccggctaatttttgtatttttagtagagacggggtttcaccatgttggccaggctggtctcgaactcctgacctcaggtaatccacctgcctcggcctcccaaagtgctgggattacaggcgtgagccaccgcacccagcctgtttctatgaatcttttatgtctccatcatagcacttgtagtgactgtcattaagtagttaattgtgaaatttgtcatttaatgcatgccttcatagctgaaatataggctccatgaaggcagggactgtcattgttttccatagtatctttaaggatgagcatttaatgctcagtatctttttttttttccaaggcagagtttcactctgttgctcaggctggagtgcagtggcatgatcatggctcactgcagcctctacctcctgggctcaagggatcctcctgcctcagcctccagattagctgggaccacaggtgtgtgccaccatgcctggtgaatttttttgtattttttgagagataggatcatactattttgcccacgctagagtgaaactcctaggctcaagcagtctgcctaccagggcctcccaaagtgctgggattacaggtgtgagcccctgtacccagccaatgctcagtatttttaatacttagtgtttgacgggtagctggctatcaataagtatttatccaataagtaaatgaatgagtagtgcttagataacattattcatgtatctcattatgccattattcattattatataattctgagcttttttttgttttttttttgagacagagtctcgttctgtcgcccaggctggagtacagtggcatgatctcggctcactgcaaccaccaccttccaggttcaagtgattctcccgcctcagcctcccaagtagctgggattataggcgcttgccgccacgcccggctaatttttgtatttttagtagagacagggtttcatcgtgttgaccaggctggtctcaaactcctgacctcaggtgatctgcctgccttggcctaccaaagtgctgggattacagacgtgagccaccgtgcctggctgcattttttttttcttcaatttttaaaagtgagcaatggactgggcgtggtggctcatgcttgtaatcccagcactttgggagacttagatgggtggatctcttgagtttaggatttcaagaccagcctgggcaatgtggcgaaactccatctctacaaaaaatacaaaaattagctgggtgtggtggcatgcgcccgcacctgtagtcccaacgactgagtaggctgaggtgggaggatcacttgaactcgggaggcggaggttacagtaagttgagatcatgccactgcactccagcctgggtgacagagtgagaccctgcctctaaaataaagggagcagtgaacataaaaataagtctctttttctgtttaacgtgtaaaatgccaatggttctaggaagaacagcttttagtaaataaaagtgttttttttagaaaaattcttgcgtactatttttttctgctaaaaattaatgtaactaattgtgctctattataactttttaaaaattaacgaatacaaataaaatgctggtcccaggatgctttttgttcatgaaagaaaaatgacattcaaaacactatgtagctggccaggtgcagtggctcatgcctgtaatcccagcactttgggaggccgaggcgggcggatcacctgagtttgctagtttgagaccagcctgaccaacatggtgaaacaccatctctactaaaaatacaaaattagccaggggtgctggcgcatgcctttaaccccagctacttgggaggctgaggcaggaggatcgcttgaacccaggggccagaggtttcactgagccgagatcgcaccgttgccctctagcctgggtgacagcgagactccatctcaaaaaaaaaaaaaaaatgtagcttactgacatttcagatgtgtgatgtgttaaatgtctgcatggcctttcattttctgctgccaagtcatactgaatgggattctcgtacatttttaaaggatggaaataaataaaatactgagtctataattcatttaacaaatatttcttgagcttcaaccatatgccaggcatttgatatgtaagggtgaacaaaatgcacagggttcctgtgctcaaggaatttatactttagttggcagagacagaccacaatctgattatcacagaaataaatagacaatggcaacccagtgtgtactattaaaggagaaagtaggagagcaataggttgataccccttacctagactgggtagtagaaaacggatgtttttcccggaggaagtgacacttgagaaaggatctaaaggaagatgagtttgtcaggtaaaggttccagacagaaggaacagcatgtacagaggcccttgaggcaggaggagcacggttttgaacttacagaagccaatggaactggatcagaaaagaggtgtgggaaaggagtttaatagagctggagaggtaggcatataccacatcagcatcctagacaacattaaagatttgagtcattaaaatgtcattactgtcaccagtttagattatgaaatctaaatatctgtcagtagaggctagtcaaataaatcacagtataacgatgtaaaggaatactgtgtagctgtgaaaaaagtgaatgaggaaatttacaactgtcaagttgaaatatagagacaaatctctgagattaaaatattttatttgagaagaaaattgcaggccaggcatggtggctcatgcctgtaatcctagcactttgggaggccgaggtgggcgggtcacttgaggtcaggagtttgaaaccagcctggccaacatggtgaaaccccgtctctactaaaaataagaaaattagccatgcgtggtggcaggctcctgtaatcctagctacttgggaggctgaggcagaagaatcgcttgaacctgggagggagaggttgtagtgagccaagatcacgccactgcagtccagcctgggtgacagagccagactctgtctcaaaaaaaaaaaagagaaaggcaatttgggaaatacacacagaccatgtggtcttggctgtctgaagaacaaagaggttagaggttttataaaaaggagaaatgttacatatcactcttcaagaaagctcattggcactagtaaggttttggggagctggcaagctctgactggcatgtaatcaactttcacgcaacctactcaaaaaataaaaattcaatttaatattgaaatttcaaaaaacggaattgaaaaggagaaaaattctatggcatatgtatatgtcctatatgagattttaaaggattctttcagcatagtaggttatcattttctctgaatttattgtaataataattatatatcattttgttataatatcttgagaatatatttattatatctcaagtcagatatattttgtaaagtattatagtagttaagaacacttttgctggtgtgagatcctgagttcatattctggcactgtaatttgtacagttggttaactgggaaaattgcttgaactctctaaaactgttttgtcttctgtaaaatgaaaataatactatttatctgataaagttgaggtgcgaatgatatgatatacatgtgaagcacttgagagaatgcctagatatgctgctcacgtaagaaaaagttacatattatccctttctatgaaaatatcttctagggccgggtgcggtggctcacacctgtaatcccagcactttgggaggctgaggtgggtggatcatgaggtcaggagttcaagaccagcgtggccaacatggtaaaaccccgtctctactaaaaatacaaaaaaattagccagacgtggtggcacgcgcctgtaattccagctacttgggaggctgaggcaggaggattgcttgaatccaggaggtagaggttgcagtgagctgagattgagcaactgcactccagcctgggtgacagagcaagactccgtctcgaaaaaaaaaaaaagaaaagaaaaaaaagaaaatatcttctaattaataccacatctcaaaagtttgaatgcacagagagaatactgaaaggatttatgccaataagttattgtagttgcttctgacaagtaggattatggctgatatttgtttcttgctttttgttttgtgtattttctaaattatgagtcatgagcatgtatttaaaattagtaacatctgccatttaaatatgctacctttcctattaatttttagtagcagcttttttggcagtgttagaaagtctacacatcctgattcaaattatgttactgcttgattctacaaatttatccataactttgtgctttcttccttgtattttgattaattttaaaaggctttgtggctggagctgctaaattgtgattggaatgggaaagggcttgcattttgagaccatctgtgggagttgcattgtctgaaactgacgagatcatggcagatggcaaggtcaaaagattgactttttgagcttgacataatgtgttcatgaagctggaagaagaaatccaacttatttttttaactaacagaagagcttggtgacaggaagaagtgtgcaattgttgagtctggataaaacataatgcatcagtgcacatgactggtttatctctgagaatcatccatactgccaaagatggcaacttcttgaacctttctgtgccaaatttatttaatttctagacactttggaaagtttaagtcatacaatgcaaataatttatagattaaagacaatgtcaaaaaagacaaaaactttaaaactatttagaaatgtgtatttttaaattaaaatgctataaagtatcactcaaagccaatacagcatacttaatttttaattgaatgaagaaagtctctatcacaatcccatttgtttttacaatgtctatcttaatgtaactttatttctttaaaattacatttgaacgtttggtgattacagtctttctcatctactaggctgtcttcattgcctgagatagtgccatgcacatagtgactgttcagtatttgctggatgagtaatgaatgaatgaagttattgcctactcttgttaattttagaagagtttttttttttaacacaattaaacaggttttttttctattttgaaattgggtttatgttatggtatttttcacttctaccatgtgggaattatgtattatttattttagagaaggaagccttagtttgtcatgagaaatcaatgaacagatttttttccccctctaacattgaatgcttaacttgtgctaggcagtgtcttagtaattttacatgtattgactcatttaattaagtggctgactcttactattttagagatgaagaaattgagacacagagatgttaaggtaaatttgcttaagaaatccatgcgctttggctttatttcaaacatttattatttaggtaatacttagagattccagtttgtgctgtactctggtgtggagagtcaaaggaataccaaacaaaattgtactttgttctgtgaagctcattaatatggctatttttattggtaccctcttactatattgtgctgaaatagtaatactctgttaatttcattttatttacgtgaataacacagtgaccctcattagcccagcccttaggaaatataacatcattgagtactgaattcagaaatggagcagatgcccggagacaagcagctctagccatcacaactatgctctgggcacaaaaaaacacaaagggtggggaaaaaggacacctactagttgaatctggtagcccacaccaacaatgtctgcttatatttcattggccagaattatgttatctgtgatatggttagcccatctgagaggaaggttgacgatgtagtatttgtagttgggggcacattgccacttcagcttgtaaggaagaagaggaaaatgatattgggtaggcaatagtatttgctttggaaatatagagtgtttctaaaatgtaacatgttcaaaccatttgatggaaaagacttagtagtttttttgttataactgtatttcagcaggtcatgagatagtcttaaatttgttaaaattgaacttttttgttgttaggagtgttcagaatatgtataaactggagggcgtataaactcttaacataactctgaaacattcagtgtatcagtttttcagatgaagacatggaggctctaagaggttaggttacttgttcaggatcacacaactaagtatcagagctgagacggagccaaagtccatactctttccactctactgcactgctgctttatttattagatgctgacttcaagcaggacacttacaaccaggctgttaatttgttgattttttttctatttcattaatttatgctctttgtttcttttcatatttctttgagttctcactgttcttttacgtatttaaattgattgatggcttaatgaataaaaagaaatataaatataccctaagtactagttctgctggattttataagttttttaaaattttcattgtcatttctttctgaatattttattttttaattgttattctagttctaaatatttcacattcatggagtgtttaataatatagctaaatatatgacttttaactttctaaaaaatagttgattcctaatttaattgcattgtagtcagagaccataatctgtgtaatatttcctctctgaaatttttgcttccccttggtgatagcatatatggacaaattttataaatttgtgcctaaagagatgtttcagatctattagatacagaattctgtatagatctgttagatcaagcttggttgaaatattaatcttcaaaatgcaatacttaacattttaactttaaattattagtttgaatatgccaggtagtctgttgaatgggatatcaggaatttgtgctttattatttatcttacatttaaatttatatcactagagaggacgtaagaaataattgataaatgtagaacagatatagcataggaactttatttttagattaggtcataatagacattgtacaactactgtaagcaaaacttgtaattgtggttcaggttttacttcgatttttaaatttatgctttatcattgaaaaattacaaattcagtgttttattgaaaagcaaaagaaaggaggggggagcatcaggacaaatagctaatgcatgtggagcttaaaacctaggtgacgggttgataggtgcagcaaatcaccatggcacacgtatacctatgtatacctatgtaacaaaactgcatgttctgcacatgaaaaaaacagaaaaaaaaaaccttgcttttcttctacaaaattttacttgtagattcaaattctaacatataaggcagccatttgaagcccccatttctttgaacacccattatttatgatctttgcaaagttaagttttactttatccttccccttgaatgtcttattaaagtttaattttgagataattttaaaataagagaaaagttacaaaaataggtcaaagaactcccagatgcccttcacccagattcaccagttgtaaccattttgtcacatattctttattattctttctctgtatagtgagaccatattttgtcatcatttgagagtaagttgccaccattatacccctccactcctaaatattttagtgtattttttataagaaagaggacactcaattatagaaaactccatagtttttggaatccaaaaagatgtgaggaaaagaaaactccaagttcattgatcaaagtcaggaaatgtaacattgaaacaatactattatccagtctgtagatctaatctccaattacccaaataatggtcttcacagcagttttttttttctagttcagtgtcctgaccaagatcacaggttgaattcagttttcatatgtttttagtctttttttaaattttttatttatttaattttttttgagaaggagtctctttctgtttcccaggctggagtgcaatggcgcgttctcggctcactacaacctccacctcctgagttcaagcaattctcctgcctcaacctcccaagtagccaggactacagacacgcaccaccacacccagctaatttttttgtatttttagtagagaaggggtttcaccatgttggccaggctggtctcgaactcctgacctcaggtgatccactcgcctcagcctcccaaagtgctgggattacaggcgtgagccgctgcgcccagcagtttttagtctttttaaatctggaaagtttctcagcctttctttgccattcatgacactaacattttttgaagaattcaggccattattttgtagaatgcctctcaatttggatttctctgatatttcctcatgattaaatttagattttgcatattgggcaaacgtacctcagaattcatgctgtatccatctcagtgcgcttgaagagacacatgttggcttgccccattattggtaatcatttggtaactttgatcacttggctaaagtgatttatgccatatttctttcactagaaaatttgaattagtaggtattttgtagggagatatttcaacgctatggaaatatcctatttttcaccatattttcactgactagttttactgtgtattaattattcttttcttattagttatgatggttccaaaatggaagttttactaactgtatcactcatttatatttattagttggcgttctactgcaaagaatttctcatctccccctttagccccagtaatcctggattattattttattcaatgggtttataatctgttactatcattatgtactttggtgttcagttgttgaaaattgtccagctgtaggctctattcaatgggtttataatctgttactatcagtatgtactttggtgttcagttgttgaaaattgtccagctgtaggctctttaagctgatttctgtgtacttttgacatgtctccatcattttttgagcccttccttactttaggcacaataagatgttctaggtttatcttgtactagaatcagccatttctccaagaagccctggtgtttctttcagtggattttctaaagcagcatagcctaataccatttcaaagcccaggctccagcacttgtgaactgagttgacatggtcaaattagttaacctttctaagccctagtttttatttggaaaatggggattaagatggtacaaacctcatagtgttgttgtgaagattaatttagacagttcacttagataacaatgcatgtcacatagtaaatatgacataaatgttgcctattattattattacattactattccctctgttttcctttaacaggttgttcttttaaagaattattgaagacgaaggtttttttctttttatttttttaatggctttacagaatcttaaatagaatacagtttgacatgacggcaaaaaatgtaagtatttgtaaattttttaatgtaagtattgtttaaagtgagctgtgctttttcctacatattttctcaccattctggttaaccagatttaatttacttgcatggatttataattgtatttgtttatgtttatgcagaatatgagataagctttaatgcgattgaatatggtgccctaatggagatagtagcattcttgcaaattggcaccaagttacttctcaacagctgcaaattgctatctccagaaggtttcccaccctgccctcctcttttggatattgtaataaatttgttttggtacttgctggagggttacttggcctttttgagcaaatcactgttttctttggcttattttttttttttttttttggttactcagggaaatgtatgtgctcagatattgtctgaaagtagcttgctaccttccatgagatggttcctgaagaaacattagattttagatgttttggagaagttattcaagtttttccctctacttgaggtgatcatttctgaatatacctcctttcaagttgtatgtcactctttatttatttatttgtcactgtttattaatgagtttgtttccagttatggtaaagaattgtgccttaaagagtacaacatataggggaattatttataaattgctttactgttccaatgttatatgtattaaagtctaattgctttactgttcctatattattatgtaggaatctttgactgggaattaaacaaaaagggaatttgttataaagatgcagggatatctcaaggaatttaagagtgggaattttatgggccctcagaaagatccaggcccagaaactagaaatccagcaggaattgaagcagtatttggttttcatttctcatctctctcagcttgttactgtgtacctgcttcatttctccctctgtctgtctgtccaaatcatctttctcagttccccagccaggatggtggaacatggccccactcagcatttccatctatatgttaggggaccagcctgttcagagagaggtgtgaagaaagggaaggaggcaggccaggcatggtggctcacgcctgtaatcccagcactttgggaggccaaggtgggcagatcacctgaggtcaggagttcgagaccagcctggccaacatggtgaaaccccgtctctactaaaaatacaaaaagtagccaggcgcggtgacagacgcctgtaattccagctactcgggaggctgaggcaggagaatcccttgaacccgggaggcggaggttgcagtaagctgagattaccccattgcactccagcctgggggacaagagcgagacttcgtctcaagaaaaaaaaagggaaggaggtagcttgatgcatcctgcctgcctttctagtttcagactccttaggaggagcctctggcacagttaaagtctgatgttgactagtgctttagttagttgtgaccaggagaagcaagtgttgttgcatgaaatggctgctgagggtccagcacagtgtgtgaggaaagatgataaagggtttcttgtgagtcagaccgatagttctaaatattgcccattatgcagccgaacaatagcgttaacaaacaaatccttattgcattatgtctgtttgcttattttgggttataattcagaacattgcttttaacatgcattggtaactagaagcagatacagattttgcttcattatcatttggggacagtcatcaagatttattgagtcattaggatatgagggcaggaaagaagttagagacttctcagtatttgacttgtgtaactgggtaaatgactgtgctgtttaattagaagaggaattcttagggaggtataggatattgtgataaacttaaatattctgttttgaacatactaaagttgagaaacctaaaaacttccaagtggagatattggctaggcgatttgataagtgactctggcgctcaggggaaagcttaggaatggaggtagaaatttttgggtcatttctttttttttttttttgaaatggagtcttgctctgttgcccgggctggaatacaatggcacaatctcagctcactgcaacctctgcctcccaggttcaagtgattctcctgcctcagcctcccaagtagctgggattacaggcatgtgcaccatgcccggctaattttgtatttttagtagagacggggtttctccatgttggtcaggctggtctcaaactcccgacctcaggtaatctgcctgcctcagcctcccaaagtgctgggattataagtgtgagccaccgcgcctggcccgggtcatttcatattaaaatcattgtaaagcaatgggactacatgtgatcatatagtgagtgcatggatagcaaatatataaggaccaaggtctgagcacagggattctccaacaaaaaggtggaaagcaagagaagccataaaggacactcaaagaatgggcaaagacaggaagaaaagagttatcctgatgatctggaggcccaggtgaagaaagtgtttcaaggggaagtgatcaattgtgtcacatgttactgagaagtgactcacaaacacagaagagattgtagatagggaagagattgccctcttacagaggcattactaaccatgtattcaaatatgtacattttaaattttctcattttacatgtctctgatgacaacagtttttttgtgaagagttacttttgtcttatccatgctttattaggtctcttatagttgcaaatgatcgaaaccctatcaaaacagcttaacacaaaaagtggaatgtattgacttatataattgaaaagtctagaggctgcttcaaacacatctagattccagggatcaaacgatgatgtcaggggtctgtcttcttccatctttaggccttctgtatggtggcataatggcttgcattggcctcataatacttgtctcagaaggagagagagaacttttgtgttttaaagagatggagtctggctatgttgcccaggctggtctcaaacccctgacttcaagggatctgcctgacttggcctcccatagtgctaggattacaggtgtgagccactgcacctggcccctttttagtatttatgtttcaaaatctatggagaagtttgagttgaccttgcttaaactccgtggagatggaagtgggatacggtaagtggccaggctttgagtcatgagcccactttgagcctctaagattaattgtcttactagaactacatgagatgtaggattgatcactttgcaaaaggaagaggtgaggagctggcaacatatttattgtatctggggtgaaattgctatcaaatagtatctagtatccagtaatatttttctagaccaaaaatgcagttgtgttctaatttaagcaataatacagtaaataatttgaaatataatttttgagggttttttttttttgccttgtcaatgaatctttaagaaaaacatgtaggctgtaatactcattatggaaaaattagaaaatacagataaagaaaagaaaaaatagcctagagactgtcagcaaaattttgcttaggaagatatctgatttgtatacaaatttgtatatgtagcaatcaaaatgtatagacattggcccagcgcgatggctcacgcctgtaatccgagcactttgggaggccaaggcaggcgatacttgaggtcaggagttcgagaccagcctggccaacatggtaaaaccccatctctactaaaaatacaaaaattagctgggtgtggtggcagtgtgcctgtaatcccagctacttgggccagaggggctgaggcaagataatcacttgaacctgggaggcagaggttgcagtgagccgagatcgtgccactacactctagcctgggcaatagggactataaattgctgggtttatggacatgagccaccgtgcctggctactatttaatttctgtgatgaatgcattttcttatcttgatatctctggaacatcattttaagtgtctattttagtttagtttagtttgggacagggtcttgctctgttgccccggctggagtgcagtggcatgatcatggctcactgcagcctccacctcctgggctcaagcgatgctcccacctcagcctctccagtagcggaactacaggcaccttgcccacttaatttcttcttttctttgtagggacaggatctcactatgttccttaaggctggtctcaaactcttgggctcaagcaatcttcctgccttagcctccctaggtgctcctattacaggcatgagccatggtgcctggcctaagtggctattttatgttatttattgtatggatattacaccagtttcctaatattgaccattaagttacttctgcttttttcctttttggaacattttgtctgtttttgctcactcatcatattatctccagaagaaaaattctatgaaattactgagccaaagtgtgtataattttttagagcttttgattcatattgctaagattgcacagatttatatatatacttgtggtatatgaaagtgacatttctttttatatgtttataaatctttgccaatttaatcagcaaaaaatggtgtgcaatttattacatttctctgattactagttaagtaaactaacattctgtatgtttattggtcatttgcatttctcttttgcatatggtctgtgtcagggttgaagtgttggaagccattgccatttggatgacaacccacacttaaatattgctttggcatattaatagatatatttttgccaaattaacagataaatttacataatcatttgactcgatcctatgagctctttagtttgtcttgcacatacgttctatcattcccattttgtagtgaccgttccacgatcaccttgcctgtgaaaggtagagcttaactgagcacagatgatcttactctgaacatttcagtaatgttatgtcagtcagaaatgttgaatatcaatgaaattacaatattattagtcaatatgatctgattcttaaaaattgaacttaaatactttgaattcagtaaacgcatagtgactggttatatagtacacaacacagcattggaatacccactatagtaaccattttatatatatgtatcttataacatcatgttttataccttaaatacagacaatacaatttatttttaaaaattgagaaaaaagagaggaatactcagcatattttcctcaggacatgattaggcaaagaatttaacatgaaatatgagttcacttttttctcttgttcattgaaagataagtcctttttaaataggtagaataagggaagaatggctaatattttaggatgctttcgctagccaactttttctactctcaaataatacagtttttttgaatctttacaaaatgtttatgatagtagaaattaatacatattttgaagttttaattaaatatattttggttttatatataagctttaaatacaaacacctcccctccatctatgagactaagattagcatgcagtatggactcacaattgacttttatctttttggagtacaatttgttggttcttaagatgcaggtgtacagctgcttaaaaagtttccacattcgttggctgttttactctgcagaagttggatattaagagcaggtgtttaagcataacggtaacccagtaactgaactctctattatgaatatgtggttttagttgaggtttttgaggtttagttgaggttgtataataacaaaaaggtataaactgatccttttgaagttattataatacatgtatttaaatggttatattgtatcaagcatggaatttattaaaggctgtctttgccttctttgctttctttttaaagtagaacaccaacaagttttgcctctgtcatcttcctatagcagaagagtttaaaaaggaggggggagttattagtaatggcacaataaactcttcaacaaatcaacaagttggatatttaacattatttgtgagcaactgaagagccataacatatagttatttgttgcaaattttgttggaaagtattgtctttatttctaactgaaaagtgataagaagctggacaaagttaagtatctgcactattatctacatagaattaagaggccattttctagatgacttagtctcagctactgtcataaaaatttgatgatgatagattctagagatttgcatcaaaatcacttgttaggatatgaaaaatatgtaaaaatattactgctaacatacttcttgacagaaagaaacagctattagtagagcatttgaattcttagtagagcattgaattatcaaataatgaaataattagctcttacattgatattataaactatcaaataattgcttatgaaaaatataaatacagccaggcgtggtggctcacgcctgtaatcccagtactttgggaggccaagacgggtggatcacttgaggacaggagtttgagaccagcctgaccaacatggtgaaaccctgtctctactgaaaatacataattagctgggcgtggtggtggacgcctgtaatcccagctacttgggaggttgaggcaggagaattgcttgaacccgggacgcagaggttacagtaagccgagattgtgccactgcactccagcctgagcaacaaaaacgaaactccatctgaaaaaaaaaagaagaagaaaaatataagtagtcagtgtttagaacaataagtggatagttataaagttataaagctttgtgtgctttaaaatcttttcagattgctggagatctgatgtgctgcacagtgatgataattaatagtactgtattgtgtgcttgtaatttgctaaaaggatagatcttaaattgaatcttcgcaacacacatatacacaataatagctatatagaggtaatggatatgtcagcttgactgtggtgatcattttacaatgtatacatatatcaaaacatcaagatgtacaccttaagtgtatgccatttttatatatcaatgatatctcagtaaaggggttaaaaaatcctttccatgtggtagtgtcttgaaagtatagtttgagggctgggcgtggtgactgatgcctgtaatcccagcactttgggaagctacggtgggcagatcacttgaggtcaggagttcgagaccagcctggccaacatggtgaaaccccttctctactaaaaatacaaaaattagctgggcgtggtggcaggtgcctgtaatcccagctacctgggaggctgaggcaggagaatcacttgaacccgggaggcggaggttgcagtgagccaagatggtgccattgcactccagcctgggccacaagagtgaaatgccatctcaaaaaaaaaaaaaaaagtacagtttgaggtatcataccacaaacttgtgatgttacaagttagtgtaatgtaacaaaattgtaatgtttcaaggttacaaatcttcaatgcttacaaaaagtatttgatagtaataatagagccaatttttggatgtttgcgttctgccaagttttcaaaaattgagggttttttttcctccaggctttgtaatatatttctgatattctgtttgatgatattcctgtattcagctctgtgatgccaagtagtgtagtggatattaccttaaatgaaataaattatctaaaagtgaattcataaatacttgctgtgggtagtccctcaagtataatactgacagtaacgtatgctgacatggattgagcagtatgtgccaaatcttgtgctatatgctttacatgaattatctcatttagtctttataacaacctgaattgctaagtactggtatcaccctccaatttacagatgaggaaatgcatgacttgaccaaggccaaacccctagtaggcttgatggtccagaatatgaatccaagcagttggacttaaggccaatgtattttacttctgcattgtggtattaatggtctttatttgattcctcacatgtcatagtattgaaagcattttagatagtgattaagaatagtacaaattaagggcaacagtggggatggaattttgaaatatctattggcaacttcatggctgccacattacttacttgctttcaaagaactgtcagtaaaatctgtaaaatctcagttctgctcataagtaatagtatttcattaatttttatcttaagctggacaattcatattcccctcaccttttttttttttgagacagggtctcactctgtcatccaggctggagtgcagtggcatgatctcagctcactgcaacacctctgcctcccaggctcaagcaatcctccgacctcagcctcccaagtagttgggactacaggcaatattcttccccttttaaataatatgtcaacatttcattttaaaataatactcctgtggttaatataattaattcatttgatgtggctatatatatttgatatggatgtctgatggaagatataaaatagcttgttaagtgaacacatactacttaatattctatttttaactttttaaacggttttattcaggttggtttgacttccacaaatgcagaagtaagaggatttatagatcagaatctcagtccaacaaaaggtaaggattattgaataaaatttttctgaattaagttagttttattgcatttgttttgtaaaatatgcagctacatgaattactttatgtataataattttatgatattagcacgttgttccatgccacataacttgtgctgtatgaaagtcatttacctctgacagacggaggatttttgtgtgtgatttttctctttcctaagagatctctaagatcccttatcaatgatcttattacaattgaaactgttcagaccacttttttcttgattttcttgtttgacaatcctactttcaaatggtttaagttgtaaggaagtacagtagagaaaatacatatatatgtgttttgtatattttatatacgtgtgtatgtgtgtatttctttgactaatatatgtcttactggaagaatgcttatatcagaaatctggcccactggcttggtgcagtggctcacacctgtaatcccagcactttgggaggccgaggcagaaggatcacttgagcccaggagtttgagaccagcctgggtaacatagtgagactctgtctttacaaaaacttagccgggcatggtgatgtgtacctgtagtcccagctattcaggaggccagtgtaggaggattgcttgagcctggaaggttgaggctgcagtgagccataatcatgccactgtactccagcctgggtgacagaatgagaccttgtctcaaaagaaaaaaaagtattctgacccaccagtacaagaacttacacaggaaccagcagtatctttcaatatgtctctttgaacaatatcttgtggtatatagagatacatgctgaaatgtctacggatgaaattatatgatgtctggaattggcttcaaaataatccactaggagaaggagggtaaagtgggtggtattatagataaaacaatattgtcttaagttgattatttgtttaagttaggtaatatttctgtggggtttcattattcctttcctttctcttttgtgtatatttgaaatttttcattataaactgtaggaaaaagatctattacaatacaaatagctatgagagaaacatcagcttccttaaagggtttatgtctaaggtgggagacgtactctagagcagaggtccccaattcccaggctgtgagctcatggcctgttaggaaccaggctgcatagcagaaggtgagcggccagcaagtgagcattagattctcataggagggcgaaccctattgtgaactgcacatgggagggatctgggttgtgcagtcctttagagaatttaatgcctgattatctgaggtggaacagtttcatcctgaaaccatccatctctctccacccccatccatggaaaaattgtcttccacgaaactggtccctggtaccaaaaaaggttggggaccactgttctagagagcaggctagagacatctatattccaatataaaaatgtctagcttattttattttatttttttttggtggcagagtctcactctgttgcccaggctggagtgcagtggcatgatcttggctcactgcaacctccacttcccgggttcaagtgattctccttcctcagcctcccaagtagatgggattacaggcacatgccacaatgcctggctactttttgtatttttggtagagacagggtttccacggtttcaccttgttggccaggtttaagccaccacacctggcctagcttaataatagtaatagtctgtgggaatgattctgagagttaaggtatgtattatgaggccatttaagagatactttaagcctcaatgctcctcattttttttcccacatgacaacattcatagaaaatgataacatttgtgggatgcactagggctaaacaaaaaggctgcttaaggtcaggattaagctacctagaagcttcagctgcccgaggccactccagactgccgtgagggctgagggactccattcttttgtatacccatagcttattcacaacacgtaactgggaatctctgctctaataaaacgtagtaatcaggtcaggggaaggaagtgggaacaacaagcttggtagacatggaagacatattgagtattgcaataatgagaataatggaatgatgcagcaaccttgaaaataaagagaggatagcaagtcataaaggggaaaagtgacatggaaaaatgcttttggctgggcatggtcgctcacacctgtaatcccagcactttggggggccaaggtgggcggatcacctgaggtaaggagtttgagaccagcctgagcaacatggtgaaaccctgtctctactaaaagtacaaatattagccaggtgtggtggcaggtgtctgtaatcccagctactgcggaggctgaggcaagagaatcacttgaacccaggaggcggaagctgcagtgagctgagatcatgccattgcactccagcctgggcaacagaatgagagtctgtctccaaaaaaaaaaaaaaaggaaagaaagaaagaaaaatgcttccaaaagacagaagacaaagaaagagaatgggggtttaggtgagaaagattgtctttgatggtagaataggcatctgaagggtaagtactagttataaatgttagccctggacagatgttaacaccagtaaagtttagttacagagtaaaacctcagtttgtttaactttatagaacaaatggagaggaagacagagaatcatttaagagtggactagagagatcagattttgaaatagctatatgcatgtgtttgtttttgagacagggttttgctatgcccagggtggttttgaactcctggagttcaaacctctggagtagctgagactacaggcatgtgtcactgcacctggctgaaataattatatgttttaaaagaaaactgttgctcttctttgagctgttagctagtaacagcagaaggaacttcacattaagtgaaccaacaagatttggaagagatttcttttaattggtaaaattcagttaatatttgttacaggcccaagatgagagttgtattggaagtgagatgtagaaaagtatttttcttaattgaaatgatgatgtagcaatgatattatagaaacttttgaaaaatagaaaaaaaattctgcctttctaatacaaccttttcttttttgtaatttttcataattatttatataactatgttttaaagttataaaactggtaagtattatagttgtctattttccttttttgactgaatctaaaaaacacactttgcatgttttcacatttataaatacctttcttagagcttcatactgtttcattgtgcttatgagtaatgatttattaaacattttttcatttccttattgttggatatttgtcttttttgttggttatatatgatgcatatatatttctatatatgatataaacctatgatgttggacatcataatgaatctttaatcagctaagtttttgtttctttttatttattaagataagtactcagaagtgcagttactgggtcactcccctgcctaattaaacccttttaagcaacttcctatttaaattaaaataaaatcccaaatcccttacctgcaacaccctgaagttaggtcctgaagttaggttcatttttttcctaccatttttcctctgtgttcttcacatatgacaattttcattaatctgtcttcaagttagcttattttttttcagttatcactattctattaatcctagccagtgattttttttttcagacgttgcatttttcagttcgagaatttccattgggttctttatgttttttttttttctactgaggagagagggtgaaagcacaaatgcaagagcattgacaaagaaattgtagaatgttagagcagcactgaactcaattgaggttaaatatcttaaaccctgctggacgcagtgactcacacctgtaatcccagcattttgagaggctgaggggggtggaacacctgaggtcaggagtttgagaccagccttaccaacatggtgaaaccctgtctctactaaaaaatacaaaaattagctgggcatggtggcgggcacctgtaatcccagctgcttggggaggctgaggcaggagaatcgcttgaaccagggaggcagaggttgtagtgagccaagatcacgtcattgcactccagcctgggtgacagagcaagactccgtcaaaaaaaaaaaagatattaaatccaggaggtcgactacttttgtccagcagcactgataagaaagatagctggtctgggcacagtagctcatgcctatgatcccagcaccctgggagactgaggtggaaggatttcctgagtccaggaatttgaggctgcagtgagctatgattgcacaattgcattccagcctgggtgacagagcatgaccctgtctcaaaaaaaaaaaaaaagaaaaaaaaaaagacctggcgcagtggctcacacctataattccagcactttgggaagttcgagcccccagcctaggcagcatgatgaaaccctgtctctactaaaaatacagaaattagccaggtgtggtggcgcatgcctgtaatcccagctactcgggtggcagagacacaagaatcacctgaacccgggaggtggaggttgcagtgcgtcaagatcacgccaccgcactccagcctgggggatagagtgaaactctgtctcaaaaaaaaaagagaaaaaagaaaaaaaaaagatagctggactgctccagggtttcgttatatccagccagtactacagaagggaaaacagtatagatgtgagacacatataaagattgttttgtggcaagaaatgagacctgagaggtaggccacattctttcattgattcagcaaatatttattgaatagtacttacttactatgtgccaggcatttttctaggtgctaaggataaacaaggaatagaacaaagtcccttccctcatggagcttacattctggtgaggaagatagattacaaacacatacacataaaaaactggttatgtgaaaaaatctgtatatcagggtataggactgaggatacaacagcaaggagattcagctttagatggggtgggtcagagaagaatgcactgaggaagtaacaatgtagcagaggaggtgactacacagtagagacctagataataaagttattactcataatctgtaatgctaattagactgcgacttaatgaatcagtaaagaagtatgcaaaataggctgggtgccatggctcatgcctataatcccaacactttgggaggccaaggggggtggattgcttgagctcagcagttcaagaccagcctgggcaacatggcaaaaccccgcctctacaaaaattacaaaaaaattagctggtatggtggcgtgtacctgtagtcccagcttctctggaggctgaggcaggaggatcacttgagcctggaaggtggaggttgcagtgagctgagatcgtaccactgaactccagcctaggtgacagagtgaggccctgtctcaaaaaaaaaaaaaaagaaaagaagtatgtgaaataataagaaatgcagtcatgtgctgcataatgatgtttcagtcaataatgaatggctatccagtggtggtcccataagataatagtctgtttttactgtaccttttctatgtttagctatgtttaggtacacaaatacttaccatgtgttacagttgcctacagtattcagtacagtaacatgctacacatttaggtttgtgtaagtatactccatgatgtttgtacaacaatgaaatcacctaacaaagcatttctcagaacttatccccattgccagttgacacatgactacatatattagtctctgctcctactctctggcacagaactcttacaacccttgtaatttcctgaatgataggggtgctaggagaatcatttgtcatatcatttgatcgctgccctgattcctgagacagagttcctaatacccttgtagataggagtactaggagtatcttttgttgtaatatttggtctttgaccccagttcctgacacagaactcctaagacctttgtaatttcctgagtggtaggagcatctgatacagagctcctaaatccctcaggatttcctgggtaattaggagtgacttttgtacaaatgaggtgacccttggtggactcctggatgggggctagtcaccagaaagataaagtcacgattgtaagcttgaagctttcagctctaccctctatccattggagatgggagaagggctggaaattgagttaataattaatcatacctctgtgatgaagcctccataaaaatccctgaactgtaaggtttggagagtttccaggttggtgtagacacccatgtgtcaggagggtggcacaccccaactctggggacagaagcttctgagcttggagcccttccataccttgccctatgtatttcttcatctggctgttgatcttgttcatctatgtcctttgttatatcctttaaaaattaactgataaacataagtaaagtgcttcccttttgctagagttctgtgagccactctagcaaattaatcgaacctgagtagggagtttgaggaaccccaatttatagctggttggtcagaagcagaggttacaacctggtgcttgcaactggcatgtgaagtgggggacagtattatggctctgagcccttaaccagtgggatctgatgcgatctcctggtagggtcagaatttattttttgctagtagggagaaatccccacacattttggtgaccagaggcagtgttttgtgttaaatggtgtacaagagttggaaaaacactttggttttttttcccattcttaataaagtgataccatcagaaagagaaccctagaagcagaatgtagacaaaactagaagtggaggtgatcctgaagagagagaggcagtaagttctcagaagttaccaccaaatccaggtgaaaaagaacaagggcggaagatagtggcagaagggaagggaaagaaatgataagcatgaataatattttaaaagtagatttggtgactgaggtttggtcacctcagtcagaggcaaggtactaatcaaggtagattgctgggatcacagtttgattgattgagtagataatgggtagagatttcccatccattctctgttttaccagcagaacccttttcccaagtaaaatcttacatggaatccaatatatcagttagacaaaatgaggctaatgtgggtggagcttcctgaggttattagcaatacttctaatgggaagtaggacaagaggcgttatatgcacataccctgaagagctctttttttaagatttaactgtttccagcttcccttgtccttgcgctcagatgtacagttggcaggggaaatttttgttacttttcccccttaataaaagagtaataaatgctcattaaaaaatacaaagaaaaatgagaaaaatacaaaatctagttcaaatacacaagattaaaacaatatattttcttttattattttttatgtgcagcttaaaaataaggttataatcatatttatttctaatattttgaagttttgattaaaaatttttaaaattttttgtgggtacataatagatgtgtatacatatatatttatggagtacttgagttactttgatatagtcatactttatcaaatgtgtaataatcacatcatggtaaatggagtatccatcccctcaagcatttgtcctttgtggttacaaacaatccagttacactgttttagttatttataaatgtataattattgaccggctgggtgcaatggcacatgcctgtaaccccagcactttgggaggcaggcggatcacttgaggtcaggagtctgagaccagcctggccaacatggtgaaaccctgtctctactaaaaatataaaaattagccgagtgtggtggcactcgcttgtaatcccagctacttgggaggctgaggtgggagacttgcttgaatctgagaggtagaggttgcattgagctgagatcacaccactgcactccggcctgggcgacagagcgagtctctgtctcaaaaaaaataaaaataaaaaaatctaatatcaaatattatttattctttctgtttttttttgtactcgttaatcaccctcactccccctgccatccctgccacgccactatgtttcccagcctctgataaccatagtttattttctgtctccacgtgttcaattgttttagtttttagcacccacaaataagtaagaacatgtgaagtttatctttccatgccttgcttatttcacttaacataatgacctctggttccttccatattgtgaatgacaggatctcattttttttaatggccgaatagtactccactgtgtacatgtaccacattttctttatccatttgtatgttgatggacacttagattgcttctaaatcttggctattgtgaatagtgctgcaacaaacatggaaatacagatgtctcttcaatatactgatttcctttcttttgggtgtatacctagtagtgggattgctggatcatgtggtagctcaatttttagttttttgaggagctcccaaactgttctccatagtgtactaacttatattcctgccaacagcgtacaagggttcccttctctccacatcctcaccaacatttgttattccctgtctcttggttaaaagccattttagctggggtgagatgatatctcattgtagttttaatttgcatttctctgataatcagtgattttgagcactttttatatacctgtttgccatttatatgtcttattttgagaaatgtctattcagatcttttgcccattttttaattgaattgttagctcttttatattctggttataaaactcttgtcaggtgggtagtttgcggatgttttctcccattctgtgggttgtctctcactttgttgattgtttcctttgctatgcaggaacgttttacttggtatgttcgcatttgtccatttttgctttggttgcctgtgcttgtggggtcctgctcaagaaattcttgcccagaccaatgtcctggagattttccccaaggttttcttgtagtagtttcatagattgaggtcttagatttaaatctttagtccactttgatttgatttttgtatatggtgagagataggggtctagtttcattcttttgcatacggatatccagttttcccagcactgtttattgaagaaactgtctgttctccagtgtatgttgttggcacctttgtggaaaatgagttcactctaggtgtatggatttatttctgggttctctattctgttccattggtctatgtgtctgtttttttgccagtatcatgccattttgtttactatagctctgtagtgtaatttgaagtcaggtaatgtgattccttcagttttgttctttttgctcaggatagctttggctattctgggtctattgtggctctatataaattttaggattgttttttctatttctgtgaagaatgtcattggtattttgataggattgcattgaatctaaagattgccttgggtactgtggacattttaacaatactgattcttctagtctatgaatatggaatacctttccattttttgtgtcctctttaatttctttcatcagtattttatagtttttattgtagggatctttcatttctttgactaattcctaggtatttaatttcatttgtatctactataaatgggattacttttaattactttttcagattgttcactgttgccattagaaagctactgatttttgtatgttgatttgtgtcctgcaactttactgaatttgcttagcaattctaatagtttttttgtggaatctagatttttcaaaatgtaatatattatctgcaaacagggataatttgacttcttcctttctaatttgaatggccctttatttttatctcttgtctgaatgttgtagctaggacttccagtactatactgaataacagtgttgaaagtaggcttccttgttgtgttccagatcttataggaaaggctttcactttttcctatcctgtattttactagctgtgggtctgtcatgtatgccttttattatgttgaggtacgttccttctgtacccagttttttagggattgtatcatgaagcgatgttgaattttatcaaatgctttttcagcatcagttgaaatgattatattgtttttgtctttcatttcattgaaatgatatattacattgattgacttgcattcattgagccattttgcatctctgggatacatcccacttggtcatgatcaatgatctttttaatgtgttgttgaatacggtttagtagtattttgttgagggtttttgcatcagtgtacatcagggatatttgcctgtagttttctttttttgatgtttctttgtctggttttggcatctgggtgatacaagccttgtagaatgaatttggaagtattcatctctcctccatttcaatggtccccaacctttttggccccagggattggttttgtggaatacaatttttccatggactggggtgaggggtggtatggtttacagaatgattcaagtgtattacatttgttgtgcaccttatttctaatattattacattgtgatatataatgaagtaattatacaactcaccataatgtagaatcagtgggagccctgagcttgttttcctgcaactaggtggtcccatcttggggtgacgggagtcagtgacagatcatcatcaggcatgagattctcacaaggagcacacaacttagatccctcacatgcacagttcacaacagggtttgcactcctgtgagactctaatgtcgtggctaatctgacagaggtggaggtcaggtggtaatgcaagcagtggggagcatctgtaaatacagatgaagctgctttcactcgcccgccactcacctcctgcagtgcatcctggtttctaacaggccacggaccagtaccagtctgtggcccaggggtttgggacccctgctgtactttttggaatagtttgagtaagatggatatcagttcttctttaaatatttggtaagatttagcagtgaagttgtcaggtgctgggcttttctttactgaaagcctttttattactgcttcaatcttgttacttgttattggtctgttcaggttttggattactttatggttcagtgttggtaggttgtatgtgtctgggaatttatccatttcttctaggttttccaatttattggcatatagtagccatgttgctcctagtagccactaatgaatttccgtggtatcaattttaatgtctccttttttgtctctgattttatttatttgggtcttctctctttttttcttagtctgactaaaggtttgtcaatattatcttttcagaaaaccaactttttgtttcattgatcttttgcattgtttcctgtgtttcaatttgttttatttctgctctgatccttattctttcttttcttctacaaattttagatttggtttgctcttgcttttctagctctttaagatgcatcattaggttatctatttgaagttttttcacttttttgatgtataagcacttataccatcaacttccctcttagtgcttctttcactatatcccataggttttggtgtgttgtgtttcttttatcatttgtttcaagtacattttaaatttctttctaatttcttttttgaccctctggtcaactggtagcatattgttcagtttccatatctttgtacagtttctagaattcctcttgttattgatgtctagttttattctattgtggtcagagaagatgcttcataatatttcaattttttgaatgttttaagactgttttgttacctaacatttggtctgctcttgagaatgatccatgtgctgaagaaaagaatgtgtattgtgcagccattggatgaaatgttttgtaaatatcttattaggtccaattggtctatagcgaaaattaagtctagtgtttccttgtggattttctgtttggaagatctgttcattgctcaaagtgggatattgaagtctccagctattattgtattgggggtttatctgtctgtttagcagtaatatttgctttatatatctgtgtgctccagtgttgggtacatatatatttacaattgttatatcctcttgctgaattgacccctttatgtaatgaccttctttgtctctttatagttttgtcttgaagtctgttttatctgatacaagtatagctacatctgctcttttttggtttccattgtcatggaatatctttttgcatctcttcatatatctgcatgtgtctttattggtgaagtatgtttcttgtgggcaacaagtcattggatcttgttttttatccattcagccactctatgtcttttgattggagagttgagtccgttttcattcgatgttattgttgataagtcggacttactcccgccattttattgtattctggttgttttgtgatgttctcttcattccttcttcccttccttcctgcgttccttttagttaaggtgatttttctctggtggtatgatttaatttcttgctttttattttttgagtatccattgtatgttgtttgatttgaggttactatgaggcttgcaaataatataacccattattttttaaacagatgataactggctggatgtggtggctcattcctgtgatcccagcactttgggaggctgaggcgggcagatcacttgagttcaagagttcgcgaccagcctggccaacatggcaaaaaccccatctctactaaaaatacaagaattagccaggcatggtagcgtgcatctgtaatcccagctacttgggaggttgaggcatgagaatcacttgaacctgggaggcggaggttgcagtgagccgagatcgtgccactgcactccagcctgggtgacagagcaagactccatgtcaaaaaaattaaaaataagtgagttttgtaccttcagatgatttcttattgctcattaacatccttttcttttagattgaaggaatttctttagaatttcttgtagaacaggtctggtgttgatgaaatctctttgcttttgttgtctgggaaagtctttatttctccttcatgtttgaaggatatttttgctggatatactattctggggcaaaaggttttttccttcagcactttaaatatgtcacgccactctcttcctggactgtaaagtttccactgaaaagtctgctgccgggtgctttggagcttcattgcatgttatttgtttcttttctcttggggctttttggattctttctttatctttgaccttcaggagtttgattattaaatcccttgaggtagtctttgggttaagtcagcttggtgttctataaacttcttgtacttgaatgttgatatctctctctaggtttgggaattttgctgatattatctctttgaataaactttttaccttatgtgtttctctgcctccaccttaagttattaaggccaacaacttttagatttgcttttttggaggctattttctagatcttgtaggtgtgcttcattcttttttattcttttttcttttgtctcctctgattgtgtgttttttgttttttgtttttgagatggagtctcgccctgtcacctaggctggagtgcaatggcgcaatctcagctcactgaaacctctgcctcccgggttcaagccattctactgcctcagccttctgagtagctgggattacaggtgcccgccagcacacccagctaatttttgtatttttagtagagatggggcttcaccaggttggccaggctgggactgtgtattttcaaatagcctgtcttcaagctcactgattctttcttctgcttgatcaattctgccgttagaagactcatacatttttcagcatgtcagttgcatttttcaactctagaatttctgtttgatcctttttagttatttcaatctttctgttaaatttatctgatagaattctgaattccttctccgtgttatcttgaatttctttgagttacttcaaaacagcaattttgaattctctgtctgaaaggtcacatacctcttttcctctgggattggttactggtgtcttacttagttcatttgttgaggtattgttttcctggatggtcttggtgcttgtggatgttcatcgatgtctgaacattgacgagttatatatttattgtagtctttggtgtctgggcttgtttgtacctgtgcttcttgggaaggctttctaggtattctaagggacttgggtgttgtgattcaagtttttagtcatggcagctgtatctgcattagggggtaccttaaacccagtaatgctgtggttcttgcagacttgtagaggtgccaccttggtagtcttggataagaactgggagaattttctggtttaccaggcagaaactctgattatctttcctttctttttcccaaacagagtgtctctgtctgtgctgagctgcctggagataggggaggggttacataagtatccctgtggccaccaccactgggactgcactggttcagacctgaagccagcacaatactgggtcttgctcaaggccctggggctttacaatcagcaggtgatgaagccagctgggtttgtgttcttcccttcagggcagcgagttctcctgggccccatgcgggttgagagacgccatctgggaggcagggcctagagtcggaaaccttagaaatctacctgggtctgtattctgctatggttgagctggcacccagaccacaagacaaagtccttctcactcttctctcccctttccacaggcagaggagtctttcccccagccaccaccacaggtccatagagagtactgagaggccacttccagggtttacttaaggctcaagggctcttcagtcagcttgtggtgaatgctgccaggcctgggactcacccttaaggttgatgggctcctctctcatccagagtaggtccagaaatgctgttgaagagcccaggcttggaatcagggaccccaagagcccacttggtgctctacctcagctggtggctcagctggtacctaaactgtgagacaaagtctcctttatttctccctctgcttttctcaaacagaaggagtttctcatatgacccagcttggaatgttctgggtcatacgtgaagccagcatgtctcagagtctcacccaaggcccatgaagtgtattgcctgtctactgctactgattattcagggcccaagagctctttagtcagcaggtgaggaatcctgccaggactgggtccttcccttcaaggcagtaggttcccttctggaccatggtgtgtctagaagtgtcttctgggagctagggcttagaatgggctcatgattctgccaggtgccctattctactgtggctgagctggtatcctaattgcaatacaaagtcctcttaacttccttctccactcctcaagcagaaagaaggagtgtctttttcaggttggagctgtgcagcctgatgttgggatggggtggcgcaagcactcccttagccacccctgttgatgtctcactaggttgtgtgcccccgatgtccactggctctgagcccagcacagcactaggacttgctgaagagttgtagtctttttggcctagactgccttttaagtttgtttaggaccccagagctctgcctgtggtggcagagattgccagaactcaagttctgaccactgggatggacgattccttctgtctagagctgttctatatgttccctctgtgggtatcagctgagttctgcccagtgttgacagcactgagttccaatacagagtcccacagtcactgagctctccctcccccaggtgcatagattctctctttctgccacatggctgctgccaggggatagggaaggggtggagttggtagttcaagactctctttcctaccctctttggtgcctctttcagcaatatgaagttaaaaccaggtattatgatcgctcctgatgtttggttcttatgaacgtacttttttgtgtagatagttgttaaatttggtgttcctgtaaatggagggaccatgggtagaggcttctatttggccatcttgcttcattccccagctaatattttcaagtttgagaaacattttgtgacaactgaagaaactgcacacagaactacatgttaagtcataatcttagaatgttgattgaggaacatattgttaagctaatattacttcattaacacttaaaaattaatttgtgttttactagtcacaacctcatctatatatatagggaagatcgtttgcaataaatctaagattaaagattgaaaccactatcacattatttctatgtttcattttttttcatcttgccttaaacttgaaacatttcttccattttatttatagctgcatcaaaatattttaatagtcatatgctgttccattaagtggatatattacaatttacctatccattcccccattgtccaacacttagattgtctctatcttatttctgataaatggtaccacagcaaatatctttctgaattactttctggttctgcttctggtatgggtatttagcttctattggaccaaacctattgcaaataacaactagaaattctggataaaacttttttcttttttctttttttttttttttgagacggagtctcactctgttgcccaggatggagtgcagtggtgtgatctcagctcactgcaacctctgcctcctgggttcaagtgattctcttgcctcagcctcccaagtagctgggattacaggtatgcaccaccatgcccagctaatttttggtattttagtaaagacagggtttcaccatgttggccaggctggtctcaaactcctgacctcaggtgatccgcccgcctcagcctcctgaagtgctgggactacaggcgtgagccaccatgccgggaaagccttttttttttttttttttgaggcaggttctggctctgttgcccaggctggagtgcagtgacatgatcacatctcattgcaaccttgacctcctgggctcaagcaatcctttcatttcagcctcctgactagctgggactacagatatgcaccaccacactggctattttttttttttttttttttttttttctgtagagacagggctttgccacattgcccaggcttgtcttgaactcctggtctcaagagatcctcctgccttggcctcccaaagtattgggattacagtcatgagacaccatgtgtggcctggatacaatatatttttttaaaagtatctcaaagcagtagagagggactaacagagttgtacttgtttagccaggtgaatttaccattttttagtttttagtttcagtcagaggacaggcactagtgtgctctacgcaggatactaaactttcgcagaaaaaacaaaatcttattggctggaagaatttgatggcagagattgaggcaaacatgatggctcaaaaggggagaaattaggttgttttgtttttttgttgttgagtttgaggagttctttatatattctggatattaacctcttttcagatatatcatttgcagatattttcttccattcaataggttgtgttatcacttctttatagtatactttgatacacagaagtccttaattttgatggattacagttaattcattttctcttttgttgcctgtgcttttcgtatctgtcatattcatgaaatcattgccaaatctgatgtcatgaagatccttctaagagttttatagttttagctcttaagtttaggcctttggtccattatgagttgatttttttaatggtgtaacgtgagaatccaacattattttgcatgtggatatctagtttttctagtagcattagttgaaaagactgtcctttcctcattaaatggtcttggcacccttgtcgaaaatcagtggattgtatttgtgatactttatttttgactttttaaattcattcattcattaattgttattttattttatttttttgagacaaagtctcactctgtcgcccacgctggaatgcagtagcacaatctcggctcactgcaacctctgcctcccgggttcaagtgattctcatgcctcagcctcccgagtagccgggattgcaggcacccgccaccatgcctggctaatttttgtatttttagtagagtccaggtttcaccatgttgttcaggctggtctcaatctcctggcctcaggtgatccacctgcctcggcctcccaaggtgctgggattacaggtgtgagccaccatacctggcctgtttttttaatttatatatttagagatggggtcttgctctattgcccaggttggtctcgcacttccagcctcaagcaattctcccgccttggtctcccaaagtgttgggattgcaggtgtgagccactgcacccagcatatttctgagttctttttttttgagatagaatctcactctgttgcccaggctggagtgcagtggtataatctcaactcacttcaacctccacttcctgggttcaagtgattctcctgcctcagcctcctgagtagatgggtttacaggtgtgtgccaccatgcctggctagtttttgtattttcagtagagacagggttttaccatgttggccagtctggtctcgaactcctgacctcaggtgatccacccgccctcggcctcccaaagtgctgggattacaggcgtgagccactgcacctggcctatttctgatttcttgattttattccatcagcctgtgtctgtccatatgtctgtatcataatgtttttattactgtagttttggtaagtttcaaaattgggaagtgtgagttttccaactttattcttcgtcatgattgttttgctatttagggctcttggaattccatgtgagtttggggatcagcttttctatttctctgaaaaaagacacttaacattttgatggagattgcattgaatctctagattgctttggttttattgatcttaatgctccattcaaatggaacatttatctagtctttaattcaccatttcatttgcagtgatgataatgttctggaattaaatagaggtgatggttttatgattttgtaaatatactaaaacctactttcaaaagtgaattgtttgcaagtgaattataccttgatttaacaagacaaaagcaaaaacactttcttcaacttgacgtctacttccagctgtgatttgttcttcctcttataatcagactttttggaagagggcatacgctttcagtgccattgtcacctctcattcactcctctgtccaatataatctggcttttgtttccattaattatatgaaactgcccttagtctttgtcttttttattttttttttttgcggggggggggggggggttgtttgtttgtttttaagcatttaacacagttgatatctttcttttgtttttcttaataaccttttcattttagaacagctttaggcttacagaaaaattttgaagatagtacagagttactttatacccttcactcagtttctcctactatcagtagcgtacaaaactcagattgggcaatatggtgagaccctgcctctacaaaaacatttttaaaaattaactgggcatggtggcacatacctgtactcctagctactcaggaggctgaggcgggaggatcacttgagcccaggagtttgaggccacaggagctgtgattttgccactgcactccagcctgggtgacattttcatcacagcatattaaggcacatactatcaacatgacttatcactgttgatgtgaaccttgatcagctggccgatgtcgcttttgtcaggtttctccacagtaaagttagtctttacccctctccttttctgcatcataggctttggaaggaagtcattgtgtggattgcacacttgaggagcagggagttatgctctccctccttgaggggagtttctacataagttaaattaacatttacaccaattagaactctttggtgctctagatttgtcccttctcctctattgattcaatcatttatttagattagtatggactcatggatatttagtttatactctgggttataatccaatactacttttattttcttgctcacatttccagatatggccattggaagctctttcagttggtttccgtgtcccttggacacatcctagtcattgtgtttgtttttgatacttccttacttgttggcactgcaagatcccccagactcatcttgtgtatttcctgcccggtcctcagatcagtcatttttccagagtatggattccttgtcttggagaatgttattagaaaccagtatctcagtgctaaatgagctcattgctactggagtggtgcctttctttttgaatcactgttttatcctttgtgtctgtgatactacattttcttagtctttcatagaaggtagtatagtgtagtagttaagaacaagagctctggaggactaaaatgtaatcttggttccatttcttacacccagccaaatgtgtgatcttgagcaagttgatctttctaaactacagtgtccacatctgtaatgatacatattataatagtaggttgctcatagaatgtgtaaagattaaatgagcaactgcacatagtaagttatgcgtagcacatagtaagcattcattctgtgcttgcttttttctcttgtttataatattttcaccttcctttttggctgttccctgacagtctactctattagatttcctttgtcttctaaatgctatagtgttccatggtcttaggttttcttctcaccttgtgtattctccccaggtgatttcacctattcttatagctttagttgtcatctgttatgtatatgtatgattccgaaatctatacctgtggcccaaatacttgtcttaagattttgtatatccgacagcctattgggtaccttcatttgaataactttaatgcacctcagactcagtctgtccagaattaaagtaattattttaccctcccaaaatctgctgtcccccttcacctgccctttatcccagccagaaacagaggtgtcatctttaattcctttctctttctgtctactcccagtcaaatcacttacaaggctttttgattccacctaactctctgagccttcctcacccattttctctgccttcactgctgctgtaataggtcagactactataaaccatttcctggattactgcagctgattttctgtttcattctctgtactgtagctgcatactttttctcaaacacagatctgcacaaatcttttcatgttgtaaaacattttaatagttccttattgccctcaagataaagtccaaactacaatttaaatgatcctttatggccgggtgcggtggctcacgcgtgtattccttgcactttgagagaccaatgcagttggatcagttgaggtcaggagttcgagaccagcctggccaacatggtgaaaccccatctctactaaaaatataaataatcagcccggtgcggtggtgtgcgcctgtaatcccagctactaggggggctgaggcaggagaatcgcttgaacccaggaggcagagcttgcagtaagccaagattcagccactgcacttcagcctgggtgacagagcaagactccatctcaaaaaaaaaaaaactcctttaagataatggttcttgttttcatctgtactcttatcccagacacctatccttctgccacactgaactgcttttagttccctgttctcttttctctgtcttatttagcctttctatatgctcctctctgggtctggaattttatgcttccttgacaccatctttcatgccactcctgctatatttatacatatcacctagctaattcctgttcatcccttgcatctaagcttaggtcttatttccactggcctgtaagcctctcaaataaaaatatttaaaactcctaaatggaaagaagattaaaaataatggaaatggccaatgatgtaccaggagcaagaatataatattgatactaaataaaataaaacatacttcaaacctcaaggcattaaagggacaaagaggaatattatataatgataaataatcaaaacaacagtccaattttcaaaaaatggacaaaacttatgaaaagaaagttcacagaaatggaaatattaacagttcttacacatatgtaacggtactcaacctcattcataaggcatatgtactttaaaattacactgagggctgggcatagtggctcatgcctgtagtcccagcacttaatgaagccaaggctggagaactgtttgagcccaaagttcaagaccagcttgggcagcacagggaggcattgcctctacaaaagataaaaataaaattagccaggcttggtggcatgcatctgtagtcccagctgtttgggaggctgaggcaggaggattgcttgagcccaggggtttaggctgcagtgagccagctgtgttcgtgccattgtacttgtactccagcctgggtgaccctgtctcaaaaaaataaaaacactgatgtatcgtatttcactctataagattggtgagtattaagaagtttgtgcaggattgaaaaaaagaagtttgggccaggtgcggtggctcacgcctataatcccagcactttgggaggccgagatgggcagattacttgaggccaggagtttgagaccagcctggccaacatggcgaaaccctgtctctactaaaaatacaaaaaattagctgggcatggtggcacatgcctgtagtcccagctactcaggaggctgaggcaggagaatagcttaaatttgggaaacggaggttgcagtgagccgagatcacgccactgcactgcagcctgggcaacagagcaagactccatctcaaaaaaaagaaaaaaggccaggcgtggtggctcaagcctgtaatcccagaactttgagaggctgaggtgggcggatcacctgaggtaaggagttcaagacaagcctggccaacatggtgaaaccccgtctctactaaaaatacaaaaaattagccaggcatggtggtggatgcctgtaatcccagctactcaggaggctgaggcaggagaatcacttgaacctgggaggcagaggttgcagtgagttgagatagcaccattgcacttccagcctgggcaacaagagcgaaactccgtctcaaaaaaaaaaaaaggaaaggaaaaatgtttgacaaaaacactcttgtcaagggtgtaaggtaacatgctttcctatactactggtgggaacataaattagtacagcctttatgagagggaatttgcaatatttattaatttaacattaacatatcttatgacttagcagtctcaattctaggaatttattttattgctaagctcacaaatttaggaaataaaagttaatctttacagtataatatgtaatagtaaagtattggaaacaatgtaaatccatcactaggatgtagttaaataaattgtgttcagtacatataatggaatgctatgcagatgtaaaattgggaatgagaaaggctatgtacaaatatagaatgatctagaagacacattgaattaacaaaagaaaccgcgcgcggtgtctcactcctgtaatcccagcactttcggaggtcaagtcgggtggatcacgaggtcaggagttcgagaccagcctggccaacatgatgaaacctcgtctctactaaaaatacaaaaattagccaggcatggtggtgtgcgcctgtaatcccagctactcaggagactgaggcaggagaatcagttgaaccaaggagacggaggttgcattgagccgacattgcgccactgcactttagcctgggtgacagagcaagactctgtctcaaacaagaaaaaggaaagaaaagtgcaaaacagtgatctgggtatataactattagtttaaagaagtgaggaacaggcctggcgtggtggctcacactgataatcctagcacttttgtaggctgaggcgggcagatccattgagtccaggaatttgagaccagcctgggcaacatggtgaaaccctgtctctacgaaaaattagctgggggtggtggtgtgtacctgtagtcccagctactcaggaggctgaggtgggaggattgcttgagcccaggaggcaagggttgcaatgagctgagattgtgccactgcactccagccagccagggtgacagagtgagaccctttctaaaaaaaaaaaaaagtgagaaataatgacacaacatacaaacttgaaaacatataatgtttcttgtaaggatacacagaaactgttgacattggttatctggtagtggaaaaacagtgtctttcacagaggagaaatttttaattttaatgaagttcaacatgaatttttctttcatggatcatgcttttgctgttgtatctaaaatgtaattgccaaaaccaaggtcacatagattttcttttttattgtcttctaggagttttatagttttgtattttatgttttaagtctagaatccattttggatttttatgacaggtataaagaatctgtgtctagattcatttctttacatgtagatatccagttcatttggcctcatttattgaaaagactctcttttctccattaaattgcctttgcccatttgtgagagattagttgaccatatttttattgttctgtttcagggctgtctgtcctgttttgttgatctattttgccgttcttttgccagtgccacactatcttgattattgtggctttatagttacagtcttttttttttttttttttaagctagagtcttactctgtcactcaagatggagtgcagtggcacaattacagcttgctgctgccttgacctcctgggctcaggtaatctcctcacctcagcttcccaagtacctggaactataggcacgtgccaccatggccagctaatttttaaatttgtttgtagagacagggtctcactttgttgcctaggctggtcttgaactcctaggctcaagctatcttcctgccttggtctgagtcagtgctgagattacaggcatgagctaccatgcccgacctacagtcagtcttaaagttggataatgttagtcctccagcttttctttactattgtgttggctcttctgagtcttttaccttgtcatataaattttagaatcagttttttgataactacaaagtaacttgcaggatttttattgagattgcaatgaatctgtacatcaagttgagaataactgaaatcttaataatattgattcttcctattcatgagcatggaatagctctacattaattaggtcttctttgatttcttttatcagagttttatggttttcccccagagatcttatatatatatatatatttattggatttatacctaagtatttcatttttggtgctaatgtaaatggtcttgtgtttttaatttcaaatattaattgtttattgctggcatataagaaggcaattaattgtatgttaaacttcatattctgtaaccttgctgtcattgcttatcagttgcaggagagtttttgattataagaggtattttaattttcagtttctagttcttctttgctaacatatagatatataattgctttctaatttcactggttaggactttcagcacaaggtttgataaaaatggtggcagcagaaatccttgccttgttccccatattaggaggaaagtgttaagtcttttatttttaggtattattttagctgtagattttttttatagctgccctttatcaggttgagtaagttttccttctgttcttggttttctgggaattttatacatgaatggtttttggattttgttaaatgttttttctgcccctgttgcaatgattacatggtggagtactgttaatatggtatattattacattgattgatttttatatgtcaaatcagccttggatttcctggataaacctcagttatgagagaagtacacaaattctccatttggagagtattggtgattagatcctgttttgtattatttttagtcctttatagtcttagagatgagtctggggtcccctgggtcacagcaaggaaccagctgaagttagagtccccagaagatagatgatccccaacttaacgatggtttgacttaaaaatttttgactttatgatggtgcgaaagtgacacacattcagtagaaaccatactttcgagtacccataccactgttatgtttttcactttcagtacagtattcaataaattacatgagttattcaacactttattataaaataggctttgtggtagatgactttgcctaattgtaggctaatgtaagtattctgagcaccttaaggtaggctgagctaacctataatgtttgataggttaggtgcattaaatgaatttccaacttacaatattttcatcttacaatgggtttatcaggatgtaaccgcatcatacttaccttcatagcatctatacatacatttatagtggcaccaattgtttcaggttttataacatttttgaacaaatcttcacagcctggaaacaggaataaaagaagcatattgtgggcaaagcattaggagcaaaaggaattcagagttctactgagagagttgctggaatggctccctgtagggaccataataatgcatttctggtgagatgcaaatgtgagaactgtgcttttcttgatgagagtaagataaagtttaaagggagttggaaagggaaaagagtagagaattggtattagaaattacttcagtgtttaaaatcttaaaaattcagtagcttatatgttttagagtttcatgtttacttaagctgctaacttttacctgcattacttttttggattttacttcacaaatttaagccccaaaatatctagtaagcctgttttattttgtattattttgagtaataggtataagcaatatttggttgctatttcaataaaaattctttggcaggtgtccaaatcccagcgctttgagaggccgaggcaggcagatcacttgaggtcaggagtttgagaccagcctggccaacatggcgaaacctcctctttactaaaaaatacaaaaattagccaggtatgggggtgtgcacctatagtcccagctactcaggaggctgaggtgggagcatcacttgaacctgggaggcagaggttgcagtgagccgagattgcgccaccctgctccagcctaggcgacagcgtgagactctgtctcaaacacacacacacacacacccacacacacacacacacagagtgaatggttctagctttcctctttttttggtttaggataactaaaattacacgcctgtaattccagcactttgggaggccgaggagggtagatcactggagctcaggactttgagaccagcctgggcaacacaaaaccccatttctacaaaaagtacaaaaattaaccaggcatggtggcctgtgcctgtgcagtcccagctccttgctccttgtgtggctgaactgggatgattgcttgagcctgggaggcagaggttgcagtgagctgagatcacaccattgcactctagcctgggtgaaagagtgagaccctgtctcaaaaaaaaaaaatcttaatgatctgaaaacagaattccattctgcaaataattttatttattgaccagttcatcccagcgagttgctttacctgaaaaacctttaccatctgatcctttttcttgtttgtatttttcctgtttatcttcagatacattttatttaaattaatagtggtttgttaccatattaaataattagatactacaattcaataagaactaccttttaaaaatgaaaatcagaggagttcctgatttaaaacaaaaaataaaggaaaatattaaagtgtttttaaagagactaaggttaccacatcttttatcttcctgttaactacttttgcaacatatattgttgtgattaggtagaattatacaactttgctctgtttctttgattgcgtattggaaactcttattatcccttttttcagtgacgttgttttacattggataacatccagtgacacttgtgtattctttacatcctttagtgagtccatttgggacccatttacatatgaaaagcagcatgactgacactgcagacatgtaaatcgcaaatctaaaggaattagagaagatgaaaacattatttatcaataaggtcctcagtctcccaaatgaacaaagtaggcacttgagtaataatttgaaaaagtgattcatcttttttctactccctgattaataaaggtgatattttcttagtatgcttggaggttgggaatactttaagtcagtagttctcgaattttatcaagcatgagagtcacctagagggcatgttataaagattaccaggcatcacctccagagttctgatacagtaggtctggggtgggacctgaaaattggtatcgctaacaagttctcaggagaagctgatgtttactagcactggaccatactttaagcactactgttggccaggcacggtcatctcagcatttgggaggccgaggtggacagatcgcttgagcccaggagttcgagaccagcctggccaacatggtaaaacccatgtctataaaaacacaaaaattacctggatgtggtggcacaggcctgtagtcccagctacttggatagctgaggcacaagaatcatttgaacccaggaggcaaaggttgcagtgacccaagattgcaccactgcactccagcctgggcgacagagtaagactctgtctcaaaacaagaaaaaaactaaaaaccaaaaaactactggtatatggtagggtatatgaaagtggagaatgagcaacaagtaggatcagcctgattttcctgcctaaggttttcattcaattcagaaattttttttttttaagtacctgctatgtgtctaatactacgatgtcatcaagctttacatgtcttagacttttcgacagtggatcttttgctttattgagaggcttcaccaactaaggagcactgtctaaaataaaagactagtaaagaaagaaataaagttattcattttgttgctttttcaaccctctgtttttatgctaggtaatattttaccctttaccaattttaatgtgcaaacattatttctggcaattccacctctaggtagctatcctaaggaaataactttcaacaattgattaatgtagacacagacagagatgtttatcatagatgtttattataaagagcagaaaagtagctcctacactgaagtctgtagttttgcaattactaaataaactgtgtatgtatgtatatgatagctaattttgtagccattaagttttgcttatgaagagaagcattttaaagttaaaaatgcttgatatacaagaattattttatgtaagcatattttaataaaatttaagagctcagatttaagtgaaattgtattttaggttcttaactatgtgagatttatttatagagaaaaatgaggaaatataacaaattactttttacaaagtatctttagaatgtgagattatgattgactgttactatatattctcttctgtatttgtaacatatccataactggatattacttttataattaaaatattcatgttttatatttacatattatttcaagttttatttacacacatatattagtgtacagctcagtgaagttttataagccagcactcatatctagaagcagaatataaccagcaccctagaagcatgccttgtgctctatttcaaggataactgctatcatgacttctaaaagcacagattattttctcctgtttttgtactttatataaatgtaatcatacagtatttattcttttgtgactggcttctcttgcttaagaagatgttgtgagatcaagcttagtaatcatagttcatcctttctcattgctatgtaatactccattgtgtgaataaaccattattcactttaatgttattgggcatttgggtaggtaattttaagtttgggaatattatgattagttatgtcataaatattttagtccatgtcctttggtgaacacatgtacgtatttctacagggcatacacctaggattggaactgtttggttggggttcagttttagtcgatactcccagatgatttttctcaaagtggttataccagttcacactcccactggcaacagatgaggatttctgttgctccacatccttgccaatacctaatgtgcattagtcagggttctccaaagaatcagaaccgctgtctctcctattggttttttatgactatatatatacacacacacacacacacacacatatatatatatattatataatatatatatatgtgtatatatacagctgacccttgaacaacgcagtggttggggcactgacctccctgtgcagtcaaaaatctgtgtataattttaactactaatagctcactgttggccaaaagccttaccgataacatgaacagttaagtaacccatattttgtatgttatagattgtgtactgtattcttacaataaagtaagccagagaaaggaaaatgttattaagaagatcttaagggagagaaaatatgtgtaccattcattaagtgtaagtggtttgtcataaaggtcttcatccttgtcatgttaatgaagagtaggctgagaaggagtaggaagaggaggggtggattttgccgtctcgggtggcagaggcagaagaaaatctgtgtataagtgtacctgtacagtttgaacctgttattcaaatatcagctctgtgtgtgtgtgtgtgtgtgtgtgtgtgtgtgtgtgtgtgtgtgtgtagagagagagagagagagaaattgattgattatagggattggctcatacagttatgtaggtcaagaaatcctgtgacctgctgtctgcaacctggagaaccaggaaagctggtgatgtcattcagtctgagtctgaaggctgagaatcacgggagccagtggcacaagtcccagctcaagtctgaagggctgagaactagaggggctgatggtacaagtcccaattctaggccagaggcctcagaaccagtgtgccaatttcacaggcaggaaaagatgaatgtccagctcaaacagaagcagattctcccttctgttgcctttttgttctctttgggccctcaacaggttggatgatgcccctctccattggagagggtgattttctttattcactctactgattcaaatgctagtctcttccagaaacatctcatagaccacccagaaacaatgttttatcagctatctgggcatcctttagctcagtcaagttgacacaaaagttaaccatcacagtatttttcatctgttttcttatacttagtgtggtaagtgtgcagtggtaatatatggtagctttaatttgtatttcctggatgattaatgaattgagagcctttcctatatttttggttgtaaattatgctaaaacgttgttgtagtttgcagctcagtatcagatatattttaactttatttcaaggaacttaattataagaagtattttacaaaatatatcaaaggatattataacttgatccaaggttatgtatgaaacttaaaaatagcatacatttaatttttaaagtctcaagtgttagtgtcctgtaatatggtacctaatgagatttagtttgagttgaattatacttttatgattgaatgttattttcctgttggcttcagctataaaaattaaagacgttctcatatgaaaaatcgttcagtagacggagttgaaattttttgccaaagacaaataagtaagttgataaccagtctctgtcggctgttgtcatcaggaacactgctagactcaagtaagataatatttgtaaagcactacccagatgtttgtgttacttttagagctttaaaatctttgaaatattcttaacatcttggttttctttctgttttatccactgataccttactcctaaccctccatgtgtagttctcagaatttattccattcttgctattgtcttgagtttttagaacaaggtagaaggcacagaacaacccaaaaactgcccccctccacacacacatttttatatatttaagtataatttaaataaataaatacagaatgctgctaacctcattggcattttaagatcatattgtaatggcaggctattgagacaacatgggacttgtacctagcatagtgcctgtctcacaggagctcactgtatatttgttgagtggataagacaatgaaaaaattctactgttgggtttttctctttttaggttttgttgggagcttccatttgttgtcccctacccaccagttttggatctttaattttaaaaagagtacttaagatggatatgagaaagttactgttatgctgggcacagtggctcacgcctataatcctaatgctttgggaggctgaagtggaaggatcacttgaggcaaggagttcaggaaagtttctgttagtaaaattttcaaagtggaactttctctcaagataacctcatatagacagtcagaaaggagaacagtaaaattgtaaaatgactggaaaataagtatacattttagtgattttttatgtggtacttattttgggagaatctaattattcaagtacccattaaaataaaaagcaaagttaatgttatctttatattatttaagatgtatccatgagataaattctataatatatattggattacttatgaacaaagagaactagaaaaaacgtgttttaagaggaggtaaataaaagaagttccaaatagaaggaaagaaagctggagaggggctggacacagctgctcaagcctgtaatcccagcactttgggaggccgaggcagtcagatcacctgagatcaggagtttgagaccagcctggccaacatggcaaaaccccgtctctactaaaaagacaaaaaaattagctgggcatggtggccgacgctggtagtcccagctactcaggaggctgaggcaggagaatcgctggaacctgggaggcagagattgcagtgagccgagattacaccattgcactccaccctgggtgacagagcaagactctgtctcaaaaaaaaagaaagaaagctggagagaacggtgacactatgtctcaatagcatctgttatcctagatgatgttaaaaagttctgttgaatgcttttttttcacaactctcttctactctgaattataaaatgtaatagtgtggtattagaaaagacagctaatcctttagaaattggtcgtatattattttgaccattggtcattgattattttactggccagtttgtgaagcttttcttgatttttttttattccagatctttagacctcactatgaaacaacccacttgttaggaaacattgatacagtcattggaaaatcttaaccatatgtggtagaatggccacaagcaaatgcatgaggcttaggcctgaagcttcagggctttgtttgatacatgtatcaatttatatagaattgatcaaagcatatctatgactgctactgattaccatagaaaaatagctgagtaactgttgctttattctgtaatatcaatgtgtataataaaaaataaattttgttcattgcctccagttctggcacacagttcctaaagccctttgaatctccaaagtaatgagtgtcttttgtactctaatgagaagattgttgactggggtcccctagatagctttaggatgggggctggtgccagaaagaccaaggattgaaactttcaaccccacctctgacttccagcagggagagagggcctggagatttagatgattaccaatggccatgatttaatcaatcatgcttacataaggaaacctctataaaaccccataaatgacagtttggagagcttctgggttggtggacacagtgaggtactgggagggtggcgtgcttggaggtggcatggaagctctgtgcacccaccccctacccctgccccattgccctgtcttacgtttctcttcgatttggctgttgccttcctgagttgtagtagccttttaaacaaaccagtaatagtaagtaaagtgctatactgagttctgtgtcattctagcaaattattaaatctgaggcggggtcatgggaaccctcaaatttgtagtctgtaggcagaaatgggagtagcctgggcatgtcatctgtggctagcagctgtggcaggcagtcttatgggactgacctcttagtctgtgaggtctgggctaactccaggtagttactatcaaaattgtattgaattgttagacacctaattggtgtctgaagaattggagaattggttggtgtgatttaaaaaaaaaaaaaaaaacccaaacatttggtgtcagaagtgttgtgagtaaaaacagttcattattaggtacttaaattcaaagatggtgtagattttatgtgtatgatcactggcttctctcttttaatatcgagggttagttatcaaggtaatttttaaatgacttggacatttaaaaaatagaataaaatactaatttataaataaacaagggttaaatcaggctgtataaatcagtggagatgtaagcactttaaggcaatatccttatctccgtttctgtgaaatttgagtgtggaatcttgtaagataattgtgactattttataggccataaggagaaaagtgacatctggtatatctggaccatagaccttaaaggattctaacacaaacacataccaagcttgattggtattgaactggcctggggaaaagtatgtcataatagcagaaactctgtgatggtatggatggagaactttataaagccaaggaactgaatccgggcaccgtggtcaaagaggaaaacttctagcgtctccctgtagccatacataattctataggtattaccattccctctcaactcattctgtattattagggaaataaagtctttctctaacgtttttcttttctcctaatatagtttgaaatgcagtcacttttacttaaacttatcttttggaataaaataatttatggaattcatagcactcagattgtttcaccagactacttgtagaaattctggattagttgattaaccacagttcatagcttcccagttgcacattatccttagatttcaaaaattcctttctgagtaagagatacaaaacaacccacccaggaacaaattattttcttggttggcagagcagtatcattcttagcacacatgaaatcgagctaagaaccagagctaatccaagattttagagttgtcttagctctgctaattttctttattattttgcttgtattttcattttcacacaactctctcaagtgattaagctgtacttaagtatttttttaaatttcgtctttaaaaaggttcttactgttttgtttcagaaaggacatgctatagctaatacactttttgtaatcttatggtggccatggaagtgtgccattcagacctcctgctggtgggaggcacaaatgactgacagtcccagctgtggtccctctggatccaccacctcattcttgctgaggtcacactgatggtgactccacatggccagtgaatgaatgagtgtaggcctgttcataagaaacacagttctcctctaatcagcagggcattacttcctattactgcataataattactctaaaatttaacagcttaaaacaaacattcatctcacatggtttctgaggatcagcaatctgggagtggcttacgtaggtatttctgcctcagggtccctcatgaggttgtagtcaagcaattggccagggctgtagtcatctgcaggctggactagggctggaagatgtccttccaggatggctcacatattcatacatggatattggcaagagcttacagttccttgctgactgctgttgacttcagatccttgtcacatggttgtctccacagggcagcaaataacatactttttcagggtccagatttgttggggacaagtaagagtagtttggtttttgtcttaggtatcatttattctgagatgctttttctaaacatcactcccaccaagggttgccagatatagcaagtagaggacaatatttggaacatacttctactaaaaaattattcattgttcatctaaaattcaaatttaactaggtatcttatattttatctgacagcctttctgggtttagtttgtcttctctgtgcacctgtggtaccctgtgctatcccgcttctatatttaccgcactatattttaattgtctatttagttgccagtatcttcccactagggtgaaacttctccatgggaataaactgtcttttttttttttttttaattcactgttatatccccagtgccaagcactgtgcttgacctataataggtactcagtagccaggcatggtggctcatgcctgtaatcccagcactttgggaggccaaggtgggcggatcatggggttaggagttcgagaccagcctgaccaacatggtgaaaccccatctctactaaaaatacaaaaattagccggatgtggtggcgcgtacctgtaatcccagctactcagaaggctgaggcaggagaattgcttgaacctgggaggcgaaggttgcagtgagccgagatcatgccactgcactccagcctgggcgacagagcgagactctgtctcaaaaaaaaaaaaaaaaaaaaaaaaaaaaggtacttaataaatgcatgtgggctttccaagaatgaaaacacttggtcttataattgcatgcacttttctcctccaccttttcttgattgtcatcatgaatctcagtagaatgctaatgcagcaaaagggctagtaattccaagattcaagaacttgtgttatcactttatatataagcttcaggttcccctctggtagctggagataatatctgtttcctcttggaagcaggaaaaaaaatgataaagcctactattttctaggattgtactagcttcaataattggaagctgggctttatgtaatgataataggttttaaggacatggaatcaaataggtctgagtttaaatgttagccttgtcacatactaaaggtgacttcttgggcaaatttgtcatgtttcaaaatgtcgattttcttatctctaaaatgggagtgatcatgcactttcataagggctattgtgaggattaaatgataaaacaagtgaccttgcctagcagagtgcctgtttttggcacatggtaggtacacagcaaatccctaatgaagcttcctggggctaccatatgtcccgtgagtgattctgtctttggattgataggcatttataattccaccaattgtagattctcatccaagtacatataccaaatatctgaacctatgttttatctcttactgagatggattactatggccacaacacaccagaagaataaaattaacctgttttatgataatctaaaatagctcatttctcttatatgtagatgaacaattcaatgcttgttgaatcccattcccagtgataggaggagactgactgcattgcaggatcaaaagtggatgtttttatgattgttgtctgccacaaactagttatctctgtgatgacttttccaatatccaatatctgcttaaaatctggatcagaaagctcatgaggttcttctttctcagtctttggctcttctgaaaatcaggttcaagtataacttttggcccttcacgtctctggaggtttctgtccttaatagtcttacatgcattagaattgttgattgtaccatctcttatgtccctaacactgtctttccccacttgatccatgctttttagtttcatgaataagaaaagtgaatctcataaaggtaaaatgacttactgcagaccacacactgggatttgaacctaggtatgttgactgggatttgaacctaggtatgttgacaaatcacaaatcagctgggatttgaacctaggtatgttgacttcattgcaatatgcatactacatgccagttgtttcagtggatgagaattatgaaacctgtgcattgatatacaaacacgaggtgttaatattatgaagtgccacctgagatacacggtaacccctatagcagagggtttatagttgatttaaggagaactgatacataaataacaaaacatagtgtcaatgattcatataggcaaaaccagctactaaagtcataattatttttagccatatagaatattttttgatattttattaatctcattttgtgtctggattcttgtacttagcataatgttttcaagattcattcatgttgtgtgaatcagtagttcttttctattactgaatagtattctattatatgatataccaccatttgtatatccagtcatgggttgatgaacatttttgttgtttcacttgtggagcattattaataaaactgctgtgaacattcaaatacaagcttatgtgttgacataagttttcatctctctaaggtaaatacctagaagtggaattgctgggtcatatggtaagtgtatatttaactttataagcaattaccaaacatgtttcccaaagtgtttgtacaagttggcattcccatcagcaatgtgtatgagagttctagtgccctgtgtccttgccagcacttggtatggtcagttttttttgttttctattttagtgattcaagtgagtttggtgctcagtgtggttttaatttgtatttccctaatgactaatgatattacgaatcttttcatgtgcttatttgccatcagcatattttctttggttacataagtgtttaaatcttttgcagattttttattgagttgtttgtcttgttattgtcttattcatgttacaagtcctttatcacatgtgtattttgcaaacattttctcccaggctgtcatgtgtctttttcttctcttaactttttaaaggcttttccaatatctcctgcttaaaatccagattagaaagctcatgaggttctactttctcagtcttaactttttaaagttaagagattttgaagagcagacatgttttatatcttgatacatcagtctgtttatgttgctataaaggactcatgaggcaggataatttataaagaaaagaagtttattttggctcatggttctgcaggctgtacaggaagcatggtgccagcatctacttccggtgagggccttgggaagtctacagtcatagcagaaggcaaaggagagtcagcaagtcacgtggcaagagagggagcaagagagatggagggaggtgccatactgttttaaacaaccagatctcatgtgaactactcattaccatagggatgacaccaagccattcatgagggatcctcccccatgacccagacacccccatcaggccccacctccaacattgaggattacatttcagcatgagatttggagcggacaaacatctaaactatatcacttaatgtgcagtttttcaattaaaaaagatagtttgtggttctttgtatcctatttaagaaatctgggctgggcgcggtggctcacgcctgtaatcccagcactttgggaggctgaggcaagtggatcacgaggccaggagatcgagaccatcctggctaacacggtgaaaccccatctctactaaaaatacaaaaaatagccgggcgtagtggcaggtgcctgtagtcccagctactagggaggctgaggcaggagaatggcgtgaacccaggaggcaaagcttgcagtgagctgagttcatgccactgcactccagcctgggcgacagagcaagactccatctcaaaaaaaaagaaaaaaaagaaaagggaaatctaagccaggcagggtagttccagctacttgggaggcggaactacccttgggaggggtggactacccttgggagggagactacccagcctagtagttccagctactttgggaggcggaagtgggagaatcccttgagcccaggagttagagaccagcctcagcaacatagtgaaaccccatctcagaaaaaaaagaggaaagaaaagaaatttttgcctaagccaataatactaaggttttctttttttttttctttgagacagagtctcgctcagtcgcccaggctgatctccgctcgatctccactcactgcaagctccgtctcctgggttcacgccattctcctgcctcagcctcctgagtagctgggactacaggcgcccaccaccacgcccggctaatttttttgtattttttttttttagtagaggcagggtttcaccgtgttagccaggatggtcatgatctcctgaccttgtgatctgcccgccttggcctcccaaagtgctgggattataggcgtgagccaccgcgcacggccaatactaaggttttctcgtacattttcctataagtttttacgttgctatattcctttattttcctagaactttcctagaagttttctaattttagctcttaaatttaagtctatggtaagttttgttttttgtgtttttccaagacagtcttgcttggccggagtgcagtagtgcagtcacagctcactgaagccttgacctcctgggctcaagctatcctcccacctcagcctcccgggtagctgggactacagacatgtgccaccacacccagctaatttttaaattttttgtagagatgaggtctccctatgttggctaggctggtctcgaactcttgggctcaagcaatcctcccgcttcagcttcccaaagtgctgggattacaaacatgagtcactaagtccagccttatgataaattttgagttaatttttatatatggaatgagaggaaaggtttatttttgtatcatatgaatatccaatcattccagcaacaaccagtcaaaaaagattataatttcccatagaattgctttgtacctttgtcaaatatcaattgactatgtaattgaggatctgtttctagattctgttctgttccattgatgtacgtgtcttatcttcatgccaatactgtactctcttggtagctcagtggttctcaatgaaggacaattttgcccctaggggacatttggcaatatctggagacggtttttttttttttgagatggaatctctctctgtctcccaggctgaagtgcagtggtgcaacctccgcctcccaggctcaagcaattctcccgcttcagcctcccgagtagctgggattacaggtgcacaccaccacgcccagccaatttttgtaattttagtagagatgaggtttcaccacattggccaggctggtctcaaacacctgatctcaagtaatccacccatcttggcctcccaaagtgctggattacaggcctgagccaccgcgccaggcctggagacatttttgattgtcacaacttggggggtaggcaggaaggttgcccctgggtagaggtagaggccagggatggtgctaaagattctgcaatgcacaggagagtcttccagaacaaaaaattagctggtccaaaatgtcagtagtgccaaggttgagaaactctgctgtagctgcatactaagccttaaaaccagatagtgtaatctttcgattttgttattttacaaagttgtttgagctatactaggtcctttgcattttatataaattttagaatcaaccttatacatttctacaaaaaatatctgctgagatttgattaggattacattgatctatagataaatttgggaagaattgacatattaacaatttttaatctcctgattgattgattttttgagatggagtctcactctgtcacccaggctggagtgcagtggagtgatttcagctcattgcaacctctgcctctcagattcaagcagttctcctgcctcaacctcccaagtagctgggagtatatatttattttatttttatttttttgagacagagtctcgctctgtctgtcacccaggctggagtgcagtggcgtgatcgtgactcactgcaagctctgcctcccaggttcataccattcccctgcctcagcctcccgagtagctgggactacaggcacgtgccaccacacccggctaatttttttgtgtttttagtagagacagggtttcaccgtgttagccaggatggtctcgatctcctgaccttgtgatccgcctgcctcggcctcctaaagtgctgggattacaggcgtgagccaccgtgtcccgccactgggagcatatagaaaggctagaagagaaaacagggaactaaaagcaattcagtgtcgcagaaggataggtgtctgggataagagtaaagatgaaaacaagaaccattatcataaaggatctttttttttttttatttttttttttttgagatgaagtcttgctctgtcacccaggctggagtgcagtggctggatcttggctcactgcaagctccgcctcctgggttcaagcgattctgcctcagcctcccgagtagctgggattacagacgcttgccaccacgcccagctaatttttgtatttttagtagagatggggttttaccatgttggccaggctcgaactcctgacctcggcctgtgatctgcccgcctcagccttccaaagtgctgggattacaggtgtgagccaccacacccagcctgaatcttctgatttataaacatgttttttctctccattaatttgtcttctatagtttcagcaatctattgcagtttccattgtataactcttgtacaattttgttagatttatccctaaatatttaatattttatgctattgtaaataatatgtttaaaatttttaatatctgattttgttttgttggcagaagatagaaatacagttggcttttgtatattgaccttgttgcctgtgaccttgccaaactcactcctagtccatttatatagattctataggattttccatatagaccaatattttgtttatgtacaaacaaattttacgtattcctttcttattttatacctttcatttcctttattacactggctaagccctctagttcattgtcaaaatagtaaaggtatacatcattgtcttgttcctgattttaggggaaaagcattcaatttttttaccataagtatgatttttagctatgggttttctatagttgctttttagcattttgagtaagttcccatctattccttgtctgctgagagtttttgtcatgaataattgttgaattttgttaaatgccttacctgcatctattgaagatgatagtgtagttcttcttttttattctgatgatatggggaattatattgattgattttccaatgttaaatcaaccttctgccattcatgggataaactcaggcatatgttatcctttttatatattctagaattcagttagctaaaatttcatttagaatttttgtgagtgttcatgagggatattgggccgtagtttacttaaaatggttttgttttgttattttctttgtttgtattccttttctgaagtaccttttaaccttagttgccatcttactttctctcactattttcagaggatgaacactttttataagaaatctgctgtgttttgagtgctatatgccaggaactacaagaaacccttcatattcgttatttcatataatcctcagaaccttcttcaagatagatgctattatgatgcccattttagaggtggataaaacggagactcagagcagttaatttcccaagtgatagaggcagttcaaattacgtctttcgggctgggcacagtggctcatgcctgtaatcccaccactttgggaggctgaggcaagaggatcacatgagcccaggagtttgagaccagcctgagcaacatagtaacacattgtctctacaaaaaaattaaaaattagccaggcatggtggcatactcctgtaatcctagctactgggcaggctgaggtgggagggttgcttgagcctgggaagtcaaggttgtagtgagctgtgattgtaccaccgtactccagcctgggcaaaagagcgagaccctataaaataaaaaatcaggtctttcaaatcagaggttgaaaacggctctgcatttatatctttctttagaaatattttattaatctgaaatattactgacaaaactaggaggaatttagaaaactatacctctactaatcttttttctcttcttttgattttttttttttttcccttaagacagggtctctctctgtcatccagactggagtatagcggtataaattcggctcactgcaatctgtctcccaggctccagcaattctcctacctcagccttctgagtagctgagatgataggtacatgccaccatgcccagctaatttttgtatttttagtggagacgaggtttcaccatgttgcccaggctggtcttgaactcctggnnnnnnnnnnnnnnnnnnnntgagcccacctcatcctcccaaggtgctaggattacaggtgtgagccaccacacccagctaatctcagagcacctctttatgctaattggttttgatattctctgtgtgcttatttttcagtttgaaagtgtctaataattagcatattagggccaggagtggtagctcacacctgtaatcccaacactttgggaggccgaggtgtgtggatcacctgaggtcaggaactcaagatcagcctggccaacgtggtgagaccgcgtctctactaaaaatacaaaaattagctgggtgtggtgacaggagcctttaatcccagctacttggcaggctgaggcaggagaatcacttgaacccgggaggcggaggttgcagtgaaccaagatcgcgtcactgactgcactggagcctgggcaacaagagcgaaactccatctcaaaaaaaaaaaaaaaaaagcatattagttcactaatttgcaagttttatcaagcacacattattgtgaattaacttgagtgtttctaattggatatgtcaacctaaaatgaagaaatggaggcaaaactaatataagtggagagtttatttgggccaaacttgaggattacaacctgggaacatagattcaagtttccctgaatatacactcctgttagcagcagttacaagtggagtttgaaaggcaaaatagggggacagggggtggactgtacaaagttgtttgctagcaattctcactggtttacagaaccagtgagaattgattagtgattgactatacgttgttaacctataaggtatggattatagtgttattataattcacacctgatgtggattattaagctaatttatggctacttatggcaatagtaagcagtttaaacagatgaatacatagctcaaaggaggggagtaggcatgattgtaatctcattttaatgtctatctgggcctgatatttaaaaggacttgcattcctcagataaaagttcttttcttttctcagttgctacagtgcttcagtttaaacttcacatctattggaagtctttcaacgttgttaatctggattagagatccttgagagaaaatgccactttcttttttactatactgtatttaatatgctcaatagtatcaataggcatatttctgtttatgtaagattgtagtgtggctgaaggctgaaggggggcaagagcacatgagaagctattgcttccacttatctgcttttcccaggttgaatgtgtgctagattattttaggaccttttgggctcaaaaaatcaatggggaagcctgaatttagatgatagctagctggtgggacccaacttaattttctgtcttatgcttcggtcaaatttgggaatatacacaaaaaagcaaagctacaaatagagattggcaatacagattaaaatgtgccaggcaacaggaggaatttcgatgagtagaaatgaagattgatccctgagacaaaatagcggggacaggcaggaaaaaggtagatttctacccttctctacttcatacctacaaatttaaggaagtaggatctttaccaaccagaaacttggcagcttcccaccaacgccgtgttgcaactgctatctgcaacatccagggctctttttctccctcccatctctcttatcattacctctgtacttcccttagtgaccacagctctgtaaaggcagtggcagaagtggatttgttgggggtacgttttcagatgtgatgaaggtagtggtgagaaggggcaaagagaagaaaatccatgggagtagtatgccttttctcaggccctactttagacagacacacagattaagctttttattatggaaaatttcagatatttacaagagtaaagagaacagtttaataaaccagtcaccaggttaaacaactcttggttaggtcctgtttttgactaggggagaactatattctgtttcaaagtatgtaggattagattgccaatcacgtgcacatggaacaagacaacagggtcagaagatcttccttagtttatcagcgccatagtaaatcaggggatccctacattagatccacaaattgactttaagtcatgacaaactgaattgatgagcaaaattgtgtgctctagatagtatataattttaatttgatcctcaaagggatctttaatcctccaaataggtgagagccatagtattatgtgactgctcaatactaggtctggcttgtgtggataaagtttaaagtcaggccaggcacagtggctcacgcctgtaatcccaccactttgggagaccaaggtgggcggatcacttgaggtcaggattttgagaccagcctagccaacatggtgaaatcccatccctactaaaaaaaaaaaaaagtacaaaaattagccaggcatggtggcatttgcctgtagtcccagctacttgggaggctgaggcagaagaatcctttgaacccgggaggcggaggttgcagtgagctgagatactgccactgcactccagcctgggtgacaaagcgagacttggtctaaaaaaaaaaaaaaaaagtcaaataatacctaggtggacagagaccacctagaatttacttaacttttttcttagaaaacaccaaacctggatagatttctcaactttcaaataattgacagaaatttttaaaggcatcgtgggatttattaagaaattcttcaaaacacgaccaggtgtggtggctcacacctgtaatcgcagcactttgggaggccaaggtgggcggatcacctgaggtcaggaattcgagaccagcttggccaacatggcgaaatcctgtctctactaaaaatacaaaaattagcccggtgttgtggtgggcacctgtagtcccagctactggggaggctgaggcaggagaatcacttgaacccgggaggcagaggttgcaatgggccgagatcgtgatcgtgccactgcactccagcctgggcaacaagagtgaaactccgtctcaaaaaaaaaaaaaaaaggaaagagattctgcaaaataaaagaaggacatctgatatttaagaaacagaaaaaaattatactttgaaaaagttgagaaaggaaacaatattagatggtattttctttattctcatggggtttgtttaatgaatctgaaaaatatgtagaagatagcagattgccatagaaggaaaccaactgagatgtcagcaattataataataataactaaatatatattgagtaccagattctatattaaagccttcatgaattagctaattaaatctaagtaaatggttattcccaagaacacggaggtaaagaggttaaattacttccctaagattgtataactaataagaaggaggtctcagatttgatcccaaatacactttgacttcagggacctagagagagaagaaataaggatgatttcacaggatcttggatcatcctttgtactcttctgcgttggaattttaaaagaaattatttagggccgggcacggtggctcacgcctgtaatcccagcactttgggaagccgaggtgggcagatcatttgaggtcaagagttcgagaccagcctggccaacgtggtgaaactctgtctctactaaaaaatacaaaaattaggccgggtgtggcagctcacacctgtaatcccagcactttgggaagccgagatgggcagatcatgaggtcaacagatcgagaccatcctggccaacatgatgaaaccccatctctagtaaaaatacagaaattatctgggcgtggtggtgcacgcctgtagtcccagctacttgggaggctgaggcaggagattcacttgaatccgggggaggcagaggttgcagtgagccgagatcgcgccactgcactccagcctggcgacagagcgagactccggctcaaaaaaaaaaaaaaaaaaaaaaaacccttttgctgctgccgccgccgcagccatgagtatgctcaggcttcagaagaggctcgcctcttctgtcctctgctgtggcaagaagaaggtctggttggacccgaatgagaccagtgaaattgccaatgccaactcccgtcagcagatgcggaagctgatcaaagatgagctgatcatcagcaagcctgttgacagtccattcctgggcttgatgccggaaaaagaccttggcccgccggaaggcaggcacagtggcataggtaagcggaagggtacagccaatgcgcgaatgccagagaaggtcatgtggattctgcgccggctgcttagaagatactgtgaatctaagaagattgatcgccatatgtatcacagcctgtacctgaaggtgaagggaaatgtgttcaaaaacaagcggattctcatggagcacatccacaagctgaaggcagacaaggcccgcaagaagctcctggctgaccaggctgaggcccccaggtctaagaccaaggaagcacgcaagcacggtgaagaacgcctgcaggccaagaaggaggagatcatcaagactttgtctaaggaggaagagaccaagaaataaaagctccccctttgtctgtacatactggcctccgtgattacatagatcagccattaaaataaaagaaacctttatctgcttgtaaaaataaattagccgagtgtggtggcatgcgcctgtaatcccagctacttgggaggctgaggcaggagaatcgcttgaacccaggaggtggaggttgcagtgagccaagatcgcaccactgcactccagcctgggtgatagagtgagactcagtctccaaaaataaataaataaataagagtaaaaataagcggccgggcgcggtggctcacgcctgtaatcccagcactttgggaggccgaggtgggtggatcacgaggttaggagatcgagaccatcctggctaacacagtgaaaccccgtctctactaaaaatacaaaaaaattagccgggcgtggtggcaggagcctgtagtcccagctacttgggaggctgaggcaggagaatggcgtgaacccgggaggcggagcttgcagtgagccgagatcgtgccactgcactccagcctgggcgacagagcgagactccgtctcaaaaaaaataataaaataagcatcgccgggcacggtggctcacgcctgtaatcccagcactttgggaggccgaggcgggcagatcacctgaggtcgggagttcgagaccagacttaccaacaaggagaaaaaccgtctctactaaaaatacaaaaaaattagtcgggcatggtggcccatgcttgtaatccgagccacttgggaggctgcggcaggagaattgcttgaacccgggaggcagaggttgtggtgagccgagatcaagccattgcactccagcctgggcaaaaaagcgaaactccgtctcaaaaaaaaaaaaaaaaaaaagcgtccaggcaagaggtagaaaagagactgctacaaaaagctatatataaaattcatcacagattttctgctgcactaataaatggtaaaaaaaaaaaaaaaaaaaagaaaagaaaagaaaagaaagaaaaagaaacactggccaggcacagtggctcacacctgtaatcccagcactttgggaggctgaggcaggcggatctcgaggtcaagagatcgagaccatcctggccaacatggtgaaaccccgtctctactaaaagtacaaaagtacaaaaattagccgggcgtggtggcacatgtctacagtcccagcttctcaggaggctgaggcaggagaatcacttgaacccaagagatggaggttgcagtgagccaagatcatgccacaacactccagcctggtgacagagcgagacttcatctcaaaaaaaaaaagaaacactatttacagtgttattaggaaaaagaaaatgtctgcactgttattagcaaaagacaataagcgatagtgttgaagagcagtgaacataatagagtgacaaatataagaccaccttattagtaattagaataaaaatgaatatgttaacatataagtttaaaagatagactcaggaattgtcaaaaaccatatctaagactcacattacctgatttttgaggcctactataaagctgcagtaatcaagataatgtgttattggcaaaagaatggacacatatatcagtagaacagaataaagagcgcagaaatggactcacccaaatatagtcacctgatctctgaaaaaggagcaaagacagtttaatggaagaatgggttttttcaacaaatgatgctagaacaatcaaagtccgtatgcaaaaaaatgaacctaggcatagaccttatacctttcacaaaaaattaactcaaaagggatcatagacctaatgtaaaatataaaactataaaacttctagaagaaaatctgtgtaaccttgggtttggcaatgatttttagatacaacgccaaaagcatgattcatgaaagagaaaactgatgttggtgtttgttaaaattaaaacttcttgtattagtccattttcatactgctatgaagaaatacctgagatttggtaatttataaagagaagaggtttaatggactcacagttccacatggctggggaggcctcacaatcatggcagaaggcaaaggaggaacaaagtcacgtcttacatgatggcaggcaagagagcgtgtgcagaggaactgccctttataaaaccatcagatcttgtaagacttattcactatcatgagaacagcatgggaaaaacccgccctcatgattcaattacctcccacctggtccttcccatgacacatggggattaagggaattacagttcaagatgagattttggtggggccacagctaaaccatatcacttctactctgagaaagatactgttaagagaatgaaaagacaagtcatggactggaagaaaatactttcaagatacatttctgttaaaggactttgtggttagtcaattgcaaagttttgaagccatgcacaagtcagccctcacttatgacatcagttgcaagttcaggggtttccagaacttcctttaggattgataattcactaggagaattgacagaactcattgtaagctgttatactcacagttacagtttattacagctgaaggagacagattaaaatttgtcaaaagaaaaggcacataggacagagtccaggaaattatcaaatacagttataaaccccacaatacatttttagtggttgctttagagtcttgattatcttttttttttaaaaggtcttgctctgtcatccaggctgcagtgtagtgttatgatcatggttcactgtagcctcaaactcctgggctcaagtgattttcctcccttagcctcctaagtagctgagagtacaagtgtgagctagcacacccagctaatttattttttattaaaaaaagttttagctgggcgtgatggctcacacctgtaatcccaacattttgggaggccaaggtgggcagatcacctgaggtcgggagttcaagaccagcctgaccaacatggagaaaccctgtctctactaaaaatacaaaattagccgggcatggtggcaatgcctgcctgtaatcccagctactcgggaagctgaggcaaaagaatcgcttgaacccaggaggcagaggttgcagtgagctgagattgtgctattgcactccagcctggataacaagagcgagactccgtctcaaaaaaaaaaaaaaatttgtagagatagtgttttgctacgttactcagggtggtctcaaactcctggcctcaggcagttctgcctaagcttcccaaagtactgggattacaggcagaagccactgcgcctaccatagaatattagttatcttttgaagtgattaaaaagggaaaagattttcttccagtttaatgatgagaaaagtgaaagaacagttattttaaagcccctgatatttccaacatctaggtcataaatgagtctcgttctgttgatagctttatctcttggtaatgtgcatgcctgtgtgtgtgtgtgtgtgtgtgttttattttgtgtatgtcttataatttttagtttaatggcaaacatcatgtatacaagaacagtagagactgaggtagatggtattttgtgtctggatataggcacgcctctcccatcaggccaattgcctgtgacattgagtcaacctagtctggagttgaggtggatttggattttgatgttggtatcattatgttcagtgtacttgggctgctgttacctggtacctggagcctggggtaccagatggtttttcttcagtgtttctgttccactgttggctttcctcagtcccatcatgcctccatcacagagggggagtctctattcatatccttgccccttcactagtggttgactgatgctgcttgttactcagtgctaggcttatggtggtgtcataggtggttttctattgtcctggttcagccttagctttaggcagtccctgttcatttgaaccccaggggtggtacttaatctgccctttcctgagcagtagcaaacctctgcttggcatcagaatcctgggccaatgaggattctctcctgctctcccagaaacaagatgtttgcttctacctctcccccagcagcaatagggtatgtgagaggtgggaggtttacttgaacccaggaggtcgaggctgcagtgagccatgatagtggcaccacactccagcctgggtgacagagcaagaccctgtctcaaaacaacaacaacaacccaaaaaactgtcaaggtcatcaggaacaaaacatagccaatagccaagaaactgtcacataccagaggagactaaggaaacatgatgactaaatgcaatacaaataaaaaaataaatattggcactgtaagaaaaaatagggcagcagaatgggtaattcacaggagaagaaatgcaaatggctaataaaaatatgagtatgaattcaacttcactagtaattaaactcaaatgtaaatgacaaaaactgatttttgccagtgacattagcaaaggattgtttttgttaatactagcatttggcaaggttgtagagaatatgggaactcagaataatacagcctctctggaggataatttgcgcagtatcatatcaaaaggcttaaaattgtacaaattatttgacttagccatgtctgtgccgttgatttatcttaataaagtaaaggaagatctgtgggaagatttagtcaaagggtgcctatcacggcattgttaataataatgaaaaattgaaagtagcatgataattaacagtatattgtgatattcttgtatggtgatattctgtagatattaaaagttaaacaatttgttaagttcaaaaagttaaactaacatgtatggtgtgatccccttttttgtaaaaaaaaatatgtatcatagaaagactcgatatgtgtacacaaaacattaattgtaatttttggatgattgaattctagatgatttttgtttcctcctgtgtgcttttctatattttgcagttttttctgacatgagcatgtgcagtattttggacattatataaaaagctatttaaaaacgaaatctttttcctctatcaattagcaaagattttcttaaaattattacctttgttggcaaaggtatgagaaattggtatctttattttatatccacttcttattctacatctatttaattcttctcatctacagtatttctacttattctcttttttttttttttttttttttttgagatggagtctcgctctgtcgcccaggctggagtacagtggtatgagctcacctcactgcaagctctgcctcccgggttcacgccattctcttgcctcagcctcctgagtagctgggactacaggctcccgccactactcccgactaatcttttgtatttttagtagagacagggtttcactgtgttagccaggatggtctcaatctcctgacctcatgatccacctgcttcggcctcccagagtgctgggattacaggcgtgtgccactgcgcctggcccttctacttcttctttatatctacttctgtaggggatcagcacaagcactcttgggaagcaaattggtaataaatatcaaaccccttaaaataatttatattctttcactcagtagaaaggcttctgggggatttgtcattagaaaagaatcagagatgtgggtggagacatgtttattacatgataatgtataactgcaaagtatgaagactgtaaatatccacttaaaagggaaataaaatatgacacaactgtatagtggaatattatgcattcatgagagtatttaaagaatatttattgatgtctgataatcttcttgcttcttagtcttctgctcagaatggcatccatgattatgtttctttccccatgttttttactgtagtcccagataagaaaataaggactggattccctctcttactttgtgtaaataaccacaactagtaaattacttttccccccacaaaaccatttccttatgtgtatttgtcttcctcagtttcaatttatttgctttactttaattatgggtattatgtgagcctttgcacagttctgtttttctgcctgaaattatcttctccctgcttttaccatggctgagacctcttcaccttctaggttgcagcttaaataatactcagagaggtcttcttggaccaccttatctataataaaagagcatacaatgtattactaataccctttaccatctctctaatgcccactagtttttttcattgcagttaacacagttgatgatgtttttgtatttatttgcttgtttataatgtgtcctccagtagactgtaacttcctgaggctaggaattatatcttcacaagtatatttttaggtcctctcctaatgtctggcacatgtaaacagtcagcaaatatgtgtagattgaatgaacaaactaaattttgcagttttgatgacagcttattaagaatttatcatgttacttagttgaaagttgtcataccaaagttattcttataacacatatttattttagctatattggtttgatatttaatatattttatgtaggaatgtagaggaagaagtttaggttacactcgaggtcatagagagtcttataacgagttcagactaccattggacgctgaggagtgtgtagaatttgaagagacaaagaagagggggaaagacattttgaacaagactgccccatgagttttttaagacaggacagcaggaatatctttagcatgtttgggaaaacatgacagagaattgtgggtgactaatggagctacttgctggtaattataaatggaatgttactagttagaaaatttcatctaggtctaatcattaagagcctggaaagaaggccaaggtagttggaatatcttttgtattcagggcagttcttttaacagatgggaagctactgaaggtatttgatcaagtgaaggtcccttgtcatttattaatttgtttattaatagatatttattgagtgcatgctgtctactatgtggtcttctagatgaggagggtacagagatggaataggagggctggagagccaaaaaccggctgtggaggaactcgcagactacgggaagtgacagacatgcaaattacaaagggttgtgataaatgttgtaataaatgcacatcatcaatactgtgggaactcaaaataggaccaggtttattcagatagttgtgaatatcttaactaaggaggtgacattttctatgggttttggaggataagcattaatttaccaggtaaagaaaattctgaccttagcagtaaagtcatggaccattcagggaatggtaaataagtcatgcacctggaattgtgggagatgagcctagaaaaacagttatcctaaaacagttatccattaaggaccttgtattatctatttaatgaggaaccatcaaaagttctcatatagaggactgaagtgatcttctttattttttttcccatccagaatagtttacttggcacaaatggactagtatatgacatggagaacagtattaggctttagttagctttttgattaaaatctactcattgaattcatatctgtaattaatactgatagtcaccaagtatgtggactttgagaagtcaagaacttgattagtatttagtccattttcacactgctgataaatgcatacctgagacatggcaatttacaaaagaaagaggtttaatcggacttacagttccatgtggctggggaagcctcacaatcatgctggaaggcaagaaggagcaagtcatgtcttatgtgtatggcagcaggcaaagagaggagcgcttgtgcaggaaaactcccacttatagtaaccagcagatctcatgagtcttaccatcacaagaacagcaccagaaagacctgcccccatgattcaattacctaccaccaggtccctcccacaacacatgggaattcaagatgagatatgagtggggacacagcgaaaccatatcagttagaatctcagttttaccacttgctagcatttatgcaagttatttgatattagtaagcctacgttttctcatctctctcaatgaggcttatgagtggtttatgggcacttttgaccaaggagatgtaatgaggttgctgttagatgggggagacagtcaaatgagactcttgattagacatactattgtctcagtgtactctgagtgctgagtgaagacagaccttgagacagccataaaaagatagaaatttaatccataaatgcaattagttcaaagtaggtttttgtatggcatgcttaaagatttggaggcaggaactactgaaagtttttaagcaggaatccatatgttccacttttcccaaacagctcctaattatttatggtgtgcccctttcactcctaatggtaattcagtttagataataaattatgtaatcagtcaccttctgaaacaacagtacagcaaaagagatggctgtggttgagccatttagaatacaagtaataagaaaaaaataaaggaaccactccacaagttttggggtggaaacagagaaggaatagtctttataaaagccaagagaaggctgggtgtggtggctcacacctgtaatcccagcactttgggaggccaaggcaggcggatcacgaggtcaggagatcgggaccatcttggttaacacggtgaaaccctgtcactactaaatatacaaaaattagctgggtgtggtggcgggtgcctgtagtcccagctacttgggaggctgaggccgtgagaacctgggaggcagagctttcagtgagccgagattgcgccactgcactccagcctgggtgacagagcaagactccgtctcaaaaaaaaaaaaaaaagccaagagaagattgttgtaatagtattaagaagatgggatttgtaagatcagcaaggccagatacagcaaggctatggagcataagcacacattattagatttatcaaggcagagctcattgtctgctttagacaatgcagttcatttgagcagttggatagaagccaaattgggtttttgtttttttgttttgttttattttttgaggataaggacaatgtcttgtttatttttctctctctagtgcctaactgtggttgtgtcagaggtacttggtgcatttttgaagatttaataattaattaatagttggtgcaggccaggcatggtggctaacacctgtaatcccagcactttgggaggccgaggtgggcggatcacctgaggccaggagttttagaccagcctgaccaacatggagaaacgctgtctctactaaaaatacaaaaaaaattagccaggcgtggtggcgcatgcctgtaatcccagctactctggaggctgaggcgggagaattgcttgaacctgggaggcggaggttgaggtgagccgagatcacgccattgcactccagcctgggcaacaggagcaaaactccgtctcaaaaaaaaaaaaaaaaaaaaaagttggtgcaaaagctgagatagtggctatagataccacactaaaaaattttagtgattaaagagagatgggaagtatgatgtttttagtttggttagcagttagaagggaacaatctctgcatttgaagtgttaagatgaactcagtgggaagagaaatattaaagtttctgaagagggaagtaagtttgaaagctaaagcccttgttgcctacaaaagacccttttgcaaagtggaccctcctggttcagttatctcaccctttgggattctgtgtgccagctgagccaactaattcctttcatgttaaactagtttgagttcgatttctgtcccttataactaaacaaatacttgaatttggatgaagtattctgactctaatgctcatgctgtctccactgtaccatatttcttctctaaggctaaaggtattatctccaaaattttgtccctccctaacttgtgggggctttagtgaactatttctgtcctctctagaatctttgctttctttccctcctatagatccctcgccacgtagctcgtgtaggcctcccttatctttgtgaagccttaaacttaattctgtgggccccactaagttgtgataaagcatgcataggggttttggtagaagataacgttaacacaggtagattggagctgggtctatgttgaaaaaaatttggattactaatttaagtggtttgccattgatttctagatcagagatgtttaatagaactttcttcagtgatggaaatgttctatatctacagtgttcaatacagtagctgttagccacatgcagctccatagagcacttgacatgtggctagcatgactgagaaatcaaattttaaatttaattttatgtatttatctatttttataagacagagtctcactcagtcgcccaggctggagtgcagtggtgtaatctcggctcactgcaacctctgcctcctgggttcaagtgattctcctgcctcaggctcccaagtagctgggattacaggggcctgccaccatgcccagctaatttttgtgtttttagtagagaggggtttcaccatgttggccaggccagtcttgaactcctgacctcaggtgatccacccgccacagcctctcaaagtgctggaattacaagcataagccactgcgcctggctgattttatttaattttaatcaccttaaatttaaatggccacatatggctaaggctaccattttggatggtatagctctagacatcagaagttatatttctcattttgttttgtttttaaactgggagaatgatatatgttagaaaaaaaatggaaacaatgtgggcatttgggtggtgaggatgaggcaagaagaaaatcactttctgttcttgatattaatgcctttaacaaggatgaggaacctaggaggatgagtgggtttgggaaggtagacaggaagttcaatactgagttgagattatgggatatataaacagagatgtccaataggcatctaaagaagagtttacagcagaacagaaaaagccagggctagaagtataaatttctgtagtcatctttgtagaggtgataaagctatagaatataggtcacatcctctagagtgggagtgtagatcttgaagaaaagagcattgagcacagaactcagaaaaatgtgcatattgaaagagtcgagctaagcgtagtagctcacactcgtaatcccagcactttggagggaggcaggaggatcacttgagcctaggagttcagcctgggcaacatagcaaaaccctgtctctataaaaaatacaaaaattagccaggcatggtggtgcacacctgtggtcctggctgcttgggaggctgaagtgggagggatcacctgagcccaggagattgaggctacagtgagctgtgatcacaccactgcacatcaactccagcctgcatgaaagaacaaaaccctctctctcttaaaaaaaaaagagagagagagagaaagaaaaaaagtggaaagaggaagagcagcaggcaaacaggaaatatgaaatatttactatgcaatgtttttaagaaattggcacctaaccatgcaagtgatagcagaaagtttttgccttaggtgtagtgcttgtcaggaagatcaatattttacttgaaaatgtaagtacaggtacaatgtaactaatttctactgcttcattatatagatctgatagatagtttttatttggccaatgcctgccatcattacactattatagtgttatttctgcctatagaatcataaatgtgtctgttaaatgggcttaatatttgggcagattgccaataaatgtcacaaactccagtccaaataaatcagtttataaacctaggagaatgtctagctacctttggtgttttccagataatcagtagttgtaattaatgatgtttaaatggattttctacataagattaaggagaaattgtttgacacaacctatataatctgcatttttatcatctgagtgggaagtcttattactttccccacactgtgtcatacacttgcagaagaacataaaaggtagtgattatgctacgtgccaagaaagacatcagagcagattgaaggggtgtagtatgagtaaagaatttgagaccagagaaaaggctctggaaaggaaggcaagcatggagaaggaaacttgaaggaatagattggctgaaggtcagatctgtggagtagacagtaggtaacaggtcaatttgttgcccagctcagtgcctgatacataataggtgctcagtatttattgaaggaaggaatgggaaaaggaaaattcattctgcaagaacagtagaatcctactttggccccaccttattttatttgtcacttgacctcagttatcacatctttctgaccttgggttgctgttaggtttattgttaaaacatacactaaatagtttatattttaacttgtaattgttgtctagctctggacaattggagggccgggggggtgctctcctatttagagaacacgggaatacgccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcgcgccactgcactccagcctgggcgacagagcgagactccgtctcaaaaaaaaaaaaaaaaaaaagagaacacgggaatatacttgagtacttggatgtttaatttccttttgttttaagactataacagagtaggtgtgaccatatctagcccctgaatattctggccttgggtgacacaggtgagcacttctagctgatctgacaggttaaaggtgtacacttattttctctgtaagaagcgtcatctggtaagatgatcaagaatggtgcaaagcaggatggggagtttaaaattgtttccaaatgtgggaatgtaaatgaatataaacatgtaagattttaatataccaaactgatcagattctgtgtaatttccaagtttcttttttctttcaaaactcctctgaaatctgactgtccacaaaaacttactttatagaattttatgtgatttatttactcagatattatactgacctcacatccagtagtgaaaacagattttattgtagaatctggaaagatagagggccatataggttgtattttcagttttgtttatactaacacgtgtttacaacccagtttaatttacaccctgtattgtattattgttgtcatatctctgtatgcatgtaagtataatatgtgttggcaaaggaaaattttgagtaagaagaagctctctgatctatttgattcaatatgtatttgagtgtctaacagacactgttttagacactggtgatacaacactgaacggagcaccaaatactttacagcgtctcctggagctgttgtcaagacatactttccaaggggaatatttcagaataggtgataactagtcaacgaaggaaaagtaccttagtcatctaggagagttgtacttagagtgaactgaaataaactaagctcacgaaagacagagattttttgtttggcttttgtctgttgcattcactactgtatctccagggcccaaaatagtgctcggctcataataagtattcagcaaatatatgttgttgattggagtgtttgttttgaatttctgtaatcaaacacataccttggtaaattatctttacatcttgctagttgaaaattttatctcagttgctttgtttttaatgttaccttgctttttgtttctacttgtgccatacatcaggatgctggaaaagcttattaatattgacagtcatatggttatctgatattgaaaagaatagatttggaaaggaacctaagaggtcatcttttgttcagcttcctgcctaggaaaactaagtaagatgattaggtatgtatatttaattagtcatttaaaaaaaaccaggacaacataattgagttccctcttgagaaaatggagaaaggtacttaaccctagctataaagggactaacctggaaattttagaacttctgtgtgggaaagtggaaaaaaaaaaaaagcacaactaagctgctctttgttgatatcagaaatgggcctgtcattcattttggcattgaagcatagcctcctatctcggggcaggactgggacatttttttcctcccacaagagctggacagttattacaggttcaaaaagccccgaccagtttttcaagagtttctcctcctcttttccccctgaaactcgtggtgcttttgctctgctttcaagatgcattaagtctcctgctttgtgactgctttggagccagcagatactctgatatgtataattcaaattatgcaggtttcacgagtaagtttaatcttattttttaagttagttaaaaggcaagtgatatttagaaaaatgttaacttgtagttatttcaccctttttactttaagcatttttattgcttctcggccttttggctaagatcaagtgtgtactttaagcattttttaaaataaaaatatccttttaatttaataagaaaacaaggttctacatagaaaagccccttcatctaagacctgcacttttcaatttcttttgcgatgtctttgttgtaaacagtattcatatgtcttttgaaagccagttaactaaacagttttcttgagcatctttttagttttactgagaagtattttaaattgagcttttctgagctcgattgcttacgtctgacacagtctcaagtttccactgaatggtaacaaagactgtagaatgttgttggtactgcagtgagaggcatgcttccttagaccaggtaagagagatcagtttgtttctcactgctgggtgagtttttacagctcttattttatattctttaagcagcagcaatattaaattgataaatagccaggagcacgctgatttcaagacgtccttgcttgttgcagacagaaaaactacagggttatgtatgggggttggggtggggggggaggggaagaattagtttattactcagttacttatataaattaattaaaatgtgaaaataattctggagctcagttttcttaattcaggaactaaagcagcagttgaggaaatcagtaattttaaaggtacttcatggttattacttgtgaaagcaattcaaaggatagtttttactttcatttttttccccagtagttaataaaataagctttgcccttaactaaacattttttccacttacgaaaacttttaaattgccaacagcaaaatatacttcccaaggatccttggaaatcaacctgacacttgaaaaatatttcagcttttatagctgtttcattcctttttttccctagtacatttttcttaaaagtatttgtgctttgaaaatgtcagctgtattctaatgaagcttaggcattgtttgctcataaaggggccggtgcattccactgctttatggtttattatgaggcacagtgtgagagtgtgggtggcaccatttggtgtctgcctcttggggtagtgactgccattatgttagccttggactggcaaagaaaatatagcatacaagatgctatatgaatctggatactgtgaagaaaatcttacccctaaacaattcttaatgaccccggaatatatgacaacttgattgaattgatcatttcaattatacccttgaagtttgcattttagttacaacgtatattctattagacacgtcttattttttgatatataatagcatttagtcattctttgaagttcaataaggaagtgaatgtttctaaactatgatgtttttaatagatacagtgaaattttaaataatacatttacttaaaaaagttttaaggaacttagtgtgggtggggagcgggagtgggagagggagagggagagggagaggaggtcaggcagagagtctttcttctttcagttaggaaagccctggtgaagaaaaaaagcaacagatgtttcttctgttacaattgaggttgtttcattcaaaactcagagtagctggaatggagagaggaggtcataaatctgatttaatcagtgaataaataaaatttagtcatttaaaatttattattttatattcaggaattgaaagtcatagagtaacaaaatgagtaacatacccaatatttaaaaaaaaactttaaatattgcctgtagcctgtataattaatgaaaatgtgagaaaattaattctgttgaacttcacttaaggaaaaaattgataattaaatcatatagaccatttttttaaagcctaagccatctaaaatatagaggaaacagttgcaaaagtttatcactagacagtaggtacaaaatctcaaaatgaaaataaaatgagaaacatcagttacatatgttgatagatgatttcatcttctgtgagaagctgaggcttattcctaagacctttgcataagaaatatgggagtaatattttgggtttaattgaaatgatatgttgcagtttgcctctaaaaagaaagataataagcttggattggttgctaatggaaagaggagaatgtttatctgctgaaaagagtaggaatgaagagtgtggaagcattatgcgtgtaatgaaagcagtcaaaattttgaaaaacagtttttgaatttttggaattcataatgaggaaagtgaaaacctttccttttacaagtaacacaaagaagtcctatgctgttgtataatgtgcgtgtatacacattacaactttattcatttcttaagtttgctcttgaaaaatcagtgctgagcaccagctctttcacatatgaggcacttattcaatatttgccataccctacactggaaaattcgtagtaatttacagtagccaataaagtttttgagctatagtttaaaatttgcatatggattaattattatacagttttctaaataattggcctaaggagagagaaggctggaaaagatatcaacattcaagcagattattaaaaattcctcttgctgttagctaagatctgtgggcttacctgaagttatttttttgttgtttttttttgttgtttttttgtttttttgagacggaatctcgctgcaagctctgcgtcccaggttcacaccattcacctgcctcagcctccccagtagctgggactacaggcgtccaccaccacgctcagctaattttttgtatttttagtagagatggggtttcatcatgttagccaggatggtctcaatctcctgacctcgtgatctgcccacctcggcctgatggtctcgatctcctgaccttgagatccgcctacctcggcctcccagagtgctgggattatgggcgtgagccactgcgccggccagaagattttcttttcttcaaataatgatgaccaaatttagagattttgaagtttgtttgttttttgagatggagtttcgctcttgttgcccaggctggagtgcaatggtgtgatctcggctcactgcaacctctgcctcctgggttcaagcgattctccttcctcagccccccaagtagctgggattacaggcatgcgcccacacgcctggcctttgaagtttattgaatcattatttcaattaagattcagattctaaaacttatctatgtacattttgcttatcttaaggaatagcaacatgtaatggttgaggttttttctctctaaaataagtaaaacaatttacatggactttaaaatggatttacaaactatagatttgcctaaagaactttttttacaattctgatcaaagaacagaaattttgatggaatagacaggcttaaaaaaaagttggtcactccacatgtaatacataactgtgacagcatcatagattgtgattataaaaaatgtgtatcacttacaattataaatgtagacatgacaataagttacttaacaaggaaaacagtatcagcaacagcaacaaggacatagtttggactcctagcccttcaaattgagaaatgaagaccaaaatcagttgaattattttaagatgaattcccactgcctctgtatgtgtaaattatcttggaattattgaatgtgtggtcaaattatggttgagaagagcacattagttttagcatatatggagtatagaacatagagagtataattttctatattatattgttgatttatactctatgagaaaccaaaccattcaagtttgttacctggaaattggttgggagtgtctgaaggaaaaaacaaacaaaaactttcctaattcatctgccatttagagataattccttaattgtctttaatttctagtaaatacttccagtcataatcaatttaaatattaaattaaatcttttttttttttctttgagacagagtctcgctgttgtcgcctgggctggagtgcagtggcacaatctcagctcactgtaacctgtgcttcccgggttcaagcaattctcctgcctcagcctcccgagtagctgagattacaggcgcccgccaccaaacccggctaatttttgtatttttagtagaaacgggatttcaccatgttggccaggctggtctcgaactcctgacctcaggtgatcctctggcctcgacctcccaaagtgctgggattacaggcatgagccattgcacccggtcttaaattaaatatttaaaatgtatactgaaagaagacttcaggagtacctgaagttcttgctttatgtatgaactctttatcacaaaactgaggtcttagaggaacctgagccttacctatttattgtaacccgattcagaatacccagagaggtcaatgatttagccttttttttctgccttacatatacatatgcaactagaaataacagccaccttgaaatttctcatctctggagtggagtaagaggggagatgtgcctgatgcctatatttctctgaagagaaaaccttttacattgttgaggagcaggtagaccagtatgagtatggtgctttgagtatattatgaattaactatgttttgtgaactgatccaggaacctgtcatgtaattatgttgtttctttctaccaagtttcaagaaaccaattttcaaatgaatttttacatggtaactctaaagctggagactatcaaccggggactttggttttggcactttgctcacttgtagtgaaaatttggcaactcttggcaatttctctgacagaaaaatgaacagaccactaagtgagcacttactgtgtgccaggtagacacagtagaacttatttataaaagttctcaaaaatcttttaatgggctgggcatggtggcacatgcctgtaatcccagcacctggagaggtaggcagatcactttaactcaggagttcaagaccagcctgggcacatggcaaaatcctgtctctacaaaaaatacaaaaattaactgggcatggtggcacgcacctgtggtcccagctactcgggagaatgaggtgggaggatcccttgagcccaggtcagggctgcagtgagtggagatcatgccactgcactccggcctaggcaacagagcaagaccctgtctcaaaaaaaatttaaaaatctttaatggataaatttttaatacaaagagattttgttgacattgatgtctaactttaagatttcttgcatttcacaatgtgatttaaatgtagcttcagtaatagccctcaagtagaatatattgttgagattataatatcaataacttactgcagttttgagtgagctacttagtgcatggtattataaaacaacgatcccctcttttatttgctaaggagaagaactgctttggaactcttaattcatgggtggtccttggtccctttgaatttgtatcctaaagttttacatttattttaagtaccccccagccaggcgtggtggttcacgcctgtaatcccagcacattgggaggccggggcaggtggatcacttgaggtcaggagttcgagaccagcctggacaacatggcgaaaccctgtctctactaaaaatacaagaaaaaaaaaaagccaggtgtggtggcacacgcccataatcccagctactcaggaggctgagacaggagattcacttgaacgcgggaggcggaggttacggtgagctgagatcacgccactgcactccagcctaggtgacacaacaagactctatctcaaataaataaaaaaacttattttaaaaacccaactttttttnnnnnnnnnnnnnnnnnnnnnnnnnnnnnnnnnnnnnnnnnnnnnnnnnnnnnnnnnnnnnnnnnnnnnnnnnnnnnnnnnncagtgacacgatcttggcttactgcaacctccgcctcccgggttcaagcaattctcctgcctcagcctcctgagtagctgggactacgggcgcatgccactgtgcccggctaatttttgtatttttactagagatggggtttcaccacgttggccaggctagtctcaaactcctgacttcgtaatccacccgccttggcctcccaaagtgctgggattcaggcgtgagccacctgtgcccggcccaggaacccagctttttaattcaaagtctgtctgcagtcatggtcacctcttataaatattagaaaaatatctcacttaactgtaaatttaaaaggatttatctgttacccctgtctggctaccctctcggactgtgagcttcttcatgagagtaatttccagtgaagtactcttgggtatttgagtactcataaattctgatccttgtggttgcactcagctgtcttgatcaactctagccattcagtggctgttggtatgagataaaatgtgctgctttctgtgctttctcttttactaggcctgtaaacagtgtctgtgtgccatctggtgggtgtattgactgttgtgatggtgctaacagtggtgattgaaaatgggctaaacagtgaaaaaatataacacttaagaacaagaaacagaagaaataagggtcactcagactcttttaaaatgagaatagaaataagttcagtgtactagagtccacttgcatttcgttatttccttaatttgaacaaagagtcttaccagaccataagaatcatctgaggcacttaaaaatacaaattctccacctaatttttgaatctttaggtgtccagtggagctcaggagtgtgtgttttgaataagagacacctctcttccctttgtagtgaatcttgtgatcactcatatttgggaagaactgccgggaaggattgggaggatcaagttgtttgaggacatacagtaaacttcctcaattattaatcagaagatacatttcaaaactaggaaattttagttgagcaggtggaagaaaaatgagaaattgaacaattaaaaagtttccttgactgaatatgctaacagaaaaaagatttcaaaaggacatattttaactaaagataaagaagccaatgaaaaaccagcagtatcaaacctacagatgagacaaatgtttttgggtgaacacttaaaaaattattgaaggagaagggccctgcaagtgaccttagtgatttctaagatcttttaggtttgatgaactaaatgaaaccaattataatattccagataccagagcttgaattgaggagtttgcttaagcaatgaggagatactgtttaaatcttgcaatgtggtaagatggagaagaaaaaatgtttttctcctttcaaatttaagaatttagggcattcatggttctagatacaagaaaaggagggagctagctaatcgtttttagaaagtgtcccctaagtgaaaatgttcaacaaagccaagagaacaggtttgatcttctagggaaagtatgtaggaaagactgacatataagatttattcatttagaaatatgaccatagagctataaatacacttaatattatggtcatttcaaggatcctttggaaagattctggttaggtgatccatttgggtgaatcctgaaagttctctatgttctggcagctgcagaaacattcaggcttttccttccgtgtatgtgatatgtaggaatgtgcgtgtcagattttctgtccttatctttgcacaatgggatgcctgatctccatttagaaccaaatagaaagaggaaggttccagaggtcactttaaccattatactttggagatattatgaacttttttatcttctctttgtcacccatcccaattatagtgatgttgaggtcattcagttaaaaagttttgtaatagtgattaactttgtatttaatcttagtgacttttggcgaacatggttcagtacaaatgcatcaaaataaaacataacagtggtgtaatgtgcatgtgcaggtaggtaatactagttagtaaataaagtgaaaactattttttttttttgagacagggtgttgctttgtcacccagatgggagtgcagtggcatgaacacagctcactgcagcttcgacttcctgggttcaggagatcctcttgcctcagcctcccatatagctgggaccataagtgtgtgtcactacacctgggtaattttattatttttttgtagagatgaggccttactatgttgcccaggctggtcttgaattcctggactcaagcaatcctcctgcctcagcctcccaaagtgctggaactataggcatgagtcatcacacctagcctgaaaactttttttttttttttaaagaaaaaggtatatgagtatatttaaacataaaaatgaaggaagtcagagtaactgcaaagtttgtttttatttcatttacataggtgatgctgttgacctacagagcctgagttactttcttctttctttcttttcccccccgagacggagtcttgctctgttgcccaggctggagtgcaatggcaccatctcggctcaccgcaacctccacttcccgagtgcaagcaattctcctgcctcagccacccaagcagctgggattataggcacacaccaccactcctggctaattttttatatttttagtagaggcagggtttcaccatgttggtcaggctagtcttgaactcctgacctccttatccacccaccttggcctcccaaagtgctgggattacagacgtgagccaccgtccctggcccaagagttatttttgaaatacaggtgatagatatcccctgagtcatccatatcctttctccctagtctactttgttttcagtggcatatattgctttctagatggctggctaaaattagaaatacagtcttaaggttgtgaaatcatttctctttgcaaaacaaattgccccttctagaattgacctgtgacttgacctcttcagtactgtatttgaagctaattgatagtcttttacagtagttattaacagatagttaaaaggtagtacaggaaggaaggaaatgctctgacactactttctttttctgactcagcttattcttttgtggaactgttaatcatgaatgaaacaaaaccatggggaactgacatatgaagaggcagatcagtggagcagaatagaaaatcaataaattgacccaaataagtaaactcaaggttgcatttcatatcagcatggagtggattattcattaaaagtggctaactcagggggaaaaccttggatctgtcacttcttatatcagataacttccaggtgggtcaaggatttataatttaaaatgaaggctttaaaattgtataagaagatgttgggggggggtgtttaatataatcttagtatacattctaactgctgataattaatttataagaacagcatatccaactggaaatataaaacctatacgataagtaaaatgcagcatgtttaaagtgcatgtataaagtacacttccagggagcaaaggtaaatttaggaaaaccctggcaattagtctcacttccttcatttttatatttaaacacacacaggcctttttaagtttgacacaaaagtcattaaaaagttacaaaattgactacattcttaaaaatgtgcaaataggccgggcgcagtggctcacgcctgtaatcccagcactttgggaggctgaggcgggcgggttacctgaggtcaggagttcaagatcagcctgggcaacacggtgaaaccccgtctctactaaaaatacaaaattagttgggcatggtgacacatgcctgtaatcccagctactcaggaggctgaggcaggagaatccattgaacctgggaggcggaggatgcggtgagccgagatcgtgccattgcagtccagcctgggcaacaagagtaaatctccgtctcaccaaaacaaaaaaaaaaaaaaaaaaaatgtgcgaagaataatatataaaagcaaacactgttcaattgggggaaatatttgcagcaagtataatagaataaacgtatttcttcaatatttaaagacgttctaccaaaaaaaaaaaaaaaaaaaactcaccaaaaaccaataggtggacataattttcaggaaggaacatttacataacttttaaacaaaagatgctcagtgttcagccatactcataacaatatattaaaaccaaaataagaccaaaatgagttactatacttaattttaaatgtaaaagttgtcaaagaaaataaaatttaaaaacacattgcctgggtgcagtggctcacacctatagtcccactttgggaggccgaggtgggaggattgcttgagcccaggagttcaagaatagcctgggcaacatggtgagaccctgtctctacaaaaaatttaaaaattagctggatgtggtggcgtactgaggaggctgagtgggaaggatgacttgaaccctggagtttgaggctgcagtaagctgtgattgttccactgcagtccagcctgggtgacagaaggaaaccccgtctctaaaaaaataaaaaaataaaaaacagtagattaatgaggatatatgtaaatggagactttcatgcatttctaaagggagaaatacacagttgatacaagtaatgtgggtaaagaaatatgtatagtcattgcagtagtatatgtaatactaaaacttttccattactcaggagctcaataaatagactgctggagccataaaagggaatactatgtagctaataaaataaacattgaggcctggtacggtggctgacgcctgtaatcctagcactttgggaggccaaggtgggcagatcacctgaggtcaggagtttgagaccagcctggccagcatgacgagacccctgtctctactgaaagtataaaaattagccaagcgtggtgatgggtgcctgtaatcccagctcttcaggaggctgaggcaggagaatcgcctgaacccaggaggcggaggttgcagtaaaccaagatcgtgccactgcactccagcctggacgacaagagcaggactccatctcataaataaataaataaataaaatattgaggcaacactacatctacagatatggaaaggcatctgagatggatataaaagcaacgctcagactgatagaaggatatctttggctgggcgcggtggctcacgcctgtaatcccagcactttgggaggctgaggcgggtggatcacgaggtcaggcgttcgaaaccagcctgaccaacatggtgaaaccccgtctctactacaaatacaaaaattagccaggcatggtggcatgtgcctgtaatccaagctactcaggaggctgagacaggagaatcgcatgaacccggcaggcacaggttgcagtgagccaagatcatgccactgcactccagcctaggcgacagagcgagactccatctcaaaaaaaaaaaaaaaaaaaaaagaatatttttgcatatgtgtttgcatatgctgaggatatttttggaagcttatctacaaactggcaccacagctgtcactaaggaagggaatattttggtggtgattcgggatggcaggagactcagttttcactgtacactctagttttatgaatttgtatatatacttccatgtagacattcatgtacttaccaatttattcatccaacaaatattaagctctgctgtatgctagtgttggagacacctagctggagcaatgaatgagatgacaaagcccctattgttgtagaacttaacattctgagagtgacaagacagatagtaattatataagtaaatataaatatgtaatgtgtcatatagagataagtactatggtggaaaaataaagtatagtaaattaggaagtgctgatatagggtggtagatatctctgctgccgtgtcaacttagcagacttgaaggaaacgggaataagacgtaggatatctgggggaggattacaggcagaggagacttgaaggacaaaggccatgaagtagaaatttggttggcatgggttgaagaacagcaaagaggtcagtgtgaatgcagaggaatgaagtagggagagattgacaggtgacaaggtcagaaagaggactgcagatgatatagggctttgtaaaccctcattaaggactcaagctaactgagatgtgatgccagttggagagttttgaagaggactcctccatgtagtgggatcactctgactgctgtgtggaggataaatcagttgggtttcctagtataatgtaatccacttatgtaattgcaaattttctagtagcaatattttaatactatgaagggacaggtgaaatttattttaatgatggattttattgaacccaaacatttattaaaacattatacaaacatttactaaaacttaccatctggccaggtgtggtggctcatgcctgtaatcccagcacttagggatgccaaggcacatggatcgcttgaggtcaggagttcaagaccagcctggccaacatggcaaaaccccatctctactaaaaatacaaaaaaattagccaggtgtgctggtgggcacctgtagtcccagctactcgggaggctgaggcaggagaattgcttgaacccaggaggtggaggttgcagtgagctgagatcgcaccactgcactctagcctgggtgacagagtgagactgtcttaaaaaaaaaaaaaaatgttgctgggcgtggtggttcacgcctgtaatcccagcactttgggaggccaagtgggtggatcacgagatcaggagtttgagaccagcctggccaacatagtgaaaccccatctctacaaaaattagctaggtgtggtggcaggcccctgtaattccagctactcgggaggctgaggcaggagaattgctcgaacccaggagatggaggttgcaatgagctgagatcgcaccactatactccagcctgggtgacagagcaagactccatctctaaggaaaaaataaagaagttgaaaacatcatccaacatgtaatcaatataaacattattagtcagatattttatagtttttttgtgctaagttttcaaaatctgatgcatattttatacctagagcacatctcagtttagatgctacattttcagcaattgaagtgaaatatagccctaccaaaatgataaagttgtgtttaatgggaaaatacttcatttactttagttttaaaatatgttaattaaaattaaattaatttaaaatctaggtctaaccacatttcaagtgctcagtagccacctgtgtctagtgagtgctgtattagagagcatggaaatagagttgtggggtagggtgggcagcagcatggagctgcgtcaggaacctattgcagtaattgaagccaagatgttggccgggaccagagtgttagcagaggagtaggtgagaagtggttgtattcaagctgtattttaaagatccagcttgcgggacttatgaatggattgaatgtgggatatcagagaaagtgaggtctcaacagtaatcttttcagtctgagcagttgaagaatagagttttcatttactgagatgaagaaggagatttctggatggggtgggggcagtccagagttagattttggatatgttaagtttgagatacgtgtaagacatcaaaatggagatatgagaagatagtggatatgtgaatccaaagttcaaggaatagatgtaatctggagaaatatacacgagagtcatcagtgtatttaaagccaggagacttagatgggatcatctcatgaggaagggctcacagacaagagattggaggaccaagctaaggggctcccaaatgtttagagagaaggagccaacaactaaggctgagaaggaatggccagtaggttgggaggagaaccaggagaaaatggtggcttggatatcaagtggagttagtgtttctaaagaaggtgtgattttaaaaagtgtcaagagtagatggaaggttaaagtaaattgaaggccaagaatttcagtggaattgtgggggaaaattgggaagagagggttcaaaagaaactgagatgtggaggaagtggaaacagcaaatgctggcagattttgtgagtagttttgctgtagagggcaacaaattagttggtaactggaggaccgtggatggtcaagaaaagttggttttttgtttttgagatggaagaaattatgcatgtttatgtgctgatgagaatgatctgacagagagggaaagattgtgatgatgcaggagactgacttaaaagggacagtagttgaagggatgttttttagacaagaagatgaactacctgtatttttttttaagggccagttgaggtgacagaagaagaaaagcaagaagatggtgtaatctatagttagcatcttactaattaatatgaactcgcacaagttacatttttccatcattttattaaggtatagtttacatacagtagaatcaccccttttagcctagtgttctgggacttcagcaaacacatacaccaccacagtctaggtcattttaacttatttatgctgggtgtggtggctcatgcctggaatcccagtgctttggcgaggtgggaggatcgcttgagctcaagagtttgagaccagcccgggcaatatactgagaccccctccctacaaaaaataaaaataaaaaaaaatacctgggcatggtggtgcacaccaattgttccagcttactggagagctgaggcaggaggataacttgagccaggagtttgaggctgcagtgagctgtgatagtgccactgctctccaggctgaatgacagagcaagatcctgtctcaaaacaaacaaaccaaacacttttattttgggcaataggttagcttgttctgggaagttggaccctgtatatatgggatataccattgcttctaatttaagagatttataaacccacaaaaaatatgtattatttcttatagtaagttaccagtttggttcttgtaggaggatgtgatgtaggcttgggtgaagaaggtttttcctaaagctaattcaagcaaaaaaaaatttttttcagaaagtctgtgccatgaaaaaaaagttatattagcatcatatagacaaaccacaattatgtaactggatattttttttcattttagttggacatattgaaggtgattaattgtaactggaaccccctaaagaattatagtggaaaaaaaaatatgtggtgtctagacaattctagtggaagacaaaaatatttcagttactcaataaattgaaataatatttgagccaaaatcttgtgcctgtgccaagatctggcataagtttttagttctgtttcttagccacttctctaggtgattgatctcatttagttaattgagggaattgccagaaccaaaatccaggcaacattaaaaatcgttgtttttaatacactgagtcccaggaatcagtttctggacagtgtcgagctcctattgccaaggagctatgaatttaggccatgcacttaggaaaaactgtttagactttacttctctcagcctggctggaattttggttgactgaatctttataatctatttaaaggtgtccttttgagtcaaaaacatagctgatttgatggaagtaagttttgtctaaacatgtggcttttatttctgggtattacaactattggaattctagtggaatccttttaactacttttaaagcaaatttcatttttactacttataagaatcatttctagatcttcaacttgttttagtagctatggctgattcattctctctctctttttcagaatgacagtaacttttatttttatttatttatttatttttaagatggagtctcgctctgtcacccaggctggagtgcaagtggtgcgatcttagctcatggcaacctccgcctcccgggttcaagtgattctcctgcctcagcctcctaagtagctgggattacaaatgcgtgccaccatacctggctaatttttgtatttttagtagagacggggtttcaccatgttgatcaggctggtctcaaactcctggcctcgtgatcctcctgcctcggcctcccaaagtgctgggattacaagcgtgagccaccgcgcctggcaacagtagcttttaaaattataaaacaagtgcatgcatcttcataaaatgtttttttaaataataaaatgtataaaacaaatgcttcctccatgctactcatcagtgctaaccactattaaatttgtagtttctcttggcagactttttatgaatatataaaaatatatgaaaaatatatgtatatgtagtttttcaggtaaatgtaatcgtgttctcttataataggacatttttccatggcaatacgtgcttgtatttttagggactatataatattccatcatacacatgtaccaaaagatgtttaaacacttaaattgtttgtaggtctttgcttttctccacaatgctccaatcccaggacatgtagaattgttcttatctgcctagtttattagagtatatttccaccagaggaattgctagtcagagggtatgcccattgtcaatcatgatgtcacagaagccagacattagcttgccacttaggcaacagagggtatttgttgaaatggaaaaaagctttaaaatgtgtagaattataggccgagcatggtggctcacgcctatgatcccagcactttgggaggccgaggcaggcaggtcatgaagtcaggagatcgagaccgtcctggctaacacagtgaaaccccgtctctactaaaaatacaaaaaattagccgggtgtggtggtgggcaactgtagtcccagctacttgggaggctgaggcaggagaatggcatgaacccgggaggcagagcttgcagtgagccaagctcacaccactgcactccagcctgggtgacagagcgagactctgtctcaaaaaaaaaaaaaaagaaagaaagaaagaaaaaaaagtgtagaattatttttaaagcatttatgtagaattttgtattctaacaagggtcagtttattcctctctaattaaaatcaacacattgtcagaacctccagaaaggctctacagtattcccttcactaacaaagtatgttagtcccttgagtgcagggaacagtgttacttgttcactgaatatcctaatgcttagccttagttcttgacatagaatagtaggtgccaagtcagtacttttaaaatgtgcctgttttgccacatccttaccaactcagtgcattatcagacttgttaattttttatcagtctagtatgcaaaaaggtttcctttttaaaaaagtttgttgttttttttttttccttgttttcctcacttcttttttttttttctttttttttttattatactttaagttttagggtacatgtgcaccttgtgcaggttagttacatatgtatacatgtgccatgctggtgcgctgcacccactaactcgtcatctagcattaggtatatctcccaatgctatccctcccccctccccccaccccaccacagtccccagagtatgatattccccttcctgtgtccatgtgatctcaatattcaattcccacctatgagtgagaatatgcggggtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaaccagtttacagtcccaccaacagtgtaaaagtgttcctatttctccacatcctctccagcacctgttgtttcctgactttttaatgattgccattctaactggtgtgagatggtatctcatagtggttttgatttgcatttctctgatggccagtgatgatgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagacgagtaggttgcgaaaattttctcccattttgtaggttgcctgttcactctgatggtaggtttttttttttttttttttttgagacagagtcttgctctgtcacccaggctggagttcattagcgcgatcttggctcactgcaacctctgcctcccgggttcaagcgattctcctgcctcagccccccaagtagctgggattacaggcacacgccaccatgcccagctgatttttgtatttttagtagagacggaatttcaccatgttggccaagctggtgtcgaactcttgacctcgtgatccacccaccttggcctcccaaagtgctgggattacaggtgtgagccactgcgcccggcccaaaagttagttttttaattattaaaatcaagcgtcttttcatgtgatgactggcatctgtatttcttcatataccggatttatttttatatgggagtattgcctttttcttattgatttataagagtaggttaaataaacaaaaatttttaagaatggtaatcaaatgacctgtgccttgcacatttgtttaccagcctgacatttgtcttctaagtatattaagtcttgctatagagaaagttttgatttttaaagtagtcagatccatcagtcttttcacttaagatatctgaattctgtaacatggtgaggagggcctttctcattccaggattataaaaatattattatattttttcttctaatacttctataaagttttaatttttatgtttcaatatttgatttttctgaaatttatttttgttcagtgtgaaaaattgaaatctaaaatttcttttatccaaatggatagtctcttgtctcaacattattggtttgaaatactacctttatcatgtacaaaattttcatgtataggtgaaattatttctggactgtaatttttgttttgtcaatttctttttctttttctttctttttttttttttttgagacagagtcttgctctgttgttgcccaggctggagtgcagtggcgctatcttggctgtctgcaacctccacctcctcggttcaagattctcatgcctcagcctcccaagtagctgggattacaggtgtgtaccaccatgcccggctaatttttgtatttttagtagagacagggtttcgccatgttggccaggctggtttcgaactcctgacctcaggtgatctgccctgcttggcttcccaaaatgctgggattacaggcatgagccaccgtgcccggccacattttgttttaagaaaatcagttgcacaattacaaggtagggaaactttatttgataataccagttcagtcatgttaaaagcaaaataaacaaaggacctgctgtttaaattgatttcaaactcaggatgagttatgatcttggttggaaaaataataagggttgtaattaaactgtattgcaggaagtttggcatccagattaggaaaggtaatactttcaatctttgctgatcaaacagtttttatcatttgtgcacctgttttgtgccaaggactaaactagatgctgggatacaaagctgagagacgtagcccatttataatagaattgcaagtcagtaataacaggttttatgagaagccagaagaggaatatccagaatttagaccacaggggatgggacagcttttaacaagaaggagttgcatagagcagaggctttggaggtggagctgtcggcttcactactatgggaccttgtatttaatctcaatctcaatttcttaatgtacaaaatagggtcactaataatctatttcacactgttgtctgtcctaagcatcgatgaggaaaaaatatacacacatacatacacacacataaaatgtatatatatgtgtatacttttttcctcattgatgcttaggacaacagtgtgtatgtgtgcatatatatgtgtgtgtatatatatatacactttatatgcgtatgtatatatgtacatacgtatatgtatgtatatgtaggaaacctctgaaacactctggggacataataattgctcagaaaatggtgtggaatccatccattttgaagtgctagtaggtaggagttggctcagtagagaagggccttctcagcagaaggaaaggtgtataacaaagccaggtggttgaattggggcctctctggaaatgtaaagtatttaatctggttggattgtggggtacatgtggagggagcagctgaagatgaaactgtgaaaggaggcaggggtgggatctccactgcgagcttttgtgccatgttgaggagtctgagaggcatttaggaagtgttgtggagtccttaaaaaccattattaggggagtgttcagaacagttttgccagttgaaagactggtttgttatagatgcatggagtggctaggaaagctgttagaggtaggatatctagtaagagccgtggtgctcagccctggctgcacattggaactgtctggagaacatttaatggcccgatgcccaggttcaccccagatcaattatatcagcagctctaggattggaacctaggaattggtattgttcattgttccccaggtgattccaccggacagccagtattgtgaatcactgagttagagggtaactgtattcaaaccagatatgaagttgcaaattaaacgagtgccagcagcataaagcaggggtccccaactggccaccaggtaccagtccgtggcctgttaggagctgggccacacagcaggaggtgagtggcaggcaggcaagccagtgagtgagcaaagcttcatctgtatttgcagccactccccatcactcgcatcactgcctgagctccgcctcctgtcagatcagcagcggcattagattatcataggagcacaaaccctattgtgaactgtgcatgtgagggatctaggttgcacactccttatgagaatctaatgcctgatgaactgtcactatctcccatcactcccagatgggactctctagtagcaggaaaacaagcccaaggctcccactgattccacattgtgatgatttgtataactaattcattatatactacagtgtaataataatagaaataaagtgcacaataaatgtaatattctggaatcattgcaaaaccatacctcccttcacccctgtctgtggaaaaactgtcttccacgaaaccagttcctggtgctaaaacggttggggaccactagcataaaggaactagaataaggaaataacaaatatggtggtcagttgaatgaggaggagatggagtgaagatctgaagatcatttctagattagatcactgggtggattcgatgatcgtataagagggctcagtcatatatcgagtgagaacaggaaggagaagcagatttgggtactaggacttgctgagtgggtacaagaaatagaatttgatttttatatgtggaattagggggaaaattaactctataatgccaaatgggcagaaaaactgaagggaaagggccaatggaatagttgaaaattccggagacagagtagataattgatgggtgagatccctgaagaggcagaaagtgcagagcagagatgaaagaagtcatttagggccaggcgtggtggctcacgcctgtaatccagaactttgggaggctgaggcaggcgattacccaaggtcaggagttccagatcagcctggccaacatggtgaaaccccatctttactaaaacacaaaaattagccaggcatgatggcaggtgcctggagttccagctacccaggaggctgagacgagagaaccacttgaacctgggaagcggaggttgcagtgagccaagattgtgccactgaactccagcctgggtgacagagcaagactctcaaaaaaaaagaaaaagaaaaagaagtcatttaggctgggtgccgtggctcaagcctttaatcccagcactttgggaggctaagggggagaactgcttgaagcccaggagtttgagaccaggctgggcaacatggcaagaccccatctctacaaaataaaaaagttagccaggtgtggtgatgcatgcctgtggtgtcagccactttggaggctgaggtgggaggatcacttaagccctggagtttgagcctgtagtgacctgtgattgcatcactgtcctctagcctgggtgtcagagcgagacccccatctcaaaaaaaaaaaaaaaatagtaagggaattaaagagtgtggtcaagttttggaagatgggggtcatctgaggaaggcaactaagaaggaaatgtctttgttgtcctacccttaaatgttgcttgtccccagggttttagtgttggccttctttcacatacttcatggatgatctcctttgatatattttgttacactgttaacttctgagagaaacattgataagctgaagtttgttgggggaattaagtagttgatgttatagttcagaaaataataggttggcttttccttttggggggaattttcttggtagcagtttgctatgttaatttgaaatttaaaatactgaaatcacttgaaaacacggtacagatcccactgtttctagtattaataactagttagcaccatgttttttctctagttataaaaccctaaagcattaccaatttgacagtttgaaaatatgttagcttttagtctcagtgttttatactataaagaaatctgaatagttattttacttttcatgttatgtttcatcatcaagtatattattctgttatgtctattaaagatctctttctcaattctgatataaactgtgatttgcgttacatattctctaaaaattttttcttctaaaagactaactgaaagtttcgtagttaattgtcagataattggaactatttattttatagagtttcagtaaaatataaataagattagttatgcagcaaaattaattgtattccttacaacaaagcagtcattagtatgacttttcagtaaggtgtattttgttcataatatgcttcctaagataattataaattacctcaacataatgaattaggaccatgggtgtgtatatagctagaaaatggccttggtatggcagaatactaacttaatgttttgatatcatttcaggcaacatttcatttgttgcatttccagtttccaataccaactcacctacaaagattttaccaaaaaccttaggaccaataaatgtgaatgttggaccccaaatggtaagaaaattatcaaatcttagaattgaaactttgtttagccaagactaatttaaagaataattgcattaaatatatttgatcagatattccagttaaaccaggcgcggtaggtggctcactcctgtaatcccaacactttgggaggccgaggcaggtggatcacttgagcccaggagttcaagaccagcctgggcaacatggtgaaaccctgtctctacaaaaaacagctgggcactgtggcgcatgcctgaagtcccagctacttggaggactgaggcgggaggattgcttgagcccaagaggtcaaggccacagtgagccgtgtttgcaccactgcactcctgcctgggtgataaagcaagaccctgtctcaaaaagaaaaagaaaaaattatagttaatttcagttatctgagtcacttttaaaaaacgttctgtttttatctgaatgtatctggtcaagttttgagcttgagaaacattgtgtgctctttgatatttaattttcacatatttgaatctgtggattctggatgtgtagtattaagtcttttcctctttatgtgaggtttctcttgtattgtttaaattgatttgaaatgtgttatgctttatgtcttcctgcttttttctttttcttataaaataacctttactactctaaactatgtattctcacataaatggaatctgtgacccaacagttaatttacatctggagttattaatttaaaactcctttcattaaggacttttggggaaaaaacaatataccaatttattttaatctgtagcagtagaaataatgaatgaaaaatggaaaacaactgtttctctaaagacattcattaattatgctagagcatgaagtgtgtagcactttcagaagacttatttataagcaaggttgcattccactactctgaaactatgtctaaatggcctcacccaccattagtaaaagtactcaaacatttaagcaataactcttcattgccggtgttttcatcttttcatctatagagcaataaggataaattttacccataatgtacaacagcactgtggactatgttaaatgcaaagttatttagacaaagatatcttttaacatacctaatggtttcagaaagtctctaagacttcaggacacattctagacatgatattttccttggttagttgaggactgtttatcatctgcagaaatcaagctaaagatacaacacaatttactgtaactatgtgaagaatgtagtctagctccaaacctcatagagatttaagctcaaataagagccctcatttcaaggtagctcaggttatattttcagacatttgctaagcatttgcccctcctcagccactactataggtgcaaatgagataaagcacctgacttaaaaatctgcattttgaaatgtgattatataagcaccaaaattaaacatactcaaatttttatgagtcttgcccttacagtactcttctgttttgagagattattttctattattttttgtttaatgctgctataccccaatttgaatttctcctttggaagcatgtataatttttctcccattgtcagtttgaactaatgtgcattttggcccttacacagtccagttctgttaagtagtgatgtgtgctactaactcagttactgtaaatctcaggatcagcaaaacaaaggtcacaagaaggagaggcgatttggaactctaccttcaactgggccatcccaagtacttaatttgtccccctacttctgaggtccttttttcagttctgagttcttgggcaggaatcagaattttgtttttggtttcctaattgttgtaagattccattgctgtctcttgaatgtgtccctccaaaattcatgttgaagcttaatccctattgtggtgctattaagggatagagcctttggggaagtgattaagctatgagggcttcattctcattgaggggattagtgaccttataaaagaagttgaggctgggtgtggtgtctcacgcctgtaatcccagcactttgggaggccatggtgggcgggtcatgagatcaagagactgagaccatcctggtcaacatggtgaaacccatctctactaaaaatacaaaaattgccgggtgtggtggctcatgtctgtaatcccagcactttgggaggccaaggtgggtggatcacgaggtcaggagatcgagaccatcctggctaacacagtgaaaccccatgtctactaaaatacaaaaaattagccaagcatggtgacacacatgtagtcccagatactcgggaggctgaggcaggagaattgcttgaacccgggaggaagaagttgtagtgagcagagatcgcggcactgtactccagcctgggtgacagagcaagactccatctaaaaaaaaaaaaaagttgaagggagctctttgcccccttctgccccacttcatgtagtgaagacactacaagaaggtaccatctatgaagcagagagtgagccttctgaatttgctggtgtcttgatcctggacttcccagccaccagaactataagaaatacatttctatcatttataaattacctatgctaaggtattttgttatagcagactaagacaaaaattagtgccaagaactggggtgtggccataacaaacacctaaaactgtagaagtggctttggaactggataatgggcagaggctggaagagttcagaggaacaggctggaaaaagcctcttgagatgaatggaccattaagggtgattctggtgaggaatcagaaaaggagagctatagagaaagcctcacttttcttagagattacctccgtggtcatgaacagaatgttggcacaaatatggatggtaaaggccattataatgaggtatcagataggagtgagggacatgttattggaaactggaggaaaagccatccttgttacagagtagcaaaaggctgggcccagtggctcattcctgtaatcccaacattttgtgaggccaaggcagaaggatttcctgagcccaggagttcaagaccagcctgagcaacatagtgagacctcatctttatcaaaaaaaaaaaaaaaaaaaaacactaaaaataaaaaattagctaggccgggtgcagtggcttatacctgtaatcccagcactttgggaggccaaggctggcagatcacttgaggtcaggagttcgagaacagcctggcccacatggtgaaaccctgtctctactaaaaatacaaaaattagccggacatggtggcgggtgcctgtaatcccagctacttgggaggctgaggcaggaagatcactcgaatctgggaggctgaggttgcagtgagcagagattgcaccactgcactccagcctgggcaacagagcgagactttgtctcagacaaaaaaaaaaaaaaaaaaccaggcatggtggcacctagccactcaggagactaaggagagaggatcacttgggcccaagagtccaaggctgtagtgaccctgacagagtaagactctatctcaaaaaaataaaagaaccaaacaacaaccaaaaaagtggcaagggacttcactgaattgttttcctgttttaatgttttgtggaaggaggaacttaggagccgtgaaattggatatttggtcaaagaaatctctaagcaaagtgtttagggatcaacatggcttctcttggctgtttatagtaaaatgtgagaagagagaaatgaattaaagatataatttatcatcagaagtgaagatttgggaaattctcagcttggccatgtaaagaataaaaaagcatgttttggagagaacaccaaaagagtggcctagtcaccttttgataaggagattagcgtgcatgggtggaagcttggtgttgttcatcaaaacaatggaagaataaacccatagcatttcagtgattaccggtgctgctcctcccatcacaggcccagagtgccaaggcatgggggacagaactatcaaaagaggggcttcaggcgctaatgaaaccctggcaatcccttcctggcactgtgtcaagtctgctccccgaattttggcacagtgctccttagccattccaggtgtggctccagtaggcccaagtatagtggctgctcctctagagggcacaggtggtgaaccttggcagtgtctgagtgatgccatctccagtgggtgcagagtgtacaagctgcggggtatgataacttccacctagatttcaaaagatgccctggagagccttagcagatcctggcagagaattgctacagaggtgaggccaccattgggaaccctcaccagggcaaagcttggtggagctgaggtgcgcggggttgctccctgaggccctagtctagtagagcttccagcatgcaactccagcctgggagagccacatgcagaagactcaaactctaacccaggagaactgcagcatgggctgcccccaataaagtcatgggggtgggggcccctggtaccctgggggcccaactcctgctccagtgtgtccagaaggcaggatatcaagtcgaagattattctgaagccttaaaagttaatgtttgccctgttgggttttgtattggttgggacctattatccctttcttcttttctattttctcccttttggaatgggaatgcatgttctgtgcctgtcccatcattgcattttggaaacaggttggatttcacagactcacagctggaggggaatttgcctcaggatgaattgcacctttgagtcttacccatatctgattttgggaaggagttaagacttgtgagactattggaatgaaatgaatgtattttgcctgtgaaatagacatgaattttagagggccaggaactgaatgctgtggtttgaatgggttcctccaaaaattcatgttgaaacctaatccctactgtggtggtattaagaggcggggccttttgggaagtgatgaagtcatgagggcttcacccttatgagtggaattagtgcccttataaaagaggttgaagggagcaccctggaccctttctgctattaggatgcaaccagaaggcatcatctttgaagcagagaataaaccctcaccaggcactgaatctgccggcactttcattttggacctctcagcaacctccagaacagtgagcaataaatttctgtggtttgtaaattacccagttttgtactccttgcagaagactttaaagaaaattaattaattacccagtctaaggtggtttgttatggtagcctgaatggactaagacacccagttacagccatttatcgcttctcctctaactccctcatccatgatttttaaaaaagtttttgtttagttaaagaattcttggattaggctgggcgtggtggctcacgcctgtaatcccagcactttgggaggctcaggcaggcagatcacgaggtcaggagatcgagaccatcctggctaacaaggtgaaaccccgtctctactaaaagtacaaaaaattagccgggcgtggtggcaggcgcctgtagtcccagctactcaggaggctgaggcaggagaatggcatgaacccgggaggcggagcttgcagtgagctgagatcacgccactgcactccagcctaggcaacagagccagactccgtctcaaaaaaaaaaaaaaaaggaattcttgcattacaaactcacccatttgcttcttagccttctttttgtgcttgccctttgaactttacatgtcttttggaagccaaatcttaatggtagatagaaatttcaaaaggccccatgaaaagttttgtgtggttatggaaactagtttagcagtacctattttagtttgagatacttgcccttttcttacaggctgtcttatggttatatgttatagatcttaagattatttatacagttgacctttgaccaatgcaagggataagggcacagcccctgtgcagtcacaaatccatgggtagcttttgactcccccaaaatgtaactattaataccttattattgactagaagccttactataacataaataatcaaataacacattttatgttatattaatgttatttcatatgttaatatgtattgtatactgtattcttacaataaagtaacctagggaaaaatattacaaagaaaatcattaggaaaatacatttataattcattaaatggaagtggattatcataaaagtcttcatcctcgacgtcttcacgttgagcaggctgcggaggagaaagagggaggagttggtctggctgtctcaagggtggcagaagtggaagaaaatccatgtataagtggacctgcccagttcaagcccatgttgttcaagggtcaactgtataagataatctaatggctgtcttattttagaagagtaaaaactgcatgcttcttatagtgaaaaccaaaattccatcaaatagtgaaatctcttaatataccactttataattttgtaattttttttccctttagaatacatatgctgtcttggctttttttaactgtagatggcagtagcacataaaatatgttgattgagggcaggaaaatgttcagagtaatgttcaattgctatgtgattttcccagagtaactaattctattgtcagagaaaccacatgataacatttaagttaaggatgtctggatttttggtaggaggactctgaaatttaaaactccattttccttagcatatcaagtgaatattaaaagtatatttttacctccaacttcagtacttcaaattttttttcttttttgacagagtctcgctctgccacctaggctggagagtgtagtggcacgatctcagctcactgcagcctccgcttcccaggttcaagtgattcttctgcctcagcctcctgagtagctgggattaccggcgtgcaccacaacacccagctgattttttttgtatttttggtagatatggggtttcaccatgttggccaggctggtctcgaactccctacctcaaatgggagcctacctcacctgccttaggctcccaaagtgcggggattataggagtgagccactgtgcctggcctgggatttcaaaattaaggttcagggttagaaagcatgaccggctcatcaccctataaaccaattttcttatattctgtggctgttcaagtcttaccgactttccttctgttttatttcttacgtttcactctcattatcctagtttaggaacttactgtatctcacatactcttaggccttatctttcctattcaggtgcgtcatctctctaatttgttcatgtaggaaatgtttattaaggaattgctatgtaccaggccctgtgctaagagaaaggagcagagtgttgctaatcactctccgatcagccgcagctaacaatctgacaatgagggagggaaaaaaagaaaatgtaaactagaattcactttcaaagtcattttcataaagatagccagtttttctctatgtcctctttcccttccttctctctttttttcctttctttctcttttttttttttttttttttttgagatggagtctcactctgtcgcccaggctggagtgcagtggcatgatctctgcttactgtaacctctgcctcctgggttcaagtgattctcctgcctcagccttccaggtagctgagattataggtgcccacccccacgcccagctaatttttgtatttttaggagagttagggtttcaccatattggccaggctgatcttgaactcctggcctcaaatgatccgcctgcctttgcctctcaaagtgctaggattacaggcatgagccaccatgcccagctccttttttttttctacaaagtcctgtaaatcagcaaaaccaagcatgtaggctgctaataccatatagaaatactgcagtagtaatacaatctgtttcaagggtaaattggaatgcttagaatagctttgtagacactgctgttcaaggaatagggttgaccagaggctaatcaaataactcacatttttctttataagttgtccatccaaggtcagcatgatagagaatgtgatgtagtgattggtggaaactatgctgtatttttttagtggattttatataaaccttttagcatatcaataaatgaagttactttttcccctattattttaaaagttgagtattttatcccagttagtaaatatttattgtacctttcctatgagcatcccctaccactgtgttaaaccctgcaaaggacatagtttagcaaggtactcgccacccctaaagatcctgcactgaaatgggggatgcactgaaagtggggatgtgggaccagatgtgtggagtgggaagtgcaagcatacttggaatgcaaggcagaatttgatgagaggtacagacacattgtctgtttttatgttttctcatgaggcaaacttctgagtgccttatttaatacccttggtgtattgtacataatcagaactctccagacatctgtcagtattattaacttttgtttttatttttttaaactatggaatgaacggattgaaactatttcataaacatttctaggtgctaacatcttcctagccccaagctaacatagtcaaacataaacagactctaactaaggtcttaaatacttggtaaatgaataaatgttgactagactttaataactaggtctgaactatttttatgcttcagaggttattgtttgactctttccttcaaatgcaaataaagagcttgaaatgcttattaatccttcccttcagttatgtatggagcaagttagcaatgaacttaatgattcaccctggctgcagaaacatgtttcatttggtcagggagataaaaattaattagcattttgtcttgcataaggcagtagaaatagaactatttctcttgtttgaggacttattaacaattacttgtagtccctgtagatatttttcattctcagttgggacttaaaacttactatcatgaacactttcaaaactttacaaaaatagaactatatacccagcagttgcttcaacaattatccacataggggccaatcatgtttcattaatatccccattcaccggagcatgcctcttcccctttttttacatgaaaatacttctaaagctattactaggctgctagtttttttgtattaattattataaatgtctttgggaaaaacatgttttgttttgtaaccagtgaaaattttaagacctggtaacacatataaggtacctttctaaaaaagtctttaggggttccattaatcccctttctggagtctagccttaggaaatagaaattaagggcaaggtctttgtacaaaaatgtttatcacagcattctttataatagtgaataattaaaaatgcatatatatctaatagagaataataaatccacatggtagaatgttttatggtctttaaactatcttcaaagagtatttaataacatgaatactcttttttttttttttttttttttggaaatggagttttgctctttttgcccaggctggagtgcagtggcgtgatctcaactcactgcaacttccaccttccaggttcaagcgattctcctgcctcagcctcccatgtagctgggattacaggcgcacagcaccatacctggctaattttatatttttaatagagataggttttcaccatgttggccaggctggtcttgaactcgtgacctcaggtgatcctcccacctcggcctcccaaatgctgggtttacaggcacgagccaccgctcctggtccaatactcttttaaaaaaggataaaattgcatctatataataatccaagctggatagtatctttgtgtatactgtatgatggactgtggaagtgtgatttgctgttgccctggttctagtaaatcaagctgtactgcaattcatttcctcagtttcaaagaaagcttttcatttttctgatttttaaagcattatcagttctctacttaatccttccaaattgccatttatttgctgaaacctgcattgtgacctcatgtcagtattcaggatacttgtgctttaagatcctaggatataagtaaatcaaaggcattgcttatatttttagatgactgacattaagtgccttttaggcagcaaggtttcctcatatgtaggttagcaatcaatgttattttctgcctgtaggcttttcttaataattaagaatattatattctttgttcctaactttacagattataagcacaccacagagactaaccagttcaggaagtgttctgattgggagtccatatacccctgcaccagcaatggttactcagacacacatagcagaagctactggctgggtccctgggtaagagtgttgcaagttactatttttaaaaccttaaaaaaagtttagacatttttttcttactatcttgtcttctgttcttgttttagtttagttcttaaaaacaaatgtttttcctttaaaatcacctattttatttcactttatatcttagatataaataatctctggaataactatttttaaacagaaaaaaacagtgcaataactcataactaaaccctgtgactttttaaactctggaataggactacttttattattataatatttaactgctttggagatataaaaactatatttttatatatttttaactcacacagaaaaggagttaaatattaagtgttggctatactcagaatttcccctatgaattacttccataaagaccagaaaagggtaggaaaagaggccagataaattttttattaaatttcctcttctttttaaacgctgaacaattgaatcaatatcccttctgttactaatttgtcacttttagtacaaacttctatatgtttcatctttgcatgtaaaatacttatacctttctccactctttatcattttagtacctcatacttccataaaagaaaaataagtaagataaattactcaaaacctcattttgttaccttagacgttttgttactttagaagttatttacatggtggaatactgcattggtgattctgtcatatgtgagtttgagcaagcagatggtaagtcttagttaagtaagaatctccttgcttcaaggatattaagtgaattaataatcctggcaaagtgctttaatatgcatacatattaatatacataaatacatgcctacacacatgtacaaacacaaatacattaaagacagaagagttttgtatatgcatacttttccattatcaaatgagctgaaatgacagaattacctggaatcctatgggtgttattcaatccttatgaacattcttatgtagatcaaaggttaccctggatttctctatagccttgaaagattataacgtgaaagccaagcctgtgccagcagtgctggcccactttggaaatgaccagggtctggatgttttcagccccatttgtgctttatattggaggtggcaggattgtctggtgtttttatagtcagtatttcgcagagtgaagaaaatttttctctatcttgtttgcaagtctgcagtgttttcctctctagctagtcattgagctcttttcaacttatgattattaagttgtgataccttgttcacatgataaaattaagatttattttatgtacctatcttttgtatttgctagttttagtctttgaatatattcagtgtataattttagacaagttataataaagtattaatgaaattaaattgtatttaagtatgtattgtttttatgctatcttttttcctttttagtgatagaaaacgggctagaaaatttatagactctgatttttcagaaaggtgagtataagtctaactattttgtttggaagatttggctatatagagaggctgttggcattgccactgctctggtttaatgcgatgtttttcttcatgtaactttaacttctttcagttcttgccattatttcattctgcattgagtgccccagttcactcatagtatctgtatggtttcagtagaaattaccctgtgagcagattgactattggtagtatgtcctttagtctctcctctctttccatctggtaaatgaagagttctatcaaagtgaatactccacattaccctaacatgcccaaagtttaacaattttttcttttttcttttttttgagatgaagtcttgctctgtcacccaggctggagtgcagtggcgttatcttggctcactgcaacctctgcctcccgggttcaagcaattctcctgcctcagcctcccaaagtgctgggattacaggcatgagccaccacacccggctaagtttttcttaaaacatttataaatcataacaaacttgcttctttcttaagcaatatgttgggcataaggaaagttcatgttatcttagaatattaggacagtggcttctccattctggctgtgcatcagaatcacttgtagtctgttaagtaaaaaataaatgcctgccatgtcagaaactcctacattttctaatttgctatctctgatttgctgtgccctgagaaattagatggccaaatatgttagaattcagtctaaaatgaaagtgactaggttctgagtgagaaccatgggaatatgtataaaggatgtgtgttttcttgccctgacactagtgctgtttcagttccttggtggcttttgttgtttgcttcttggtgctaatcgttttcaacagatacaatcacttctgaggagctgctgtatcatagaaatgaaatgttctttactctctaacagaaagtcctctttccaactcaaactggtctttactggtgtttatccttcgaaagggcaacagaacaagttcttgcagaggtatttagcaatgtttaaggccttaaaatggaactatttgtcagttatgattggtggcacctctgcactgcaaacagtacaaaaaccaagattctctttattctcctttgtaagtaagaattctaaagatctataagtgagaacacataaaagtgttaggttaaatttatagtgtagccattggttcaactttctctttctacatttggttcagtggctttttttcctagcattttttttttatcattttttaaaaagttttgaatataacttttctgtaatgtatccccaccacccgtctgtcaaaccacgaagattgctacatgtatttttctttattccttgttctaaataagatttagcacagtggtgtttcatttttttctttatgctttttttttcttctttctttctttccttccttccttccttccttctttctttctttcttttctttctttttttttttttttgagatggagtcttcctctgtctcccaagctggagtgcaatggcttgatctcagctcactgcaacctccaccttctgggttcaagcgattctcctgtcttagcctccagagtagctgggattacagacatgcaccaccatgcccagcaggtttttgtctttgtgtagaaacagggtttcaccatgttggccaggctagtctcaaactgctgacctcaagtgatcctcctgccttggcctcccaaattgctgggattacaggcatgatccaccacgcccagcctcttttgtttttaagacagggtgtcactctgttgcccaggctggagtgcagtagcgcaatcttggctcactgcatcctctgcctcccaggctcaagtgattctcctgcctcagcctcccaagtagctgggactacaggcgtgtgcccgctaatttttgtatttgtagtagagatggggtttcaccatgtggccaggctggtctttaactcctcacctcaagtgatccacccaccttggcctcccaaagtgctgagattataggcatgagccaccacacctggccttttttttattttttacttttttgctaattaggtcaagggttaattttataaacaagactgaaatattttgttgatttaaatgttctggttgactctctttttaacaagaagtgaaacttttactatatattttatataactccttattaaaatgaaatacatttattgcaatttatacttgagatacaatactatacatttaagttgtatattacttttgtaaaccataaaaaaatttattgggaaaatgtcaaaagatggtttgtagattctagttacgtgcctggaaagaaagaaaaatacttttttattatttgggtgtaattcttttgaaacttcaaaggaaataatcaataaaatgtaacatgcttttcaaaccatagtatattagtggggtttgtttgtttgtttgttttttgagatggagtctcaccctgttgcccaggctggagtgcagtggtgtgatctcggctcgctgcaacttacgcttcctgggctcaagtgattctcctgcttcagcctcccaagtagctgggattacaggcgtgtgccaccatgcccggctaattttttgtattttcagtagagacggggtttcaccgtgttagcccaggatggttttgatctcctgaccttgcaatctgcccgcctcagcctcccaaagaattgggattacaggcatgagccaccgtgcccagcccagtccatcttaaattggaagctctctatttaaatcttaaatatataaggtttatacatttttttagaacctgagctctttcaaacaccaagaccctctctttccaaataacgtcaaaatttggccacaggatgtaaacactctataagttcataaaccaaacaaagaaaccaggaggaagcattctttatcaaaggaactaaattaagaagctaaaacctaaataagaaaataaaaccacagactgggcacggtggctcacacctgtaatctcagcactttgagaggctgaggttttttatggtgaaacttgtctctactaaaaatacaaaaattagttgggcatggtggtgggtgcctgtaatcccagctactcaggaggctgaggcaagagaatcgcttgaacccgggaggcagaggctgcagtgagccaagatcacaccactgcactccattttgggcaacagggtgagactccagcctggtcaacacagcgggactccgtctcatgtttactccctacctccctcatgcccactgctaagatcttattgaaattttagtataaaaaataattaaagaggctgggcatggtggctcacgcctgtaatcccagtactttgggaggccagggtggccatatcacttgaggtcaggagttcaagaccagcctggccaacctggtgaaaccctgtctctactgaaaatacaaaaattagtcaagcgtggtggcacatgcctgtaatcccagctattcgggaggctgaggcgcaagaattgcttgaacccaggaggcagaggttgcagtgagccgagttcgtgccactgcactccagccccggtgaccgagggagactctgtctcaataataataataataataattattattattattaaagtaaatctgtaaaagtgctgtaaaaaatgataggggtatagattttccaactagaaaatgaaagctagtgttattataatgaaaagtgaaagtagagaaatctacatcgcatattgcgtggaagaagtcagcatcagaaatggtagccattgtaccctacattgtcacagagaggctccaggcttaaagttgacctgcgtagaaagcaagaatgaattgttggaggaagtaaggagggcgattgaataaagacttttagcagctgggccagctgaaccatcccaacccttcaaatccccttgtacctcttatcccacctccatacacagagcagttgccccaaaaacatttctcccctagggctgaaacttggagaactgatcccagggaaacaactgcctgcttcagctggtttaagaattttagtatgccccagaacaggttttcctcatactggcatttgtatttgtgggaagagagagagaccagactggctgcctgcttgtctgcttagcagcaaatacaacctgaagttaagcttgttgccagcatggcccactcacatccagagaagttgtggttagccctccacaagtgggggaaccttcttaggaaaacaagcgtgcatacaagaagctcatgtaaactctatatattgaaaacttgaatccaacattcgtgaacatgaaagaacaggacatttttggaaaactatgatgaaagaaaaggaacaagatgaataaacaaaagttatgacccaagaggatgtaagataaaaaagaacaataaaataaagttgtaattatcaccctttgagaggtctgaaggttcctgagaagagataatattcatgaaagaaaaagaagatcctatggaaaagaagcaaagaagaaaaacattctatgaagtttaaaacatgattgccagccgggcgtgttggctcaggcctgtaatcccagcactttgggaggctgaggcaggcggatcagttcgagaccatcctggcccacatggtgaaaccctgtctctactaagaatacaaaatatagctgggcatggtggcgcgtgcctgtaactactcgggaggctgaggcaggagaatcgcttgaacctgggaggcagaggttgcagtgagctgagattgcaccactgcactccagcctgacgacagagtgagactccatctcaaaaaaaaaaaaaaaaaagaaaagaaaagattgctaaaaacagttcttcaagatattaaaacatgaaaacagaatttttattttaatgaaataacttggcagcagtctagtgttgctgcagagaatagctgggattgtgttatttgaagataccagaaatctactgaggcaggagaactagaggggctaaaactagatcaggaagaacctcagaaagttgagggacttccacagtagcttttagatatggggtagtttgctgtttgtgggcaggaggctgagaatctaggattttgtacaaaataaaggagaaaaatgttatgatcagttggtacagaaaaaagcacatgacttgattaaactctactcattatggtaagtggcaaactagtaatagaagggaacttagtatgttaaagacaattggcaaaaaccaacagcaggccaggcacggtggctcacgcctggcatcccagcactttgggaggccaacccaggcgattctcttgcgcccaagaattcgagactagcctgagcaacatggcaaaacaccatctctagaaaaaatacaaaacttagccaggcatggtggtatactcctgtagtcccagctatttgggaagctgaggcaggaggatcgctgagtataggaggtcaaggctgcaatgagccaagatcaggcccctgcactccagcctgggtgacagaatgagaagaatgtcattttctttttcttttcttttttttttgaggcagggtcttgctctgtcgtccaggctggagtgcagtggcacaatctcagcccactgcaaccactgcctcctgagtttaagcgattctcctgcctcagccttcggagtagctgggattacaggcacctgccatcatgcccggctaattttttttttttttttctatttttagtagagactggatttcaccatgttggccaggctggtcttgaactcctgacctcaagtgatccacccacctcggcctcccaaagtgctgggattacaggcatgaaccaccgcacccggccgagaagaatgtctttaaaacacacacacatgcacgcacgcatacacacacacacacacacacacgccaggcgcagtggctcatgcctgnnnnnnnnnnnnnnnnnnnnacaaaataaaggagaaaaatgttatgatcagttggtacagaaaaaagcacatgacttgattaaactctactcattatggtaagtggcaaactagtaatagaagggaacttagtatgttacagacaattggcaaaaaccaacagcaggccaggcacggtggctcacgcctggcatcccagcactttgggaggccaacccaggcgattctcttgcgcccaagaattcgagactagcctgggcaacatggcaaaacaccatctctagaaaaaatacaaaacattagctgggcgtggcaggatgcacctgtagtcccagctactcaggaggctgaggcaggagaattgcctgaacctggaggcagaggctgcagtgagcagagatcacaccactgtactgcagcctgggtgacagagtgagactctggctaaaacacacacacacacacacacacacacacacaaatctgacagcaaacattacatttagtagtgaataaaaagctttcaacttggcataagaaacaaggagaatccctagttaatcaccacctctattcagtattgtagtggaaattcttgctagtgcagtaagccaagaaacaaaatggaaagccttaataaaagaattgtaaatgaagaaataaaatggcactatttgcagatgatgtgattgtataccaagaaaaaacaaaagaatctacagacaatttatgagaaaaatgaatttagcaaggttgctggatataagggcatataaaaatgaacagaatttttttattctagcaaaaaatacaaacgggccagtaaacatgaaaaagtgcttatcagcattaatcattagaaaaatgcaaatgaaaaccacagtgcaataccactttacatccatcagaatggctacaatgaaaaggatagacagtgctaagtttggcaaggatatgaagcatctagaatgctcatacactgctggtggcaggaaaaactggtacagtcattttgggagttagcagtgtctgctgaagttgaatgtacacatacccgtaactcatcaattctgttccttgtgtatgctcaacagaaatttgtgcacacattcaccaaaaacatgtacaagaaagtttatagaaacactattagccttcaactagaaacaaaccaaatgcccatctgcagaatggatgaatgaattgcaatgtattcatacaatgaaatgaatgaaatacagtcacatgaaaagtgtgaatgaatctctcaaatagtgttgtcagatacaaaagggtacatactatatgattttaatttaaagttcaaaatagggaaaactataatagaagtcatggtaacagatattcttgaggtgttgggtttgggtggaactgtaactagaaggagacacttaacacagttggtttgcgtacttttctttatgtgttatgtacgtcaatgaaaatttgcatttaaaaactcaggaagaagttaaacactgtagccaggtaactctcaacttgtaggctgtaagtcactagacgatgggacaggactacataagaagaaaaggaaagctttcttcctcatgttgtgggctcctgtggtgtattcctagccatcttttatagactaagctcagactaaggagtggaattgctgggtcatacagttactctttgtttagcccttttgagtatggctagactgttttccaaagtggctgtaccgttttacattcccataaacaatgtatgagtattccagtttctccacgtttttgctaacacttcttgtgaaatggtacctcattaataaaaattaactcaaagcattttgatttgcattccttgtatattctagatggaaatcccttattaaatacatgatttgcagagtttttctccaatctgtgaattgacctttcattcttaatggtgtcttttgaggcacaaatgtttttaattttgatgtttaattaacttatttttttcttgtgttacttatgcttttgtgtcatatatctaaaacatctttgcctaatccaaggtcacaaagacttaacacctacgttttcttctaagagtttgataggtttagctcttacatttaggtctttgctttgagttaatttttattaaggttaatttgtcaaatgtaacccagaagcatatagaaaatctatgaagaaaaaataggtgtttttttttttttttttttttttgagacagcgtcttgctctgtctcccaggctggagtgcagtggcgcagtcatggctcactacagccttgacctcctaggcacaagcaatcctcctgcctcagcctcctgagtagctggcatatatcaccacacctgactaatttttacattttttgtagagatgaggtctcactatgttgcccagcctggtcttgaaatgctgggctcaggcgatctgcctgcctcggcctcctaaagtgctaggattatagacttgagccactgtgcttggccaaaatagggatttttgacatttatttttataacatttttacagttattttaatttttcaaacaagcctgggtttattatttaaaattatcagctaaattagaaaagtaaacttttattttaatcctcattttctaatggtgagataagcatcctgaactatttttttcaagaaaaggcatacctattctgaaggtggcagcagtagtagttaaccagatgtgacaatggaagtaacttaaagaatgaagaacaggctactctgggcacgttgcctatggggtagtcctgctccacaaggagcaatgtaaaaaaaaagaagaagaacagtaaaatgaatacaatagagtttgtattagttttgctcagaaacatgaccccctctcatattgaatttggttttgtagccataattgatgatgaaatacataatacataaactacagcatcttatttgcagaaatacactggctaataaagccatgaaatcatcaaaacttaagcatcaaagacaacaaaacataagtcagttcaaaaccaaaagaaccatggagaaataataaattgttgggcaactatcaccactatccatcttgagaactttttcatcatcccatattgaaactctgtccccatgaagcaacaacactacatttaccactcccccacaatccctctgttctactttctatgattttgactataatttgatttcatataagtggaatcatacaatatctttttattttttttttgagacggagtttcgctctgtcgccaggcgtgtacggtggcgtgatctcggctcactaaaacctctgcctcctgggttcaagcagttcttctgcctcagcctcccaagtagctgagactacaggcacgcgccaccacaccagctaatttttgtatttttagtaaacggggtttcaccacgttggccaggatggtcttgatctcttgacctcatgatccgcctacctcggcctcccaaagtgctgggattacaggtgtgagccaccacacccaacccaatatttatctttttatgtctggcttatgtcacttatgtcttcacagttcatctgtagtgtagtatgtatcagaattttattcctttttaaggatgaatgtatttcattatatgtatataccacattttatctgtttatccattcattggtgggcagttgggttgcttccacattttacctattgtgaataatggtgctatgagcatgggtgtacaaatatctgttgttcctgctttcagattcatctgggtgtatacccaaaagtgaaattactggatcatatggtaattctatgtttactttttttgagaaattgccatattgttttccacagtggctgtatcattttatatttccaccagcagtgcataatgggtgcagtttctctacatcctctccaacactttctcgttttcagtttttgtttttttaatagccattctaatgggtatgtagtggcatctcattatggttttgatttatatttctctaatgatgagtgacgttgagcatcttttcatgtactttttggctatttgtatatcttctttggataaatgactattaagtcttttgccctttttttttttttttcttgagacattctcactcccaggctggcgtgtgatggcgtgaactgcaacctttgcctcccaggttcaagtgattctcatgcctcagcctcccaagtagctaggattacagatgtgtaccaccacgtccagctaatttttgtatttttttgtggagatggagtttcaccatgttggccaggctggtctctaactcctgacctcaagtgatccacttgccttggcctcccaaagtgctgggattacaggcacgagccactgcacctggccctttgcccatttttgaattgagttgtttcgttttttgttgtaattctttatatagccttttgccttttagtgttctttaactagagacattttttgcttaactttcaaagtggcttactggattggttgcaggaccaaatctctcatctgtgtatggcaggtgttgactcttttaacctcctttgttgaattttaatgttgatgttaattgagttttggcatgatattctattaaccttccaaataataagcttaatttcttgatccagccattgttgaatagtgccctttggttttatattgcttatgaaaattctagcagctcatgaaggggataagatcacttgtagtgtaccatatgttatatgcatttcatcctcacaacttgtgagatgtgtattctgcatttttcagatgaaggactgtggatcagagttaaatcgagtaaactgctcaaaatatgtatctgatagtttactaatgttgatatttaaccaagttttcttcaagtttattatcaatttatgcactgaactgattttataaaactcttacatgtaggcttgtatctacatttcaagagtatagccatcactgttttataatagttgttaaaattgtagttgttcctacttaaggactatgtttagtttcttcctttaaatattacccaggtatgactacaaatattatccaggtatgactatagagagccaattagctaagtgattgcccgaaaccaccctatcttattgctgcctttaacaaaaagaccaagaattggatgaaaaacaaccctgcttcactcttggcttttcaaaagtatgtaactggctggcctgaaggtagtgagttatctcaattgatggttcacaatcagttgaacacagatcaaactccttgttctacactttaccccctacttgagtagggggtaaagactacttgagtagtcttttaaaaaaaaagaagaagaaaaaagcatataaccactaagttgagaaatttatttactttaagccattaaccagttcttttcctggctatataatcccatacacaacattatttctgcccaatagaaattttaaaagaaaataaatatctgaagttaattttaatatttttaatttagtccaatatatccaaaatattgtatttcagtgtgtaattaaatataaaaatcactagtgaggtattttacattcattccttatattaagtatttaaaatccagtgtgttaaacttacgacatatctcaattcacacttcccacatttcaagtattcaatagccacatgtgagttatgcctaggggtattggacagtgctgattaggaggtttaaaatgcaactcataaatttaattcatctcttcgatctcagtaaatgacccttctttctagaggtcattctactattcctctcttccttaccctccacttcagacaattttattgattttttgtcttttaaaattttgtaaatccatctttttatctcctgccctaccacagctccagtttggggattcatattctcttacctggactattgcaataccctctcagttggtctttgtgtctctgcttttgcctcataaatttcacttctactgttactaattctgattccaaaatctgctttgcagtgagaatgtctgcctaactgaaaatgtcaccattctactccactacttaataccattcaatatattttagtgatttcacattatttcaaataagtagtctgtgaggtaagataagtatgctgtcctatactatcacaagggatgcatacacaactctttgggaatgtagggaaaggagagtagatatccttttctcatattccttttaaaactgcatgtttagtatctctttctatgtacataacatagaacatgtaaattatttatcagtaaatatattcacagtcccacatcacttaatgaggggctatgttctgagaaaggcttcattaggcgatttcatcgttgtgtgaacatcatcaatgtacttacccaaacccagggtggtatagcctgctacacacttaggtacttggtatagcctattgccccgaggctataaacctgcacagcatgttactggtttgaatactataggtcattgtaacacagtgataagtatttgtgtatttaaacatacctaaacatagaaaaaagtagagtaaaaataccttgtaaaagattttttttaatgatacacctttatagtgcacttttcatgaatggagcttgcaggactggaagttgctctgggtgagtcagtgagtggtgagtgaatgtgaaggcctaggaatttactgcacactactttagactttataatcactgtatacttaggctacagtaatttattttaaaaagatttttttcttcttcaataataagttaaccttagcttactataaattttttactttataaactttttaatgttctcaaactgttttactcgtgtagtaacacttgacttaaaacacaaacaatattggccaggagcagtggttcacatctgtaatcccagcactttgggaggccaaggcggatggatcacttgaggtcaggagttcgagaccagcctgaccaacatggtgaaaccccatctctactaaaactacaaaaattagccagtcatgggggtaggcgcctgtaatgccagctactcgggaggctgaagcaggagaatcacttgaacccgggtttctcagtgagctgagatcataccactgcactccagcctaggggatagagtgagactctttctcaaaacaaacaaacaaaaaaaacacaaacatattaatgggtccaaaaatacacttagatacaatgaataatatctagtatttggtagtacaataggttgctgtagttaacaacaattgattgtatattttaagtaactagaggaatggaattggaatgttcctaatacaaagaaacaataaaggcttgagatgacggataccccaattaccctgattaatcattacacattgtacagctgtacaaaaatattttctttatatccttattccataagcttttttctgtttgttttttaatttctaattttttttttttttttttacttttgaaacttttttgttgaacactgagacgtggctgggcagggtggctcacacttataacccaacactttgggaagctgagatgggagggatcacttgaggtcaggagttcaagagcagcctgggcaacataatgagaccctgtctctacaaaaaagaaattagcgaggcatggtgacatgcacctgtaattctaactacttggaaggctgaggtggaaggatcacttgagcacaggaggtttaggctgcagtgagccatgacggcaccactgcactctagcccgggcaacagagtgagaccctgaatccaaaaaaaaaaacccaaaaacagaaaactgagacagagggccaggcgcagtggctcacgcctgtaatcccagcactttgggaggccgaggcaggcagatcacctgaggtcaggagttctggaacagcctggccaacatgatgaaaccccgtctctactaaaagtacaaaaattagccaggtgtggtggtgcacacctgtaatcccagctactcgggaggctgaggcaggagaatcgcttgaacctgggaggcggaggttgcagtgagctgagatcacaccactgcactccagcctaggggatagagcgaaactctctctccaaaaaaggaaactgagacacactatcctaggcctacaggggggtcaagatcatcaatatcactgtcctccacctccacattttgtcctactggaaggtcttcaggggcagtaacacacatggagctgtcatttcctgtgataacaatgcgttcttctggatacctcctgaaggattgcctgaggctttttacagttaactttaatttataatttgaagaagtacgctctaaagtaatgatgaaaagtatagtttagtaaatacagaaaccagtaacatagtcatttattatcattatcaagtattatgtactgtccataattgcatgtgctagacttttataggactggcagagcagtaggtttgtttgccagcatcaccacaaacatgtgagtaatgcattattactcacattaaccattacgatggttacatcactaggcaatgagaatttttcagctccattgtaatcttattggactactgttgtatatgcggcccatcattgactgaaatgtccttatgtggcaaatgactatagttttaatttcagtaaaaaactataatctacatagagtaggaaaagataagtctgttagctgtacaagggcagagtttttgtgttttttcactgacttattctcagtgtcaataacagtatccggcatagaatagtaactggtcaataaatatttgttgaataaataaatgctgtgcatagaaaaacactctaactttatactttattagacctttaaggcaaaaagtaagtttaaataaacattttctcatctctattcaatttaaatttttgacacttgaagtaaaacttaaattactgtcttcttgcattatcttacagagatttgtaaagaaagtctctaatatgtataatggagtaaaaaaaacttttttcccttctagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcggtatgtaaatcatgaacctgacattgattttgatggatgatgctacttctttgtgttatctttgttatagatttgaggaatcacgactatacttgagggttttatcctttattttgggggattttttgttgttgttgagttttattttggagggaattcctttttttttttttttaggcggaacctcactctgtcgcccaggctggagttcagtggcgcgatctcggctcactgcaacctctgcctcccaggttcaagctattcttgtgactcagcctcccgcgtagctgggattacaggcgcacaccaccattcccagccaatttttgtatttttagtagagacagtgtttcaccatgttggccaggctggtctcaaactcctgacctcaggtgatccacctgccttggccttccaaagtgctgggattacaggcatgagccaccatgcctgacctctacaaaaagtttttttttttaaattagcgaggtgcagtggcacaaacctgtagtcccagctactccagaggctgaggaggattgcttgagcccaggaattcaatcatgccactgcattccagcctgggcggcaaagcaagacttcgtctctttggggggaaaaaaaaaaaaaaaaaaaaatatatatatatatatatggctatgactgtttctctagagcactgatttagccctatcctattgattctgatatattattctttagatgttctttaattttggttttaatttgttctttgacctaaggattgccttagaaagagttcttatagttccaagttttgtttgttgctttaaagttttacttttattacttaatttgtccagagaatatgatttgaactatttcccttttttttttggattacattgagattttccttgggagccattatatgtgattttctttttcttttcatgttctctaggcacttgaaaaaaaaagtctatagcattctgtttctgagtgaaagccatggttctcacaatgatctgcaagcccctttgtgagcttgcccaccattacctcactaatctcgtcttctgctatgcactgtctcatttactaccctccagccacatgtcactatgctccagctacatgttttgtccctgatcaggccattacactgctttgcctagagcagtctttgctaggtattcatatggcttctctctccctgccttgtgatcttcactcacctgtcaccacaatgaagcatttcttcttagcacttttcaatatctaaaatacatttttactaataccctatcaccaccaccttcccaggatataaacaaaggttgagtttttttctctttattcactgctttgttatttttctgataatttagaatgcttgtagtctcagttcttcagttggttacctttataacttaagttccttgagttaccacctgtagacagtatctattggttatgaagaaaaacatatgtttttttctgtcttccatttttctcttctaccatgggactcagattagatatattagtatatttgttaaaaagaataatactactactataggccgggtgcagtggctcacgcctataatcccagcactttgggaggccgaggtggacggatcacactgtcaggagttggagaccagcctggccaacatgatgaaaccctgtctgtactaaaaatacaaaaattagctgggtgtggtggtgggcgcctgtaatcccaactactcgggaggctgaggctggagaatcactggaacccagaaggtggaggttgcagtgagctgagatctcaccactgcactccagcctgggcaacagagcaagactctgtctcggaaaaatagttgtttttattactttaaataaatagattgtgctgaaccctttattattatttaatctgctttgaacaacatccatatcccttccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctcaaagtggtgggattacaggcatgagccccccccaactctggcccattgtcaagatttctagtatttacattcagttctataacttaaatcccccacttatttagatctagttttatatttaggtggattcagtgttctccaccatcctttattatcgttgcatttcctgaggaccttgttccacaatgtaaaccaacatggtttccttgattaagtcttactatcaaaaaatagaagaaaaaggccgggcatggtggctcacacctgtaatcctagcactttgggaggtcgaggcaggcagatcatgaggtcaggagttcaagatcagcctggccaatatggtgaaaccccgtctctactaaaaatagaaaaattagctgggcgtggtgatgtgcatctatagtgccagctacttgggaggctgaggcagaagaatcgcttgaacccgggaggtggaggttgcagtgagctgagattgcgccactgcactccagtgtgggcgagagagcgagacactgtctcaaaaaaaaaaaaaaaaaaaaaaaaagaagaagaagaaaaatggtcagctgaactgaacagtgtcccttgtcatatagaggattatattttggtacaagttcctagtcccattgtagattggagacagtttgcagatcagcagtggtcaaggaacacattttgagaagcacagttttacccagaacttgaataaatgtccttgatttttttaagtctaaaatcctcccagataatgcaagggcttagaacactttacctccaatacctttttctgttaatatgtatactatttgttgtcatgtatattaagttctgtattctagactccataaggcattattattgttttatacagtgaaaattgagatttacccacatatttacttttttgggttggtcttcattctatcctacatacctaagctcccatcttagatgatatttcttctacctgaagaaatccctttagtatatttcagtgtagatctgcaggtaacatgatctttatttttaagattattttgttttatattgtttgaaagtatttttatttcatctttaattttgaaggatattttctcggaatatagaattcttttggatgtttttgtcagttggctaaataaaaaaatagaatccttccagcactttgaagttgtaatattaatttgatatattcatatcatgtgactgtatcttaacccttaagatttatcactcagtgaaaatattttttagcaggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggaggtaagtgagaaaatctgtttatgaatagctgtttgcattattttacatcacaggcattttaatttaaaaatgtaattctaatataaaatatttccaatttttcatgtataccatgtcattttttaacagactgtagaattttagaattggaaggcgccttataggtatagtctgcagtttaatttgcaaatgatgaaactgagggatataaaagttgaataacaatttgattttactgtttcttagagaagatttttatttcatcctaagttaattctgagcactctactaataaacttttggtgaaatggtatcttatttgatgagatgcttgctgtatgtatccaaaaaaaaaaaaaaaaaggatcaagccggctgtttatttcctttattggttacacaatattctgaatatagctgtggaagtcagacttttactttgaaatagtagcaacagaatgaatagtgtttcatttgtgtctttaccagaatggatagaattttggaatgatgtatgcagaagcattttaagttctgttaactttaagcattatagaaaactcttcctaaatgagcatgttccctgacatactgtttctaaattgacttgacataattttactatcatggccataaatggagtaaactgaggttaaatatggcttctgggccaggggcggtggctcacgcctgtaatcccagcactttgggaggccgaggtgggtgtcaaaatggtaaaaccccgtctctactaaaaatacaaaaattagccagtggcagacgcctgtaatcccagctacttggaaagctgaggcaggagaatcgcttgaacctgggaggcagaggttacagtgaaccgagatggtgccattgcactccagcctaggcgacaagagcaagactccatctttaaaaaaaaaaaaaaatatatatatatatatatacacatagctttgggagataattaagattggtttcctgtttttctcagtcttttctccccagcaattcagttatttggtattattatacttatggatggagagagaaaccagatattcatcagaagctatataatatttttcatatgctacagtggaaatatcctccttttcttgtttttcttccttctcatagagtggaatttgagcatcattttcatgaccagtaatattgagctgataccaaagactcattaagcaaaaaaaccctattcacatctaccttgtgcttaatcacaggttatacaaggcaaatctctgaccccaaggtactgtcattctcaccggggagaagagaaatgtaaaagagttaccgaaaatgtgattactcctaagaaagaaatgtacagattctctgcaaagagggctgagggagggctttactaaggagataatcccagagctcaggcatgaggtgggagtagtctgccaagtggataagggtggggagggccttcaaggcagaggtgctacatgggctgagacaggcatgagaaagcttgcctggagctgggtgtggctagggaacaggcatggagaaaggaggatagatatctaagtgttaagcagtggagacctgatcctgtaaacaaagggaagcagttgataaattacaaagagaagggttgataggatgttttttaaaggatcactctgccagtgggttggaaataaaattaacaggtagggaaggaaatggaatgggggaggcggattagagatggtctgagttacggcagcggccatgagattggagaggtgttttagaggtacaatcagtgcagcttgacctggttggatgagggacaggtaaggggcctggcttgtcagagcttctgataaagggatgctcctacaacatcttttcaaatgcagaacgccacacagattttacagtgaatcttaagtaatttaaaagtaaaacgtggtggatagaggaaccatgaatggaaactgctagtatagactagactggatgtggagcaagtaagagataatctgctggagcagacaagaaaaatgtcttatttgatgattgaaagacaaaattgtaacaaatttagtttaaagatcttaattgccttttatttgtgattctagaatctggcaacacctcactagtaagtagaatgagtattcctataagctgagcagaagaggttgaacattcttcagtgttttaaagatagagaagcagcaaaggcggatagaggcagaaacagaacaaaaagcagactggacatatcaatgtcactttccttgtaagggtaaaatagagaagactctcttatgccagctgcaactggcctgtttgggtagtttgctattctctttctctcctgatttcctaggtcagataaacaactcagttttggcctggtggcatttcagcatgagtgactccatttttgtttggtctgttgagcttagtgcaggagctcagtccaaaccaatgggctcctataaattttctttttttttttgttgagttggagacttgctctgtcacccaggctggagttcagtggcgcaatcttcggctcactgcaacctccgcctcccgggttcgagcaattctcctgcctcagcctcccgagtagctgggattacaggcgcctgccaacacgcctggctaatttttttttttttttttttttttttagtagagacgaggtttcaccttattggccaggctggtctcttggccaggctggtctcgaactcctgaccttgtgatccgcccacctcggcctcccaaagtgctgggattacaggctgagccaccgcgcctggccataacttttcttaataaatgtcattggcttttgcccaaggagacagtgaggaactcaactgcaaggaagttcagaccctaatgtctgttttctctgagtagttatcagattgagaaaaaaagcagtagtttgaagctggaaaatttgtccaataagcatgtttctttttttttttttctttttgagacagggtcttgctttgttgtccaggctggagtgcagtggcatgatcttggctcactgcaatctctgcctcccaagttcaagcaattctcgtgtctcagcctcccaattagctgggactacagatgcgcgccaccacacctggcttttgtattttttgtagagatagggtttcgccatgttggccagactggtctcaaactcctgatctcaagtgattctcccccctcggcctcccaaagtgttgggattacaggcgtgagccaccacacccagcctaccatgatgtgtgagatatctgtattatcagctgtcctcattggagagtcagctaagctggaattgtaaataagatcttgccttattcttagaggagtaatataacaaagtaattaataatagagtccctgtaaccagaggatttaggttcaaatcttggctcttgccattcactagctgcgtgaccttgggtagttacttaagccctctatgcctccgttcccttcgatgcaaagtggataacaacaggacttaactcataaggtttttgtgaaggtgaattaagataatgtgtgtaaaatgcttacttttgtgttggcagatagagtgagtataaactaagtggtactattactttgattagaacttgaataataattgcaacaagtactgctaacaagtattcattaagtgtatgatttcatttttaatgacagttgccacagatctgatgttgtgtctacttgttcactccagcccctgccccctacaaagatatgatttgtctttattcatattgttaaaatgggttcagtttctctagggaaaattgttatctcagaatagggacctggaaagtgaacgatattttatagtctacctatgttcatattattttgtaaccaatgttttaaagatagagaagcagaggcggatagaacggataaagcagaagcgggcccagctgcaagaacttctcctacaggtaaagataccgagatgttttcattaccttccctgtttctccacttgctgccttttggagtcagtgtgttttctaattgtggtgcctctgagtggtgtgtggtgagcccacgccagggcagcctctctcacctcctagcttgttgccatccacgtgctctgccttaagatggtcccatctgttgccatcatctcagctccacagtagcttccctgccctgtgtgtgacttacgccaggcagcagttcactgttgacactcaggcctctctaaacataaactgtcaggggtctttttgtgtttgtttattttagcccgaatttggaatatccactagtgaagctagttaaattttaggtgcttcaagtacagtaatcaaatctgcctgtaatacttaattttatcagtaaatgacagaatggcatgaaatagttcagtaagatttttgttgttgttgttttttgagactgagtctcactctttcgccaggctggagtgcagtggtgcgatcttggctcactgtaacctctgcctcccgggttcaagccattctctgcctcagcctcccaagtagctgggattacaagtacccgccaccatgcctggctagttttttcgtatttttagtagagacggggtttcaccatcttggccaggctggtcttgaactcctgactttgtgatccacccgcctcagcctcccaaagtgctggggttacaggcatgagccaccacactgggtctgtttcagtaagatttatagaaataccaaaatttaggccggttatatatatacatatctcatatatatgagatatatatatgttatatatatatatctatatatatgagatatatattatatatatctatatatatgagatatatatgtgttatatatatctatatatatgagatatatatgtgttatatatatctatatatgagatatatatgtgttatatatatctatatatgagatatatatgtgttatatatatctatatatgagatatatatgtgttatatatatctatatatgagatatatatgtgttatatatatctatatgagatatatatgtgttatatatatctatatatgagatatatatgtgttatatatatctatatatgagatatatatgttatatatatctatatatgagatatatatgttatatatatctatatatatgagatatatatatgttatatatatctatatatatgagatatatatatgttatatatatctatatatgagatatatatatgttatatatatatctatatatgagatatatatgttatatatgatatatatgttatatatatgatatatatgttatatatatgttatatatgatatatatattatatatatgatatatatgttatatatgagatatatgttatatatagttatatattatatatattatatgttatatatagttatatatattatatattatatatattgttatatattatatataattatatataatatataatatataaataataatgttttgtttgaagagaatattgtgcagctttaaaaaaaaaaaagctgaaactgacagtttattcctatgctcctgcctgtagaattctaccaaacactcctccttgaactcctgtgctgccatcttcttccccccggcagcctctctgttgtccctgtccctgcacagttatctgcagtatcccctaagagctcatgccccaaaccctgtgctggggccctcctggaatttcttcaaaaccatggaacattttggagcttaatttttttggcacgttatttttaaaaacctgtttatcagcatgccaacagtcatctgcctatcagaaagaatggtgctgggcaagatcaccctcatgtgtgtaggactttcctgtctctagatgcctgatgcaaagaatgaaaccatattttttccctgcttacctctgtaccatgaacattgtttttttattttttaaagtcttgaacttcttttcctctactgtctctcaaaccaaatatttgtagaagagttccacccaggggcaacatggctgtcaacattcatagaaacaggtctctctaaacattaaagtgaaacccaaagtataactgaaatcaacttgtggtcttctggtaaacttaaaacttatttccaaaggccggatgtggtggctcacgcatgtaatcccagcactttgggaggcggagacgggcagatcacctgagttcaggagttcgagaccagcctgaccaacatggagaaaccccgtctctactaaaaatacaaaaaattagccaggcatggtggcgcatgcctgtaatctcagctacttgggaggctaaggcaggataatctcttgaacctgggaggcagaggttgcagtgagctgagatcgccccactgcaccctagcctgggcaacaagagcgaaactctgtctcaaaaaaaaaaaaaacaaaaaacttatttcctcctagcatttcagtttttttcctttcatcaaataaattaagttgtcatagaaagtaaattaagcagccaggcacagtggcttactcctgtcatcccagcacttggggaggccgaggtgggcagatcacgaggtcaggagtttgagaccagcctgacaaacatggtgaaaccccgtctctactaaaaataaaaaaattagccaggcatggtggtgcacacctgaaatctcaggtactcaggaggctgaggcaagagattcacttgaacccgggaggcggaggttgcagtgagccgagattgcaccactgcactccagcctgggcaacagagcaagactctgtctttttttttttttttttttttaataagtaatccatttgctgtggctaagctcacttgatttttttttataagctcatgtcacaactcactcatgtcacatgacacaggtaactattacctccttgctaccacctctcttttatttttggtaatgtagaagaatggagtgagtaaagcaaacctgtagataatcccaatatcctacttttatctctataattgccctttccagcccttaaaccttttccataataaacgcataggaaaatgaatgaacacacttaaagctgttcagcctctggaatagatgttaatgagtttgaaaaagaacaaaaggccaaaggaaatcaatcaaagggcaacaaataagtcagttcaaaataagtgaattatttttccttttactatccaaaataacattatatggtatatgaaatttgtgacagtgttaaaaaaaacattattatgaccaggtgcagtggctcatgtctgtaatcccagcactttgggaggccgaggtgggcagatcacaaggtcaggagttcgagaccagcctggccaatatggtaaaaccccgcctctactaaaaatgcaaaaattagccaggcatggtggcgggtgcctgtagtcccggctactcgggaggctgaagcaggaaaatcatttgaacctgggaggcggaggttgcagtgagctgagatcgtgccactgtactccagcctgggcaacagagtgagactccgtctcaaaaaaataataataaataataataataaaaacattatgtttttactgctctcttcacttgaaaaaccattgatactattaaatgtacacagcattaaatagtgaatcacaaatacataagggccattagttatcactgcttatattcccccatataccagggtcctcttgtggcactagggacagacaccaagttaggcaaagtgtaggaacagctcttgagatgtgtattctagtaaaagggaagagaagctatgcaggagtatttaagcatgtaattctttttctcagttccacagtttaatcataatttttcctcattattaaaggaattaagcaatgaattcgttttttagcaacagaaaataatgaaatgtaacctcaataatgtttggtaatgatattgatagtgctagttattgatagtgatttttggacacacttaggtctacaataaattggtgttcattattttttgtgcttttcaaagagtaaatcttccccttttggggagatagcactcagccattttaagataatagtaatcttttcttttcttttcttttttcctttcctttcctttcctttcctttccttcccctttccttccccttccccttccccttcccctcccccttccccttcccctcccttctcttcccttcttttctttcctttttttcttttctttttcttcttgagaaagggctctgttgcccaggttggaatgtagtggcacagtcatagctcactgcatcctccaactcctaggctcaagagaacttcccacttcggcctcccaaagtgctgagattacaggtgtgagctaccatgcctggccaataatagtaatcttactgaaactttagttaaggtccagaacctgaaataaacaatactgatcataagattgctaaaatgtaaaaaataaatttatcactactgggtgacaagattataacaagctaatgaaggggaatgaatggctctgacttgaggaacttttaaaacgttatctgtttcttgagcagatgaaaaacttgaactgcatacagtctttctagctgtgaaattctatcgtacatttaccttattaaaaaaagggagatcacttgtttgtttgttggttggtttttctcagacagagttttgctcttgttgcccaggctggagtgcagtggtgcaatctcggcttactgcagcctccgtctaaaagggagatcactttctttggcttttgagtaatggttataactaaaagtagcggcaagatccagtaaaaaaatttaggccttgatgtatcttataattagtgctgagcctcagttacctcatctggaaatgtctggttggggaaggctggggctggattccaaactgtgcccagaggctgctgagaagttctgtggaggtgccttagaaaccatgtggctgtgcttgagggcagagatggcagagcttaggacctggcctcactgcagccagcctcaacagcaccacttccatctgttttacatgagtttttttttgttttgttttgagacagggtctcattctgtcacccaggctggaatggagtggtatgatctctgctcacagcaaattctgcctcctggattcaaacaatcctcccacctcagcctcctgggtagctgggactataggcacataccaccatgcccagctagtttttgtattttttgtagagatagggttttgccatgttgcccaggttggccttaaactcctggactcaagcaatcaacctgctttggcctcccaaagtgttgggattacaggcgtgagccactgtgcccagcctccctcgagattttatttgaagaaacaattttgtgcctttaaaatgtttgcatatccctgggctacacatcctaaagtttgggggcatatttgaccccaaactgtcaggagtctatgttagataaatggtatcacccttgctgtgtcatttgctgaagagttccaggtgcctactggttctttcccagattgtgaggtcctgtttctatggatgatggaaaaatgtatttattgagttggatcattctttcttaaatgtttaattttttaaattaattcattagtgcaggcgggatgtctctttaaactctaattttaaactatatttaaaggtattatcttaattcttttaaattccaactcacttatgcacaattgaccatattgtttttattgatcattacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtgagtggagaactagggatgggtgcagggctggccttctgttaacattttcatatcatttgcaaactcaagaaggatgcactttattagttgcacccctcaaaggctggcttccttggggcacatgaaacacctcctgaaccatgggtgcaatcttccactagtgtgcgctccaaccctcaccctctgtggtcccctgtcttgtgccaggcactgtgctgtctgtattatatgtgtgtggcagtgtctgggcccaacctatgacgtgctgcatgtatgtggtaactctgagcaagtaactgtgataagttagcccagcactgtgggtctgggacaaggtagattcattggtgattcaccgtcatagtttattacggaaatattttaggtcaacatgtggcattaaaccaattatttctttgttttgctatatcatagttatgcatgcttctgtttattaatgaatgtatgaatagacatgaaaatgcctggcacattctttgcttcctttaaattgtgtttttacattttaactaagatcaatgataatattcattatggcaaataagaagtagcacttttcaaaatatagaattaatttgtgatgtattttaccattcatgaaaaagtttctctcagtggtcttcaggctgtgaccagtaccataaaagagttaagagtatatatagggtgcagagtgagacggatccatgtaccgcttatggctcccccacttcgctgctgcaaagctctgttttctcaagaacaaataggaatgatactgggtcccctatgacttcccagccttgtgaggattaaatgagttaatgtctataatgacttgaggtaagtgttttttaaatgttagctgctgttacaaaaggtcagcctatagtttattgttcaaatagggatttattaatgcaaaagaagactctataataattgcgtcagtaccacaggcataccccagaactgtcccagggataccagaacttcctgtctcctagggccctgacattgcccttgggcttcactgctacttgttttcccactcttcttcctggcgctcttgcgccccctgccggtctctgttgtgtccagagattccgggccactccactaagaaggcacacacacaaaagaagagttagccaggcgtggtggttcacacctgtaatcccagcactctgggaggccggaggctagtggatcacctgagatcaggagttcgagaccagcctggccaacatagtgaaaccctgtctctactaaaaatacaaaaattagccaggcttggtggcgcacgcctgtagtcccagctactagggaggccaaggcaggagaaacgcttgaacctgggaggcaggggttgcagtgaaccgagattgtgccactacactccagcctggacgacagagcaagactctgtctcgaaaaaagaaaaaagaaaaaaacagcaggaatttcaaaactatttgataattgagactatagacacaaaaagaaatagtagaggttatgaagtaaaccagaaccaataaatttttttttaagagtggattcttggccgggcgtgttggctcatgcctgtaatcccagcactttgggaggccaaggcaggcagatcacctgtggtcaagagtttgagaccagcctgaccaacatggtgaaaccctgtggctactaaaaatacaaaaattagcgtgatgatgcacacctgtaatcccagctactcgggaggctgaggcaggagaatcacttgaacccaggaggcagaggttgcagtgacccaagattgtaccattgcactccagcctgggcagcaagagcaaaactccgtcccccccaaaaaaagagtggattctcactgttctcactgttgcccaggttggagtgcagtggctatttacaggcacgattatagctcactgcagcctcaaactcctgggctcaagcggtccccctgcctcagccttcctagtagccaggactgcaggtgcacacttccttggccaactaaagctgatccattttttaatcttctaagtttcttaacctctctgagatcatgttcctttctccacaaaaataagaattatagtatttaccttgccagtttcaaaaagttatgggtaaattaatatacaacccagcccagtggtcagtaagtggtagatatctgaattattttccacacacttgcaaattctttataaatatatgtcaaagaggaccattaacatagtctcagaaaactgagaattcaggccgggcacggtggctcacacctgtaatcccagcactttgggaggccaaggtgggtggatcataaggtcaggagttcgagaccaacctgaccaacatggtaaaacccccatttctactaaaaatacaaaaattagccaggcatggtggcacgcgcctgtactcccagctactcaggaggctgaggcaggagaatcacttgaacccaggaggtgaagtttgcattgagccgagatcgtgccactgcactccagcctgggcgacagagcaagactctgtctcaaaaaaaaaaaaaaaaaaaaaaaacaacaaaaaactgagaattctggaaaatggttagcatcttttcagataaaaaacacaaaacttagcattctagttactctctcaaattagtctcttgttttgtatggagaattataaaactatcttaggttagtctcttaagtctaaaaagaatgatgggaaaatctgggaatcattggcctagggtattgtggacactgttcccccaggctggaatctggtgaggcttccatctcttgggtggtccctgactcatgccctttccttggccttcctttgagtggagggaaggaggctctgagtagcttgtacaagcttgttatccgacgtaggtccaaaaaccctttcagttactttggtgatgcagtctttccccataattagccaagaggctttccacaatgaggattacatttacaaaacgatctgcttttaacagatgcctgaaatcatccctgtggcaggcacccacttcagatttttttttttaagttgttattgtactttaatcaaattcatatactttagattacttaaattggtattttgcttcaaattataatttttgcttctaagataatctgttattcaaattatcttagatagggtataaagttttaccctcacatgattttaatagaatttcatgaccaggtgaaacctaccattgtccccaaaccctgtccctgcagggctgaggcccatgatgaaggtgctccaggcctagcctaggagtcggaaggactgtgtcttccttcttttgcctcttgattaacgtgtgttgggctgctgggaagctgggaatccaatttgggtactttccaaacatatttggaaacgtgcttgtattacatgtgacattttttcttaaaacattttactccttagcctctcaggacaggatttggggttgttttcacttgttgaaagtcttctatttattgcttatctgaagtaggctgtagctaacatttgactcatgaaaatgaagtaagcattcaaaatgtttttttcctcaaagctaacaggccaactcggaatagggatatcgtaatattaaagtagaaaggcttttcttttgtggcaaagctgtaggcaactttgagaagtactggatttagaataaaatttctatcctctgtttgtaacagagttagggctaaagtttgtgggtttctatcatctgtcagaggaatgttgttttaattgggaaagtgttttatttgagatgtcattcccctgacagagcagaatgactcatggctctctaaatggtagcaatttctagcactatagctggatttaggcccccattctgttacttaaactatagaatacaaaactattcagacctctccagcaccaccaaaaaccctttactttgtttcctgatgcaggtttgagtatcttttcaattttgacaacacctttgagatccatgatgacatagaagtactaaagcggatgggaatgtcgtttggcctggagtcaggcaaatgctctctggaggatctgaaacttgcgaaatccctggtgccaaaggctttagaaggttatatcacaggtatgttaactgatgctttcatgtgttgtccctgattaaatgttgaatccaaacttgttaaaacctttcttatagaaaattgcaaaattttagaacatctgtgcttgtgtcgacaaactgaaacctttaacactttaggaccattttttcaaaaattagattaaatagtttgtttcataacattatgaacttacatctatacaccacacattatatactattacatctaaattggctcactcagcactgaatttggctcttcagagagatcttgtaattcccagtacctagcttagagcctagttagagtaagctagtaaaagctcaatgagggagttttaaaaaatcttctcttagtgccctgtggatacttcaagggaaactttgggcaatttacaaaagaaagtaggtacatcctggccgggcgctgcagctcacacctgtaatcccagcactttgggaagccaagacgggtggatcacctgaggtcgggagttcgagaccagcctggccaacatggtgaaaccctgtctctactaaaaaaatacaaaaaattagccgggcgtgatggcacatatctgtaatcccagctactcaggaggctgaggcaggagaatcacttgaacctgggaggtggaggttgcaatgagctgagatcgccattgcactctagcctgggcaagaagagtgaaactctgtctcaaaaaaaaaaaaaaaaaaaaaaaagtaggtacatcctacttccctctaatggaaaatttagtatatctattatctgcccatacataaaaacatttgattaattgaattcagagaggaggagtggactgaaagtttaaatgtcaggggaaaaaagggcagaacggggtaaacctggattcacatttgtgtacgctgctcctctttacagtaaaacttctcaagttgaccatatttactgttccttcttcctctttccccagtcttaaattgttcttattaaatactgagtagatacaaaggttgtttacgtctgtagactctgaagggtcacagtacagtagacccccatgaatccagcacccagctgaggaaagcacattactgttccagtccactgcatgcccctgccccaggctctgtgccctttcccacccctcaaatataaccattctcttacatttcattgtcattcacttgcatttctttagagataaaccaaaatggtaaactggaaataatgtattatttagttttgcctacttctggcctctatataagtgaagtcatagtaatatactctttggtgatttgattttttttcactcgatattatgttctttagagtcatccatgtgatttaatatagatataattcatacattcttactcctgtgtaaaattccattatatgaatacatcacagcttatctgtttattttactgaaaataaactgtttgtttccgattgcttgatgttaaaatacagtgctgctttgaacattcctatacatgtatcccagtgaccacatgcaaacgtacagattgaacttgttaggtcagagttgggtacatcttcagctttactagatgataccaaaaattttcaatttgattttaccaaattacacgttccccagcagagtagaagtgttctattttcctaatcaggtgggtctgaaatgataccattgtagcttttctaaattgagattgaattcacatgccataaaatacaccatttaaaaatgtcagttcagtgatgttttggtatattcacaaggttgctaatcatcaccactatctgattccagaatattttaatttaaaaacccaaaaagaaacccaaacccattaacagtctctattcccccattctccctcagcccctggcaaccactaatctactttgtgtcactatggatttgcctattctagaaagacgctttatgtgaatggaaccctacagcatggggcattttgtggatagcttctttcacttagtgtagtgtttcaaggttcgttcatgttgtagcaccatcagtatttcattcctctttattgccaaatactattccattgtatggatggaccacattttgtttatccattcatcagttggtagatatttggactgtttccactttttggctatctcgaatgatgctgctgttaacattcttataaaagtttatgtgtaaacatatgtttttatctctaaaaacatatacctacgagtgaaattgctgggtcatatggtaactctgtgtttaacattttaaggaaataccaaactgttttccaaagctcctgtaccatttacagtccaaccagtggataagtgttccaa

SEQ ID NO: 15092 - DNA, 133719 bp, Human
  misc_feature (1)...(133719): n = A,T,C or G
ttagactctaatgagaaagacagacaataaagaataaacagtcatcctggccaacatggcaaaacctcgtatctactaaaaatgcaaaaattagctgggcgtggtggtgcatgcctataatcccagctacttgggagactgaggcaggagaatcgcttgaacccaggaggcggaggttgcagtgagccgagatcacaccactgcactccagcctggcaacagagcaagactctgtttcaaaaaaaaaaaaaaaaaaagaataaacagtcaatccttataaacatcgaaaagctatgaagaaaacaatcggagtgctgtgagacagagtggcaggtggagcctatcttagatagtgtaggtctgcagaggtcacatttaagccaaggcctcaagaatgagaagcctgccagccatgagagaagaggggtagaaatacctgtggacttcaggctcagcatgtgagcagatcctagctcagggaaaagctccttgtgcttgagaactaaaacgggcctctctaaacccaccccctttccagacacctctttcacacagatgctgacttcacctgctcattctgattaattcatctcttgagctgcaataggtcattctctgggttctccttacttgacatttgggtgcataccgtcttttattattcagctgtgtggaagatctttacgggacttgagttcctttcttcacctctccaagggcatcagtcaggcttctatttatgtggaagatgctgaagaaatacttgaattctattcagttcaataaacattaattaaatgcctggtctgtgctaggtggtacctgctgggtatttaattcagtgctggtgtttaaaaataaccaagcctggcaagatggcaagaccctgtctgtatttaaaaaaatgtaaaaattagctgggtgcagtaaacatacctatggtcctagctacttcagaggctgaggcaggaggatcccttgagcccaggagtttgaggcagcagcgatttatgacagtgccacagcgctgcagcctgggtgacaaagcaagaccccatctccaaaagaataaatacataaaataaacaaaccccagtctaaccatgagaaaaacatcacacaaacccattaagggatattctacaacactgctgaccagtactcctcaaaactggcaagatcatcaaaaacaaggaaagttcgagaaactgtcacagaccagaggaggcaaaagagacatgacagctaaacataatgtgagatcggatgggatcctgcaacaggaagaggacaccaggtaaaaactagcgaaataatcagtaacataccaatgttgattccttagttgtaacaaacacaccatagtaaagcaatacgttaaccagataataaagtatacaggcattatctgtactatttttacaaatttctgtagctctaaaactatcctaaaatagtttatttaaattaaaaaataaataaataattaagacatgttccctgctctctataagcttatactccaggagaggagacacacatctaaacaaatatttgcaactcagtatgataagggtaacaataaaaatgtatgccaagtacaaaagtagtccatatgaaggcatgattatctcaaatttagagaagaaatcactgaggagggcaatgcctggagctgggttttgagggattaataagagtttgaagaatgtgaaagacgcttggaaaaggttaatttgagcctaggaaagggcatttgacaaagcctggaattttttcaaactatttggtattgaaaaaagggaagaaagaaaagaaaagagaggagcccagctttggaatttagtcaacaattatgggagaattgtaagtacctcattctttgtggctgggattccactgcccatggcagcagattcacagggcctctgagcattatcccccatactcctccccatcattctccacccagctgttggagccatctgtctgatcaccttggactccatagtacactggggcaaagcacagccccagtttctggaggcagatgggtaaccaggaaaaggcatgaatgagggggccccaggagacagtgacttagagactgaggcaagagtgccgtggtcaatcatgggtcattgtcttcgaactggacaggccagaatgtctgccacacccacacctgcaggtgaaggagccagaaggtaagagccactgagagcaagttctttgctctgctgatcactgtgtaccctccccccaccacccacaacccaatgtctggcttaaagtcagttctccaagaatatctgacgagtgaaggaaaagatgaagcccatgaggactgttacccttcagccacagaggaatgaatcaaaatgggaacccgaggtgggatgcccaagccaaaggtcaggaggtgaccagtgaagtggctggcctccaacagaagggtgatctctcaagtcctctcttggggaaatctgaacaggaggaggcaggtaggcagcagctgaagcacagagatttgaggtggagaaggtcgtgaatccctctgtagaaggtgctgttataagtaagcaaagtctatgaatgagcccaatggtggtgagtgagtgagtgagtcagttactatcagaactgagaggcaaacatccagggaaaggcagtaaccttaaggcagagaaactgttctgcccacgagagggacagcaagagagcagcagattttcccgatcctgtttctgtgcggcccacccactctggtgacagtgacctctacaagcccaaatgtcctatcaaatgggggtaataacagcgacagcctcatgggtttatgatggggttgacaggagacaatccacgcaaagcactgagcaccatgctgggcagctaagtagttcatcaatgatatttttgaggttgttgttttataattcttattaaattccatgagaacgcggctactcatattactccatgtgcattcttgcaagaatcaccctttagtttggtgagtctttgttccttgcaacaacaacaacaacgacaacaacaacaacaaaacccgaatttcaaaacgatccctggtcagagttgcaggaactatgaaatatgtttgacacagcccagtggaggccctaatccctagggatcattttccctgtcagttccaagaggggaattccctgtatgctcagctagctgtttgacagtgactggtgcagcttgtgggcttcctggtttggggaggttgagctcaaacagacaccaggctacccaccctgggttgaactgtggggaactagagaagttagaggcagggaaatagtcgtgagctaacacaggctgagcattcctggtgtccctttgggctccctgaggcagcagcgtgctgagaagcctgtccctgctgaggaaggaagaacgtgggagctctgaagacacaacttgtcgacccccatccctagaaaatgttacaaagctcatattttcactttgttgtttaatcagtggtttcatacaccattagcattattttgttttctgaataggacacataggtacatgatacaatattcaaaaggtacgaaaggatgtaaagttagaggtgtaagccttatgccttagccacagttaccaatttcttatgcagccttccgaaaatccattctataaatatgttagcatgatgaattcaaacatacatattcaaatatatctgtttgtacacactgtctgcatcttgattttttcaattcacgccacatctttagagataattccatagcaatttcgtacacaatttccttgttctttttaacaactgtatgatattccattttaatgatacaccagacgttatttaatcccctaataaatttttaatttgttttcaggctttgcaaatacaaacaaagctacagtgaatatcctcaaacatgaaccattttgtacatatgcaaatagaggtacaggataaattcctagatgcggaatagtaggacaatggtaaatgcatttgtaatattaatggacgttgcaaagtggtccttcatggagactttgccagtttatgtggccaccaataatgtatgtgagtgcctgttgccctacaacctcaccaaacataatgaataagttttttacttaacaaaacaaaaaaaaagatttgtttttgtggtaaatctaaacatggacaaaagccttttttctgttgttgttgttgtttttctgaagcccggtctgtgtctttctgtatgtctgtgtctcttaagtacatgcacacccacaatcccttgccctctctccattggagcttggttgaaaagctttaatctaattatttcttttccacattgtagcgggttttagtctttggtggtttgaatttgcaaacgaagaaaagtagttcttgggcaagtgttttcactaagccctacatttcccaatgtagagggtctttaaagctttccagaaacgattgctgctctcaatatgccagggcccatttcttggttaatttttccaaagccttgataatactgaggggaatgatactggggttgctaatgctcagtatttacagagcttctttgtctgagatctcaaagcacttgacagcattaaatcattgttcccttggccctctcaaaagcatctttgaacacagatggatgttacacagaaatgaaagctgtgctttctatccaaattgcctgaaaggtgaccaggaagaaaataccaactaaccaacatagtttgtagccatagtagcatgtccctttatttacctcaaacaatttaccttttgtagatacatttccaatgaataattgtgtgtgtttgtgtgtgtgtgtatatataatatatatgtgcagcaaatatatatatatacagcaaatatatatatactatatatatatatacacacacatacagcaaatatatatatatatatatatatatatgcagcaaatggaagaggacctcttccatacatgtggtaatgaggttaaattacatcagcgggtcgtgtccctggattcaaaggaagatatgctgaggtctttaggcctcttgactctctatggtctaagtctctgctagtctcttctatcagataaaatatataactatgaccaaacattgcttccagtggtccaggaaaagaaagaaggaagacaggaagggaagaagagagggatgtagagaaaaaaagaaggaaggaaaggtggaaaaaataaaaaccctaattcagatctgatgtttctttccaatgttgaacaataccttataaatagaaagcacagcctggcctcatgcataatgtttgattccaccagtgagtaattgtcctatagagtatttctgcagtcaccccaccataggcctccccaccctttcccaccccctactctccacctgctccatgtcctccacataccatacacagaattccaaccttcgagcaagaattttagtgggaaaatgttggcaactatcatctcatatttcagatacagaaaacaagtcacagagaagctataacttatttagtgataaagattctatgttaggcacacatatctcaaactgcgtctcctgggtcaaaaatgatcaaccaatagttttgattttaaaaaattatttaatacctaaataacactgaacatcaaaataaaagtaaacttactggggtcctgccaccccaactaatcatactgctttcatccccctctgtatcctttgtccatattcacataaagcggtaaccagagcccacagcaacataatgttatgggcaacagcctggctctggagccaggccacttgtgcttatatccaattccaccattgactagctgggccttagttcccttgtctgttaaatgggaacattagcagtacctacctcatggtgctttcatgggggaatcaatgagatgtccatgttaagtagttagacaagtgcctagggtatatcagccctgggtaaatattagctgctgctgttattatttttaatttttgctttctgcttttaaaaatgtatcataagcaagtgcaatagaattgtagttgctgatagatcccaaatccttgctaagctgactgccccctcctgggcattactaaagaattttaaatattttagactgacccctctccagattcctgggggtccctacactgcagagaggcaagcaacatcttttgggccctcctctttcagggactttgcagagcacacctgtggtgggcttcactgctatcctggctcttttacactgtaaatttcaaggtttcagggaaaaaaagaagggagtgaataagtgaggcaagacacagggaagacacggcattcctcagggtttccagggtctcactgggtagctgcaaccttgcaatcaaagattatgacatggccgggcatagtggctcatgcctgtaatcccagcactttgggagactgaggcgggtggatcacctgaggtcaggagttcgagaccagcctggccaatatggtgaaaccccatctctactaaaaatacaaaaattagccaggtgtggtggtgcatgcctgtactcccagctactcaggtggctgagatggaagaatcacctgagcccaggaggtggaggtggccgtgagccaagattttgccactgcaccccagcctgggtgacacagcgagactgcacctcaaaaaataattgttttaaaattatgttttaaaattgctgatccttttcagaatgatggtaataaaaggcattggtatcttggtattgtatttctttctgtttgtttgagaccgggtctggctcatcacccaggctggagtgcagtgatgcagtcttgtctccctgaaacctccgcctcactgcaacctccacctcccaggctcaggtggttctcctatctcagcctcctgagtagctgggactacaggcacacatcaccatgcccagctaatttttgtatttttagtaaagacggggtttcacatgttccccaggctggtctcaaattcccgagctcaagcaatctgcccacctcagcctcccaaagtgctgggattacaggtgttagccatcacgcccagcctgcatcttggtattttagaagctgatttagtatcttttgtattttatacatttttgttaacattttgtgttagtataatttcaaacttatagaaaagttgcaagtgtagcataactaactcccacccaccctttatccagattcactaattattaaccttgtgctctacttgcttatcattctcatccccatgtataaatactgttatatatactattatagagggagtatacacatactatgggtactacatggagggaacattccactttccttttttttgagtcacagtttcactcctgttgcccaggctggagtgcaacggtgcaaccttggctcaccacgacctccgcctcccggattcaagcaattctcctgcctcagcctcctgagtagctgggattacaggtgcctgccaccacgcccggctaatttttgtatttttagtagagatgagttttcaccgtattggccaggctggtctcgaactcctgacctcaggtgatctgcttgcctcgccctcccaaagtgctgggattacaggtgtgagttactgcgcccggcccccaccctttactctttttcagtgtagatttcctaggaacatagtctttctcttccatgaccacagtacaatgatcataatcagggaatgtaacattgatacaatactgttccccaacccacaatctgtttttgtatttttaaagcctcgcttaaaaagcaggtgtgggacaaagatgataaatgtacatcatagcctaattaggccacttgttcacctggtgacctccccactggagtcattcttcaaagcccagctctaacaaggcacccctgcaagcctgtgcaggctgctgtccccacctggcagaaataattctctgccaggtagctctctgtgtgtgccccggttatagcccttcatgttatatagcaacaatttactctctggctccgcagtggactatgagcttctctgggtttccagggcctagttgggtagctgacagataattgatgcttaggagatgtttgttaaaaaatggatgggcaaatagacaaatggaagcctctggtgggctgaacttgataaagaggtattttcttaaaaaatatatatatatatattcgatgaaagttcagagatacacaatacagtgggtgaaattataagttcttcttaggaacatcttagggcaaggaagacattgtgtatgggatcttggctcatgcctcactgccactccctcaaacttttgtctcctccctctacgccaaagcatagtaactgctgaaagaatacagttatgcgcaggaagcgtgtatagactagactccctgaagagctggtgcctgtgagcataagaaacgcagcccgggattgcagcacttggcagccctgggctttccatcattcctgccacgttcacatgcagtaactttccgtgccggctctgagctgctagtgggaggcggagctccgggctgtccccctctccccagcagccatcagcgccagggtgcccggcaactgtgccttggactaacccgaaaagccacacatcccagacctgggagcactccagccaaacgagtttgtggcagaacctggtaacttccagagcctttgaactggagtgtggagcttactgctttcccaaacacttctcctggaagatactgtcaccagccagccccttggtcccagctgctgctccctcccaggtccatgctggtgcaagtgtcacaaaacagacagtaattgagttcagcctttattgagcagctactctgtggcaggtactaccctagatttggacattaccatgttacttaatttttattttcatttaaaaatacgtaccatttgctgcatgccagacactgttctaaccacttaacacataagaactcatttgatcctcatgacggcctatgaagtaggttctattatgatttcaattttttggatgtggaaactgaagcacagagagattaagtcacttaagggatgagatgtggtccctgtccttatttgagctaataccatgaggtctttttccctttcacattttctatgttattttcacttactttccatttgatggttatctcaaaaatattattcagatccatctgtaaatatgcattaatacttactgtgcaccagatatcctgggactccaaagaagtctaaagtagattcctcactctaaagcaacagagtttggttagggtaacgaagcatctatactttagctacaaaaggagatagtgagagatgctgaccgtgggaccttcaggagttgaagggacaggaagaatcttaggggcaggaatgactggggaagacgtcagagaaggtggatggagctcttggaaacctgaataaatgaacagagagaatcagcctagtgaactacggctgtctgtccattgaggcctgcaaaagcaggcaaagatgcggtacaccttctgcagaaagtgcctcaaacaatgcctgtggttctggatcttaaaagcataaagccctgaaatcttgagtggtttggtggacctcacagctcctgagccacagtgaagtggtcaagatggatgatccttgtgtgataatacattatgactcattatgataaagtggcaatacagaaaatgtggggaccaacttgtaggcagaactcccgcttgtatgcagacagatttcaatgctatgagatgaggggaaggagggaagcagctaatgtgtttagtgttacaggattactactaaatttctcagttgacttatatgttatgatattcttatgcaataaaattttaaaagattttaggaaacaaagcaaaacaaaatttcctcagccctgatgattatgaactgacgtaaaaggcatcatcatgatacatcatctgtgaatatgggttgccatatttgtagccccaagatagtttgtccccaaattgttcaaatgcagctgaggtggctgctgacagtgcataaaactaaattcaatcctcaataataggaggagtcacaacttgtctttgtctccaaagaaagatgatctattgaagaatgtgtgtcaatttttgtagtcatttcgttaccacgatcatgctttaactcgaagaaagcaccactgaatcctggagtgcactttacattatgaaacattacagtaagcagttgatgtccaacatgattgcaattagagcttagtgaagcacaagaagggacaatccatgtaggatgcattagtgtaactgtgtttgccaggaacaagttttaaccttttgtacagctgttgagggaaaggtgccagtattccctgtgagaatacctgtcaagtttgcatttgaacagggaacacctagtttatgtttgtgaagaccactccctttttatgctgagcacctttgggcatgtgtcagcaaggaggtgttaaggcagatgggaaaaacaaatgcatgagcttcaaacccagcagattagcaagatttggagaaatggcaaggcaggaaaagttacaaagaaatcacctattcccataacatagaaatgttggaaagtgacatttggagagtgagaaggggattatctttaagaggtaaaactcaaaagaaggatgactttctcctatcctgaaatgagaaaatacattcatttttctttttgtcatcaaagtataaagaacatgttacctatgtatcctgcctcttataaagctcctggagaataaatactttttttttaagttgtgttcacatattttatagtgagttgaaatttggtaggggcaactataacataaagtaggtatcctgcctcctaatattttaatccagtcatccaacatttgacacatttttggggcactgctgtgtgccaggtgcctggggtgcaatactgaacacaaaggacgggcttcaagatgtgcgtgtatgggatctgtgtcaccacctgctacatgtatctgtaggggctgtgtgggtaggcaggggtcagagcagagagcaatgtagcagaggttgcccttggccttggccaaagttgattgagtcttgaatgctggtacccaagcattactccatcactgtttctgaggatggtgttactgtcagattcttagagtccccagtcacctctgccccacctccagcaacacaggagaagaaaaccagccaagctaagtgttactggccaagaaaagaaagatatggataactattaaaagaacatctgtttaacaccttatctgtggcctgtagtagtctattcctaactgataattaaaaattgccctcggttacaagccccattcacttctctatgacttcttagttttaagaaccagagtttggcttgccaagagtacagcagacttcttgagcacctcttatccctagctgcctctctatctttcccccatacccacagcaacaccctgacatagccaggcccagcctctggaacagtcctgcccaaacttgggcttagcaactgttatcaagaactggatgaactgaggcctccttcccaccacagggcaaatctgcccatcgccaggtttgaagttcttaatgaagaccaggctgagaagaagctcacagttttaggtttctctctctctccctctttctctctctctctctctctctctctctgtctgtatgtgtgtatgtgcgtgtgtgtgtgtattttttctttactctttcttccttccttcctgattaatatagctcatcatccactgtgctatgaatctgtaacacgcattgaaattggccaatgacagttctgcaggcagtccctccgggggagtctatggataggatgttctccaagaggaattctcactgtcacgttctgccttttgcgcagttgcttcctcagaccttgctgccttcaaaactcagtacagagttcaccctttgctcctgtgtttctgtggtaaaaatagggcccccaaatttcaatggaccaggtatgatttctttgcctcaattagtggacaagcacttaatgaagactggggctgggtgctctcccttgtatgagtgattgattgattcaacaaatatgagcaataaaatggcacctactgtataccaggcactgtgatgggttctgtgactataacactgagccagacagatacactccctgtcctactgtactcactagtaaagaatacatatcatcatatcacccctgcctctgataagttgtgctaggacagaaaggagagaaagcttggggcgattgtgttgttgtgggcttttttgtttgattgatttcagaagcaattctatattgtgcaagtcttcccccaaatgcattgtcttttatatgaatcttgcccatcatagtaaaagcatgtacatcaagtcttcttcaatgtattttctctgagaactcaacctgttacttatagaggtagacgtgaggctggtctgagaacaaggggggttttgaggaccagggggtttcctacagcctttcccctgactcagcaaaccttgcagctagtcgagctgaacctggatgtacctcaaccacagaacgcaggtatgatcattcttatttgtgcaacgcacaagattactcagggaaaatcagttcatttgtacctgagaaactttctttcctaagctcttttcctgaaatgcagttctgacatgtttggggtctgtttctgttccaagatcagaatttcttaaaccccatgacccctggaattcttcacaacttcccccaaacacccctctgctgctcttcccggctcttgtttctttctgagccttcacaaggactcaaggaatattttctaacttttggttcacaacagataccagtaaaacaacaaacaaatcaaaatttctcaatcctcaccaaccaatgacagccctcgtgcaactgggaggttgcctggcaggtgtgggagatgagattttaacagacaacaaggtgagagatgagagggcagacgcatgcgctggcattagtctcacacacactgaagacgcgtcatagcaccaccctgagcacacacacccttatgggatttgatcaacacttttatcaaattgcttaacactgccaattcacatgttccctaatttaccttgctctcggttgatccccaaaccacaaatacatatgtgtgcctaagtttgtgcatgcatacattaaacaggacataaagtgttttatgcgtgtgagtgtatatatgtggacaaaatttgaggtattttataatgctcttcacattgagttttataagagtccaatagaggtgcatttgcttctcctggagcaatggcactttttagaggaactaaattcagcaccccccaaatgagacatgctcataacaatcatgcttataggttgctcacatgtcaagagctggggcacatgggtgaatggagagtgagaaagcagagttattttcgaagcagccctctcaacctccatccacagaactccatgcagctaaggggtttcaggcagcagggcctcgtcagtcattccttgctcattaacaaaaggacttgtcatctgaagaactggttgccatgcgttgattgttaggagttcaggataaacaggtttcagcagcgcacaaaggttttttggcaaacagaaaacataaacaacttccttatgagctaggctggcagggagcagcttccccggacctgggctatcgtgagctcacattcttcctccacccactgaagattgctccctgttggttttgctgggtaaacgcaaatcccattatcagccttctcctccccggctgctgctggagcccccggtacagagttacctgcttagcaagctcctgataagtccttggaggccccatctcgtgagactttggggcgaatcttccctccccttctcattttacacttgttgcaaggtgagggttagagataccggctggggtgttattctttcctattactggtttcccagataagataggcaaaccttcaggacttagaagcactcgatctcaaggctccgtggagaagagaagccacccagtgcccctttatctatatcccctgaccccaagtgtggtcagcatgggctattacaggattcaaaatacaggaatcagagccatcagctctgccaagtgcactagcactaagatgaggaaacacgagagagcattaggacttgggtggctgtggatagtggcagctgatccaccaccaggttctaggaagcagaaagggggctgtgtgtgggttgacgctgttctgttttccctgacagctcttcaacctgtagctccctgagcaggctgttctggtctcaacttgagcacataaactgggatggagccacagccaagaactttattaatttaagggagttcttctcttttctgctccctgcattgagaaaaggtgcgttatttgagagcttactatgctccaggcagctatatgtatgtaagcatgtcagtgtctgtctgcatgtgcgtgtgtataatctcatttaaaccttatgattactataaatattaagtatcctatttcttgagaaaactgagttttagatattaagccatttgcccagcacacatggctagtgggtggcagagatgggcttgaaccttattctgtcaagccctgaagaccttgttctttctcctgtgccatgctgccccctccccacaaagggtcatagaaccgacacagaagccatgtctttataagccagattgtccgtgaactgcattccaaacccttgaatgcttttcttgggactttctcatcaatgcgccctatgaatgcctcttttcctcaaaaatacacagaaacactccaaaagaatcaaccttaatgctctttcctacacaactagaaccttccagaggttgcatttgtactgatttgccttgctgctccaatttttttatttcgatttagggtctactatctccaggtctgctcccctcagctgatggcccatgctccaaaattgtccttccttcctcctccccagcagtcaatgccaatgcttgcatttcctctgtgcgattaggaggaaagtactccattaagccaaactgtacttaacttcctgagatattatctttttcaaccgacaggcattgtagcctgtcagcctaaaaggatgaatttctaatcacacaattctctatttttcacttaaatgttcaaaagtcctgtaagaataaaggattttacaaaggaaaaaaaatgaccatttttttactaacctaccaaaaaatttccagttttcctttttcattttttatcatatatgtatgtcattttcatgtttttccaattatggcatagactcaatgttgtattcttttttttttttcacataatttccccatatgagatatcagttgtttgtctgaaagaaaggctactgaggttgcagcagaaatttattgtcccataaggccttcccatgaactgtctacctgagattttgagggtgcccttttaccaaatagtaagaagaaagtctttctctttgacaccttttttttttttcaggtgactttgtggctgtaatcctaacacacacacacacacacacacacacacacacacacacacacagatatcaaattgagattttgtgattattattttctcttatatattagtaatttttaggattttcaaaagagttcacaaagagacattcatttaatgaatgccagacgtgcctggcaatctggtgggcatgttacagcaagttgttgtatttgaatcgtagaacaaccccgtggaaaggtactattaccctcacaggtgaggaaatcaaggctcccaaggatgaagttccctgcccaactgacaagcgacaggacaagattcaaagctggatctgactccagagctctttttaatttgtcaccgggctttctctccttagaaaaaccttcactctaaagggttagtctacatgtcatttccaaggcacaccagagaaaatgtaacaaagagaaggaaatagagaaggttttatggtcaagtgacgcccctgtatattacaggcacacagagatacgaaacaaatgtaaatttattcaaatattatgagagaggcggttgtagtgatacatgttatacaggagacctattactcataattgattttactaatattttagcatctgacctgtttctcttaattgaattgaaatgacttatgcaacacatttgttttactgactttggaaagatataatcaccttcacctacactttaaatagaattaaaaaaaaaaattcctgaacagtggccttaaagataagtaaaaaaaaaaatacagtttccttctctaggaaatgcctagaaaattgcagttattttgttttaaggaggaaaaaaaagaaaaggcattttgcacaatgatcagtgaggtcaccctgaacgaaaataaaatatgtccattaaacccttcccaagaatcacagattgagtcactcaggagagtactaggagactgctctgccctttttaacttagtcaaaattagtaaatccaaagcccttaaaatataaactaatttcatgtttgcagaaaatactttacccctggggacagagtaaaacagagagagagaaaaaaaaaaaaaaaaaacagagagagagagagagagattcttctaggtacagaggtgtctcggatttcagcttccgtatgacagcaggcttgttctaccaaactgcagagaatgccagtctgctgggtttgctaatgcctggtctagcaatatactaagaatgacaattcaggaacataccagggaattgttcgctaaaggaggtaaaaattatgactctaacctcaggcttcaactgggcatacatccactagtttctgcccggggttagttgaggcttggaggaacatgccaaaaagaggggaggttcatttttatttttcaagttggcaggtcttgtcttgggaaggaaacagaattggtataccagctttaatggattataagatgactgggcattggacaagggcacaggggaaaaaaggcaagcaaaaagaaaaaaattatttttgagaacttgcaaaaaatcagtcttgctggccagtcctggccctaggttgacatctgttgtatgttagtttccaatgtgtctgtttcttaatacatgatctcagaacttcagtgatagcatccaaggaaaaattagaaaatgagcttgaggaaacatttctctgggttccttctccctgtgcccaacagggaaagagccgatagaagccctgcctagtctaacttgaggccacccattggctggtaggactaggatgaaacatcagcacctttaatgtggggttgaaaaacggaatgccaggaagttaaaaggacttaggggaaaatgtcctttggccttccgctgcgtgacaggattctgaagtggcagctagtgagcagagtagactcagttagtccagtcagaggaaaaaagcagcaaaaccagaggaccaacatcagtaatatctttgagtgcagtgatgaaagagtgaggatggctctgccagaaaggcgggtctctccatcaggtttcccaaagcagcttgtgtctatggccagctgtcagaggaaaggagccctgcctattggctggtatttattgagcacctactaggtgctaagagttctctagactcctcgtgcaaagaagactccacccttttttttttttttttttttttttttttttgcaaaactcaagattgtttgaggtaaagatacatgttgattttgctttctaccaagacaaagaaaatgcagaatagaattattaaaaagatgcattttcatatcactagaaaactcgtagtacataaacacagaagactttgaggaaggttaaagctatggcaaatcgaatccctttttcattctactcatgtcctattctggggctgattcagtgctggaaacatggtaggatatgaaatgaacaaccaagggttagagacagaagatattgaaacaagggtctagccactcctgctatggagattcccttggagatcttctgaggtctgagagattgaacccattcaagaggaaagaattttccattccccactgtctatgtaataatacccagcctggcagagtgaagataattgagcggcaatagaaattttatttacctccaaatgcaaattccctttaacttgtccctacttagaatacgttctttctccctttgtttgaaattaggaaagaccactggcccatacactttaggtgacatgacttcttagctttatctactacgaactttttattatcttctgatttttctaccttgcacaaaccaaaacactctcagtcctgaggagttatcgacaatgatctgcatgaaaacagaatcattttctaaagtctctatattttatctccacaatgcaatttatccacatggcacttgaatgaaattcaaagtttgtatttggatggtcgccctggattggacacagtcctaaagagcctctctgatccttttggtttttggggttttttttccttctctctctctctctctgatctcagtgttattgctcaattgtgctgtttctatcactgcctacttagtaacagcaatggggaacaagccttaaaagtgatcacctatcatatatacctatatatttttcttctgctggtctcataaaaaactaccagtcatttatttcatctcacttattgtcgatcagtcccgcatttttcacctccttaccgtgattttctttgtgctgtggttcccagccacagcccgcttcctgctgaattaaactgcaacccagacaaaaccaaagagcacgtctctcccaaagttcactcagaaggtcacccctggtgagatggacattgcagatgtgctagaaagatgagaggctgctttgatgaaacctgcgtctgttctttgctcctggtcctcagagtggaagatcggatggattgccattgccttgcattatttaagacttttgatgagcacctcccatcaaaattccccacagaccctggactgtgtgtgtgtagtgtgtgtgtgtgtgtgtgtgtgtgacttacacgacactttagaatgattgagatgttcaaaaggacattgccacgtgagctctttgcagggctcacattccattaggttgcccttccttaaggtctcttggtggcccttctgttctatttgatggcaatttctgttcattccagattgtattaaatctctttagcagcttcaaacggctctctcgagctgcaattttagcatgtgggtgctgatcacatcagtccctggacttttgttattttttcacgcctttgatggttttcctccctgcttctgttttcattggctcctactttcatctccactgtctgttctgcaatggtgttatctattcattcgacagagtccagccattcagccttctgaagaagaggccattccctcacttctctgtccccactttcccagtgggtagtccatgatttgtgcttttcatcaggcaaccgtggagacccctctttgggcaaccactttggtgataggatgaggattcgtgtatcatgatttcatttttatcaacctcttctgtgtcttcccattttgggttgagatgcggcggcttctgttatggcaggtatttttataaatggctttgtctgtgatcattgcaaatgatgaaaggtaggccacctcatttccatcttatggactttccacagatatatatttattgtctcttcctagagtgtgacaaatgatcagaacattgagcaggtatgagatgttgagggttttatttctgggtctgtcattccctatacctgagacttttaaaagtcatttaaccctaaggctgccacatttttgtttcctctaaaatccctgccattaatgttccatgttattttgcctaattaagtatttcacgttttaattcaaaagccctagtacctaatcatggttcttttctaaatgaattcagtatttcataccaagcaaatggtgttaagagcaaaggtctgtggagcagagatgccaaatgataatcccttaaatgtggaaaggaggtcagttttagacttaatcataggaacccttcctttctgctattggtaagcaaatatgaatcagcctgcctagacctcctgaccatgtgaatggatgaaatattaaaatgtacaaggaagacttaatgaaattaatgaaatacagggccataaaaatgaagagacataactgcaagtatattcttaacttctaaggccaatgtcatgatagacacgggggccctttgtaaactgtgtgtgtttctcggtcacacagaaaggaccagagactgtaaaacccccatcagatgaccaggcttggtatatgctcaacatcatatgatccggtttactgtagattgttataaggcctgatttattaaaatgtgtttggtgatttattggtgacatgttgttgaagagccatgtaaattatctctcgtggcaggaatgattagataatataaaaagtgtatgaacagaaagaaagatagaagtggtgacaaaaaatcttctgaagaagaaataaaaaacagcctcctgtttccttttcaaagtcctaccatggaaaactttccttacacttgccaacctgtgtttctcaaaatataaactcttcaggaacaggaaatcagttttcaatacttagcatcttgcaacatgtagtgagcactagagtgggagtcagaaacccccgttcaagtcccagctctaccatcagcggtgtgatctgctgaaccagaggcctctttgagcttcacttaccctatctgtgagtggggatgattcctgcctgctggatttttggtcgtttttaagtgtcaaacttagcctttcagctgcattctcattaacaacaacataatgataataacaataaaatgtaaaagcaatttggaggtggccacggtgactttaatacaaaaagtattattctgcatccaggacaatatgtggagtgaaagagacagaacacccaaaagcatctgagctccgcgtccatgtctaggacattctcagcaatcacttccctttcctccgtctatgcaggagccgagaaaatttatctcaggaccctcagctcctgccattgtagagtctgtacgatgtggatctagcctggcaggtggagaggcagcagtttccatgcctcttacaaattaactagttttcacggacgttttgcagctgccttggaaacaggctagcagttttgaaaaagaatcgttgcagccaagaaaaaggtatcggtatcatgtgtgtgcatggataaagcatacttttagaaacctgtcacttcacctgcactgaatggaaacaacgccaagttgtgtctatggctttcttctttttttcccattgaacttgctttaactgctaatctttctttctccagaattctggcaggttaaacattattatataaatagcaattgcaacaaataccttcacagaatgatgtataaataaacttgagccctgaacactcatcactccagtaaatatttacaaaaacattctagctttaaatagggggaaagggttgtgtttgaagagtttttactttattgatatttggctaatattagagttaaataaaatgcctgtgtataatgcaggtagcttcctatggaacacgctttatttttccagtatgcttcagaacacagcttactgaaacaagaacacctaagtccttgagtgtaaggtcttaaatagttagggttattattttaggtatgtataccatgtcacattcaaggcattatcagaaaatgaggtacatcataaaaaattaattttctgcagcgtatttctataagtgcctaaactaaatcactttatagggggaaggggagctttcaaaatatattatgtaagtccctgtcttcttagagttcatgggttaatacgtccttagtgattcaaagtcattataaccattaattattatggtgtgtacagtatgctgtaatacaggatgcactcagaaactcggcaggtgtggttggctctttgcccctatgctaaatggctccatgctgccatactttttgagttcttaggtctaactttttatcattttttaaatctcttccttcaatatttattgtctctctttgcgcctatgagcacaagtctctgttgtgcttccaaaatatctccggtatactggaagttcagacatcaaggttgtcagaattatgtcttacataagagaaaaaagcctcggagtaaatatcaaagggatgctttttaaagcacatatacaaacttttggttcttggagttttagtggtatctctgctgatctttgtttctttcttttcttttttcttttctgttttttcggcttctgtcttccatttatttcacaaggctttcatgtgagagatgtctgattgaaaagtattatagcaattgtttatacttctgagatagcagttctaatttagtatttctttagataaccacttgccttactggaaactgcttaccttctactagtgttagttacaatttttggtgcatagtcaagaataggactttttccttttaactatctttttcaaacatttcacgtagtgcctcacccaaagtctgctccgagaaaatatatgatgattaactgagatttaaaaataattatcacacacaagctacatacaaatgaaactttctacaaagtatactggtctttcatgttctagaaaatgcttctgtgcttttcacatcttggtttaaaaaaaacaacaacaagaaagaccaagttgagcataaatgataaaaataatttgtaaaggagctgaaaatagaactcttcgtagataccaattccaagtacattgcagctttcctatgggattattttgttgctggaagaatttgtagctcctaattaggagccctttaattcattcattcgttccaacaatagcatttactgaatgcttgctgggccccaccagggatacacaggcatatcagacacaatctcaggaaacagacattttggccagaatttgaaggttgctgtgagtcagagcccagctgccatatgttagaagcattcctccagttaaaactgaaagctttaaagtgaagcttaacttgttttttcaagctagccttgattcaattagaacgatcccaaatatttcgtgttctgggaagaaatctggagaagtggtgtcataatgttttcctgttcgctgacaagtcattcagtagccctgtccaagatcatttaaaatagcctgggaataatcagaagtgatgtgcctctgcggaaaacacttggaggatgtctgtcggcaaatgatgttttaaaccctaggtttgatttagaactgttgtcaggttcctaatgacgatttatatgtttaaaaaacgtcatctccagaaaagttaatataaatgtaagttaggaaacaatgaaagtttcatataatataatcattatttactctgtggttttacttatctgttttgctttgtaatcaaatatacaaacttaccttctctccctccctgctattagcttgctttgtcagtgagtcatcatgttttgcctctattaaagaccaataatcttaaatcgtatcattaatcatatctgatcatcgtaattttgtaagaaaaccatctgtataaattttgagtgaagtaaccttatgcattgtttacgtagtttcttttccactatagtttaacatttagattatgttgttagccttagttgtatgcgggaagattgacataattttattaaaattattggtttttattgccttgaaatcctaagggatacaataggttttggtaagaaagcatttcagacagaatcataataagcttcttaactaaatgtccttgtttgtctaggagtgtttgaaagaaaaaaaaatcttgtttccagagagtacaaactctaactacattacgaagaattgcttttaaacattcaggaattttttttttgaaatggagtagacaaattatcagttttcatggtgacatgtacatagtatatcgtgtgtagaacctttgactctgaagaacatagctaggttgacagaataacaaaagatccacttctaaagtgaaaaattatcttaattatttgggagctctgagtatataatgccaaatacatggagagttagcactatctgtatgtccaaataaactccctgttcacactgtttgttagtatattttatattgctcatacagttataaatgtctagtggtaggtcataaaccactccaatccagtgattattgggtatcaacagtgtgccagatactaatgggtttcatgtttattgcctgacttttaagatcttaaaaacatctctaaagataggtgttagtttttcagttgtacaggagaggaaattgaagctcaaagaatataagtaacttgtcaccaatcacaaagccactgttggaactagaatggaaaaccagattttccaactccaattccagtgctttttcttccatacatgctactttcaaagaagtattcactgattcaacaaatatttactcaacatctatgtatgccaggcactatggtaagccttaatgatataaggaatacaatggcgagtaagacaggtatgtttcctgactctagtgtggagagtctaaagaagaaggcagaaaagataataaatgatttgaaaagagagtgacgaatcaggtttacaaaaagagaagaacaagatgtctatagggcagtgacatttaaacttagaccatagaatggcaaaaaaagcagataaacaaggtcagtccattcgcattactggaggattttgtgtttacaaatttgcatactcactaaaatttatttataaccccaaaatcaacactgggtatgcggtcattggcagacaagtatgtgcacacagcgtcctagaacaggttccccactgaggtccattgaggtgatgttctgccctcttgtttcagctgtcatattataaacaggtgtcctttttaaagtctattcaatgccatatttttctaatgttcgtgctttttttttttttttttttttgagacagagtctcgctctgtcacccaggctggagtgcagtggtgcgatctcggctctctgcaacctacgcctcccagggtcaagcgattctcctgcctcagcctcctgcgtagattacaggcacgcaccaccatgcccggctaatttcttttgtattttcagtagagacggggtttcaccatgttggccaggctggtctcaaactcccgacctcaggtgatccacccacctcagcctcccaaagtgctgggattacaggcgtgagccaccatgccccgccctgtttgtgctttttgttgataagtctcactgtttaaaatgatccccaagcacagtgcttgctgaagtgctgtctagtgttcaagcgcgagaagattgtgatatgtcttaatggagaaaatacaatgtgttacataagctgtctctagccatgagttatactgctgttggctgccagtgcaatgttattgaatcaacaatacatactaaataagatgtctttaaacagaaacacacataaaacaaagttaggtattgatcagttgacaaaaaagttatgagcacagactcacagaaacttaaccctctatttcctctaggacgaataattttgtcttttaaaattcagtgttcctgggaactttatagaacttaactactttgaagaactaaaatcagcaatgaatggataaatactcaacaacaccatgtgctggagaggatatggagcaactggaactctcatacattgctgataggaatgcaaaatggcacagctactctggaaaccatcaagcatttcttataattaaatgtatatatccatcccatatgatctaacagtcccattcctaggtatttaccaatataaatgtaaatttaggttcacaccacagcctgtaccatgaatatttataccagctttatttttgattgccataaaatggaaacaacccaactgtccttcaattgaggaatgaataaacaaactgtggaatggaatattactcaacaataaaacagagcaaattattgtactcaacaacacgggatgaatctcaaatgctttatgctaagtagaagaaaccagtcaacaggctgcataatatactattccactgaaataatattctttaaaggcaaagctgtagggacacaaaacatctctggttgccaggatttggggtggagggttggctataaaggggcacagaggaatattgggggagaggggaatagaactgttctgtgtcttttaatttaattgtggttaaacaattaaatgccttagtcacaactcaaagaactgtatcctaaaaagggtgagttttccaacatgtaaattatattttaataagattaaaaaactgagatctgaaagacgaatcaaagtgcaattcttctagtttgacacggtgacatcagaaaataccattaaaatagagagcactctatatgttttacagtagttctagttgataaaatactgttagtgtaaaataaccactatgtagtaatttatgttatactgcaaactgagcagcgatctctctgaacatataaaacatgttttcttttctcttgttttgttacgcctaaatctaacatggtgacaggaaacagtttcttactagttttttgacaagtgctgaaatctgcaaatcataatatgattccaatatatgcattattcataagaggacaaaacttttgtttgatttggattacccagtttaatggcagctgaccttgggataatataacaaacaagacaacagagcaaatatgataatatcacttatcttgcttgaatatgattatttaatgataggcaactgtcagaaacagacagttaactgttcgtgtccttggaagcagagagacttaccaaatgccctctttgagtgtcttgaactctgatatttcccttttttattcttccctgtttataatggctttgctacattacctctgttatatttcaaggagcaaagatgttgtaaatcaaatcaccgttacattctggtctatgaaagtcagtttcaccatataacatgtacctaacctttgaaataatgggcgagttgggctttccaagactattacgtacttaaggctttacaacaaattcaataatgcatatcagtagtttctcaataatgtatactgtagctaacacaaacaagtcactctttctcacttttattatattttgaaaattattttactaatattttacttaagatgtgttgtcaaaacatcccagggctatgtatgtactgtgttcttttataaataacaagactatgcataactacagtcacttaataaacgtagataacagtttactcaaagtacattgaaaataaatggctctgcttaagattattaagctatcaaagccatttgttgggtgattaaagtaggtgaacaaactgctatattatatatgttgcaaaaactgtgaaaagagcagcagtgaaacaatttggaaaagtaaaaacagtaaatatatcttgtgctttttctgtagaatatcatgaactatgaaatcattatttttttacctttttaacagatgtttttggtttggagtcttttaggaacgtcagctttgatttgtgtattttttagtttccttgtaatcctatctaacatccattaacaacatttagagttgtttgattattccgaaatacaaaataaacttccctcaagagttaatttggtatgtagcaagtgtttcttaaatgtacaaatggcaacattgttttccaacagaataattacaaccatgtacagtatgtttcctcattagtagtaattaaataatttactacattgtgcaataattcataatgacacatgctaaccttgctcaattatagaagccagtgataaaagaatttcttgcacacatgcctagatgttatgagggtagtacttcttgatttctggagaagtcagcttgctatttttgaaatactaagtaatgctgaattgaaggaaaaattaattcaatttttgagagttgcagcataatgtttaggagtgcacatgctagaatcagtgtacctggatttttttcttatggttccaccggttattggccctgtcctcctggacaagtcacttaatttctctgtgccccagtttcctcatctgtaaaatgaatgtaataaaagtacagaatgtttttccataaatgaaatgatttttaaaaagagcataaaatcaatgcttgccacacaggaagttccaaggaatagttaaccagtaggagaggtagtagcagcaacagtaacagtattatataatgattggaaacccattttgatttcacaaaattatttttgaggacacaaggctttactagatactaaaaatctaacaggaattttggaacttctgactggaatgcctaatttaatctacctccatcttacaaaatgtaggaagagattttaagagaagagtgattttttaaaatgtggatctaacatattgagaaaattttaacctttttattaaaacaaaaaatacccaaatctattcttgttttagcgctcacaacagacttccacagtgtaggactggacataaataatagatggacttctgagagcagagaatagacttctggtcagacactgtcagcccagatgaatcccatcctataagctggagcttaaatgtgagcatcaaaaccactattgacatgtggcacaactgtctgaaatgtcaatagttataaaatgagtatttcataatgcagaataattgattactttgcttgactgaacaggaacatattttccctgtgaaagcaaaataatgccagcatttgctcctggaacgctcctagctgcgagatttggatttcccaatgaagcccacgttactctgcagtccttgatcatgcatgacaaaaatagggaaaaccatctgtaaccgcttatcttttctccattatttgaaaatatatttttaagatagttctttaaaaaataaaatatggcctatatatgaagcatctatattaatagaactgtctcagataattttcagaactgaaatggatgagatacaaaatcaaataacattccatttatcttgttcatcctaaaatgctctgcttagcttttcactctgatgaaataacatccatttccagttttattcttccttggtgtgctgtgatgtggaactcttttgctctatgtgttttattaagtgtaatttaactttatgactatcaaaccaacgattaatccttacaataagactatgaaataggcaagctgcaaagagatttattttctgaagcacaattcccttcttctacctccaattattttttcaaaaatcattctctgaaagtgtatagtttgcagagctctgtcctgggcactgtgagggaaggcagaagaaatagctacaacctacattctgggctttctccccttcttatctgtgtgtattttatctctggtaaatgctcgttattagtttccttgagtgagaaatgcattttctgtctctgtacttttacaactgtgttcttttattttctttacttttttaagacagagtcttgctctgtcgcccaggctggagtgcagtgacacgatctcagctcactgcagcctccgcctcccggattcaagtgattctcctgcctcagcctcccaagtagctgagattacaggcacctgccaccacagctggctaatttttgtatttttagtagagatggggtttcgccatgttggccaggctggtctcaatctcctgacctcaggtgatctgcccaccttggcctcccaaagtgctgggattacaggcgtgagccacagcacccagcctgtacttttacaactgtgttctatcgtccttctaagaggctcttcatttttacttctatccaccaagatgtgatttggccttcaaggtctagctcaaatatccttcatgaagtcctccttctcttaaagtttcagatgaaccccgcacatagtaaccactcttattcttgacttacatggcactttatttctggaacacttcgagtatgtgccacacattctgccttacattataagcattgcgtttattttcctactagattgcaagctccttggaggatagactgataccttgatttttgtcctttcctctcgacatactagcacagtgtaatgcacacagaaggtgtttagtcattgctcattggatgagaactttctctcctataggaaataagacataaaaagcctgctagaccacagggcctcttaggccaatggacaatttaattcttatccatctttgtgtcctcaatacttagcaggtgcttaataaatacagttgatccctgaacaatgtagggtttaaaagtgctgacccccttgtagtaaaaaatctgcatataacttttgaatcccccataacttaactactaatagcctactgttgactagaagccttgccaataaaataggcaatcaattaacatatattttgtatgttatatgtattatatattgtattcttacaataaagtaacgtagaaaaaataaaatgttatgaagaaaatcataaggaagagaaattatgcttactattcattaagtggaagtggattgtcataaaggtcttcatccttattgtcttcacagtgagtaggctgaggaggaaaaaagggttagtcttactgtctcaggggtggcagaagcggaagaaaattctcacataagtgaacctacacatgtcaaatctgtgttgttcaagggtcaactatacttgttttatatacatgacacacacacacgagtttcaaaattgtagaacgctcagcaaaagtgcatgcggagaaacatttcaacaaattttgattaagggttaacattttatgtcaggcacaggtgctgtgtgtgtaacaatgtaagggctgatggggtggtgatggcagttccacttgtaagctctactgagagatatcactttttcctttctgtatactgtttaatcctcctagtggccctacaaggctctactctccttatttgacgtatggtgaaacaaaggtttgctcaagctcatacagctagtgagtgggatgtaggttggttttgagcccaacttcatctaatgccaaagcccattccaccataccatggagttcaagcaaacaaagaaggcttcttggagaagtaagcagatacggcacagcatagagaaagggaagaaagtgttcccgaaaagtggatggggaatgattctgaaagcagtcacaggatgttcgagtggtaggggcccgttgcagtcagttcctactccatcaggctacagttgaggggcctggtgtcctgaaaggtaaaatggcttgcccgatgtgatgtagaaagctaatgacaagtgtgaaactatcctggacccaggattccagattctgagttcacttgtatttcttgtgtttgcttacatatatatatatatatgttgtgtgtgtgtgtgtgtgtgtgtgtgtatctcctgtaccactgccaggtataggaatggggtgaggacacagcatggggacataaaggaatggaggtccctcttggccttggtttgcatttctccccttcctgccttgactggtgtgtgtgtagtgaggcacctgccacccacctattctgtggaggttgctcagctctgtatgcctgtgaactttacccttttccttattgtggtgattacaaaacataagccagtcctctgaatttcctaataggtgtatgaaatatatggttccagaaatcccagaagccctgcaccattgtctccatttagtcaaatctttcacctccaacatcccattacactaatagccacactaatgatttgcagtcatctatcaactgttagtgagtggcacagtgctgcgcaaacatcttttcaatgggcaaccagacatgttacacctttaggaatgtttggaccgactcacggaactctacagttttcagagcacaggtcagctgatttgtgaccttctcaaaatcagggctactgtcttattcttgtttgattatccatcacagtgtcagcataatacctactcagtaagtgtggctgattatgagaaatatgtgtatgtgtgtgtgggtgggtgtgagtgtgtaaaagtgtaggtgtctcttgccacccaaatgtagtctatttcacgatatttcatgaactatgcatatgtatacatacatgcatatttcaatctacatctatattcattttaaaatcatgaataaggcagataaaccacattaatccacttgtcccgtccccctttatactcataaacagcagagttccttgtcttactgttggcttctgggtctcaccagtgttactccatttgtaagtgttcctttatgagaaactggctccttctggactcatatttaagcaaggctgtgatctcttctaggttagtttgtgatgtgtccatagcttcccaagtatccttgctttagaactctctgggtctgaccctattgtgtttataggaaacttggtcccctggctctatgtcaaccagaatggctcaactcctaaaggtcacagtgcagtggtggctaaggattccattgaatcaagctgcctaggaccacattaacctttcactgatccctttcttgttcagctataacaaaattaattgaattagcaagcagacgcacactggagagagagacgcagggcctgggtgagacaaaaccaaaatgctgtgcctcacatgcatcagcaaactttgaaatcacctttgtcctaggagccacttgcagattcgggataagtttgccagtccactggtttgtcattctccccaatagcattatatctgtgatttggggtggcaaattatgagatcagaacttgtgtggtgaaaaacaaaatatacgctcataaagtcaagtatcatttatttaaactgtaacataggaagactggcaccaatttactagtgatactaccgtctagactcctgcaaaaatgcacccatcttttcccctaggtgtttttgggaacaacttggcattagaagtgtctctctactttcttactgtgtggcagactcagtgtggaacccagcacacaggaacaccacgtggggctgtgaccatcctgggagactctgagatgagttacatgtgtttataagtatgttgtgtgccttctttttctgagattagtcaacagaaacctttgagctgcaaattaatatataacaaactcccattcctggtaaagaagtcccattctgtttaattatcttcatgtaagcaatattactttacttttttttttttttcagaacacttggtaaaaagaaaaagaaagaatatgttccttagcactgtgttctccctcagtcggtactcataagcatttatttaataaaatccaaacgattattcctacatatttattgcattttaatattttattgtatttctacttgattgtatttttttttttccttgagacagattattgctctgtcgcccaggctggagtgcagtggtgtgatctcagctcactgcaacctcaacttcctgggttcaagtaattcttatgcctcagcctcgcgagtagtagctgggattacaggcaagcaccaccacgcctggctaatttttgtatttttgtagagatggggtttcaccatgttgcccaggttggtcttgaactcctgacctcaagtgatccacccgccttgacctctcaaagtgctgggattacaggcatgagccaccatgcccggcttttacatgattgtattttaatatacagtgggtaaaagtttgtgctaaaatgtatcatttatggctccaatttggtattattgaagggagatgtcccttcaatatgggagatgttcccttttactcctgactgatttgtttggttggggccttataatgtcatagaaaatgtgcattttgagtggttaaaaaaaaaaacagcctatagtttttactctcaaagagctttgtgttaatataaagaacagtaatataacctgggttaaaagctgaagacatttaatagaggcatgtattacaaatagcatctagctacattggaaggttaggacttcatatctgaaattctgttgctcattagttgtaggaagtgaatgaagtacatctccaaagggcaaggtcagtattacattattctggaaatgtctttgttgaataaatgtgtaaatatttcagataagtacttgagattatatttctattggggacatatctatagaatgaatgattctacttataactgcaggagcagatgtcatgttacatgttgttcccaatgactgatttcatttgaaatgatctggaaataaatactgattactagtgatgtcagattattcaccttggagtcagatgtctcacaaggcacgctagagctaatagatttggttcttttgaaaacattgttttctaaagcaggatactgttttaaagtagcattgtgaatcatccgagttgtatatctgggttcacttgcattgagtagggaagaacatacttccgaggatgcagtctccgatggttttccatcctttaacgatacaaaagaaagaaaattgtacctgggacctgcttataggatagcttggcattagtcgttagcacaagggaaatcaataaccaaatgtgaatgatggtgtcagtgtaactgaggggcgttgcctcattgggagatatagttgcatcataggaacgtggtgtgatttaatttcataattgtaaacattacagtgggtatggctgattcatttgaaactcttgtccactttgctatggctggacagctgagttaacatgggtaggtcttgggttcacatttttataatttcttttctttgtagttttttttgggggaaaaatctttaagaaaaaaagctgtattagaatgaatttatctgaaatcaaacttttataaagccatggcttgactgaaggacaacgaactttattgaccttctaaatcagagcgctgtataaatgtttggaagactcaattttgccttgaaagggggctggggagggagtgtatgaatccttgttttctacggtgctgattatttgcttgtgttttaaattgtggcccaactcaggggcaagagcaactcacttacatggagaaaaaaatatgctagaattatccttgcttaatcatcatgaatgcaacagctaatagccatctgatattttaagttgtgcgtggcaacagaccaacagaaaagcaagcagaatgaaatttcgtgaaggaaccgcaataggtacgcaaacttggcttttcagaatttttttctgttatgctcggtactatagacaccctgaccaaagttttaaacaatgcagactctgggtatgtagcatctgaaattcattgtaaagagattgacctgtaaaataataacgtcatgatttacagttccgtaaggacagtaagaagaattaagcttcaaagtttagagggaattaagtcttagtcgcatgttaaaatgtacaaagttcaccttcagaggtctttattttctgtcagaattaccacagtgtttcatttttagggtatgaaaacgatagcttttcctacttgtagatgggttctctggagagatatggaagagcctgggaatttagcggctcaaatcagctggcaactggagttcatttaggtgattcacatacaatttccggctttccttgcaggtatcagtggtcttggacgcggggaagggggttgggggggacaggtgtagaccaggaccttggttattggtataactgccaatatccaagggttgccaagggttgggtgggcggagttcccccgcccaggccgagtctctccagaaagacttcggaggagcttactccactccccggacggtcccagtggcttcgttctccacggcccagaagtgggccgtaccttccgattagagctggggcactctaggaaatgcgggtgaccgtagctccccagaccaaacctgtcttttccaccaacgagctggcgcatttatcgcccccgagtgctccggcaagccagcgggagagtggcgtcgggttgcgagcctcttgccccaccgagtgggggcagaaagtggtcagaggcgcgttccgcggggcgctgcgtgcagaaaagcgaccggcggccacaggtgatcccgaaggcgaggggaagggcgggcgcccgggcgagggcccggggcgcgggagggcaggcccggccggggtgggccagcagagccgccgctgctactcacctgcccgcggnnnnnnnnnnnnnnnnnnnncggcgctggggcgcgcctgcctcccgcctcccgccctcccgcctcccgccccgggaggaagcggaggggcgcggtgtaaacagagcggcggccgtgatgtcagccggtcacatggagcctcttatggctcgggatggctctcggcgggcgggcagctgcggcagctgctgctgtggctcgggcggcggcggcgcggcggcggcagagggggctccggggtcggaccatccgctctccctgcgctctccgcaccgcggcttaaatgatgtattttgtgatcgcagcgatgaaaggtgagcccgggcgccccgccggggccgggtgggctggcggctccggggggcggggaggagggcgcgcagggggaggggtgggcgcgcctgcccgaacgcacgtactgcccggggctcggcgcgggggccctgccagggccttctgggccaccgccgcggcgccacctgagcccggccacgggatcggcctgcctccgattggggggcaaaggcgcacggggtggatccccctctgctgccccctccggctcctgtcagtctcttgggtccgcttggcaccgggcgggtctcccaaaagaaagtttgccgggagtcgccgcgcttcggaaaggaaggggagggtctgcggagttcagaggaagccggggacgcccgcggccggtccccagggcccgcacccgggacagctccggcctaggtcggggaggcgccgcggccgggcagggccgtgcgtgcgcgttgtcgcgatgtcatccccggggactggtcagcgccccaggccttgcgccctgcccctgcgtccccgagcgcctcagcggccgccggccgggcaagtgccgcaggtccgcgctgtgtcccgcgctgtgtcccgccgcggccacttccgaaagcgcgcgggccggagcgagacgggcgcctcgagcgtgccaagacgctctgggcggcccagggagccgcggcgcaccccgcttgacactttggctggtggatggaggtggggaggaactcggcagcccacgggatccgcgggcaggggcggaggttagaccgtggtgagggccgacgggcgcgggttagtcgcggccaatcctgccgggcggcccggccttccgccctcatcaggactccgtagccgggccgggggcgggaggggagggggatttggttggagggaggactggctctaggtcctctcaggtgagaaggagagaaaccgtggcaagtcagggaactttctgatgggaaagctaaagtttggaggtgttcaggaagtcgcccgtgctgccggagaaaccgagactcgctcttgggacggttgcaaacagctccggagaaactcagcccgcagcacgccgcccgccgcccgccgcccgcttgtgcgcccgcaggttcctcgccgtggataatctgcccgagctgcttcgcaggcccggccgccaggcttggggatttagagccccatctgtttgcggcggacgcggcttccctaatgcgcagcaattgtgcagacccagactgtcctgcgggtcctagccaccggtgcgggtgccaagcgcctgttaaacgtttgctagtttggggttgtgttgcaatctggaatgaaggacaccagttcggtatctgcgctgggtttactttcggatcaccgagctttgcctttcttcactagagattgggtggcatctcttttattaattattaacaggccgaaacgtactggacgttaagatgagctgcttgagatgaaatctttctatataatgtgcccacagcaaattttctcttttcccctgtggcttgaggggaatgggatttaatcatttttagaatatgtaattcatataagtaaaagagaggaaacctcccgtgatccgcgctcttaagcacttaaaattatttgggaggaaaaattattaagatttcttatcgacttcttatgttaaaaaatctattctcccccacccccccaaaaaacttttatgctagtcctgcatttcattagccctgtaagtgtgaaacgtcttaaatgccctctgcagttaaagcattttttgtctttaaattataaaattgattttgctatttggaagatgtcaatgccagtctttatccactttgtctaatatactttgtgttgattggaggaaaggcgagaggctgagacattttaaactgctttctcccctaatgaacagtaacgacccaccaaaaaaaaggaaagtacgttttaatattttgatttaaagttgatgtttcctagtacataggcttttgcttttgtaattctacaaagtgaagttccatactgtcccttgctaatagaataataagaatcacacacgctacccccacacttggagtgacctctgtctgccataaaataatagtttcatagtattgtgctttgaaaaaagtgcctcagaagtactggcaatgcaatttttctataaactcagctgcctgagagagagagagagagagagagagagatagaggaagagggagagagaatgcatctgaacaattagaatatttcactcccaatatcataatatcctgaattttaatgggattatcttgctttggtgcaaacttaagctgaaagagaaaatagtttgtggggaagtgaggaatgctgtaaatgtttccatatcagatttagaggaaaaaactggcttagaatcttattaaatacttccctattgcttctcagttttaatagttaaattggttccatgtgtaagacagtttgtataactagatttttcgtgcaaaacagaaatactgtttacaatatagctttttggtatgtggatgcatgtggacaagggaggagagaacaagccaccataaaagaaagattctctttgttggctgatttactgatgttttttaaacatcagtaaatcaggccctttgaactcaccaaagaagaaaatccttcctctgcattagttgtcaaataagtttaggcttagtttcatgctcaaatgtaataaatcttcatttgagtaactctagtctcatccttcaattttgcttttgtttaattaacaacaaaattccaataccatttggattgcttcttgggcaaagggagagagccagctataacatttataatcgggggagcacttgttctgctcatcataaaagtgcattggccagatgtcacgcggcagcggagtactgaaaggaaatgtaagacgttcatcagtttcagtagatgatatacccctttgcttcatatgagtgctcagcctgtgtttgtgcaaatggagttataagagcacagggaggcttaaagggaatttctggcccgtagattcttcgtccggcctgattcatgtgcaaatgcaagactcctcaccactttgaaaatactgtatgtgttggtagtatgtccaactgtaataaatacgattctgtagttttgaagaacttggcctttctttctacgaaatgaaattagaattcgatctctgatctcactgtaaggacccattgcctggtatcccttcactgggatttttgtaccatttttgttacttgtgatgggaaggattgggagaaggtgatggctggatcttgaaaagagaaaacccaaatggttgccactactgagcagaatgcttatctggcaagaagggatcagttcttttaaagacaaagaggatttctgaatccatttgtccatgggaggagggagaagcctggaccctccatgaagtagagagtattttaaaagcaccattttcatgggcagcctcttgattttatatatttcaatcacgttacttgagatacaaagcagcagcatgcacaagtaaacccttttgcccacgatttgaattgagaaccatataatttatttaatgctgcccagtcatgaaataatgtaatttctaaacagaaatagtcatttagaaatatacagtatgtcatctaaaccttagctctttaatatgtagtagatacacttgtaaatatattaataattctcattagtctcctttttctcctatctttccctcccactcaagtgagacacaataaaagtggatgagatcagcaaggtgataattgcaaagcacctacaatagcacccaaccactttcttatttgctctggggtatctaggaaaataatatttataaatggccacttactggagaaaagttactggatggatggatggatggatggatggatggatggatggatggatgaatagatttgcagaggtagatgtagggttcagttttcttaaaaatctcttaaattattatagggatcaacaaaaccccttatgtggaacaaatttcctaagaatactctgtcatggaaatgttttctgcattcatttttactatttacagcacttattagtaagaaatcaaggctgcctttatgtatttcatatttaataattttaaagccataattagacactcagagtcagcagctacaccacttttatgtttctctacttaaaaaacagtttttttggagccatccaccagtgacaagtcaggtgtgaattgacatttgatagtatctcaaagaccacatacagaccctctgaggaatgatttacaagttctgtctcccccatctagctattctactgaagataactcccttccatcccaaccttttgattcatgaactgagagagtcgtagtcagagctttttctatccgtcagtattttgtgtgacatgatagaacatgatttttctgttaattgtcaagagataggaggtctaaatagatggataatagcatatactatccaatgggcaaaatgcaaggaagcagctgaaatcttttgtttctggattttctttttggaatgaaatttgttagccctcatcatattttcaggagataatacgataactttaaaaatctttgctcctgtgggtataaaaaataatgtcaagattattccctaggttttccagttatttcattttttaaaatgttactgcttctgaagtttactaggcatttcataaacaaatagggagatgatgctaatctatatttattttgtgctttatggtttacaaacactcttacatcatttaatcctccatagagagtcactgatagtcccatcagtgactgatgaagaaactgaggctcacagaggttgcgttatagcctagcttttccatctgataacgtgaaacaagaactacaaccctaatttctatcttcatgcctcccctggaggaagctgtgaaaaacgtcctggatataactttgtctctagttagtggaaattataactctggcatttatatgggaaaaaaatagatccaattatgtaatgctttgctgagcctaatatctttaaattactatttaataaaatcagtttggtacaaatggggttattcttatttgcttatcattagctctcttcaaccatgattttcattaagtctgcttgttttaagaggatatgagtgaaatataagcattattttccccaagaatacagaataccatgaagtacagctaacctgtgtaaccaatcgccattatgatagaattgagagatatatctatatgttccacttatccttaggcaaagggaacattcacaaatgcatcttctaattttaatatgactttgtgtagtataaagcttacgaattctcgtgcttgtgagtgctgtcgtgtttgttttcatgacagcttaggggcatgattgtagatctattcttgagaaatcgtttgtcttttagaaaatcacgtgaagtctaaaagttttcaagtagatctgaaaaatctcatttctcacttagtggggaatggccttaatgactgctggattaaggtgtgtttgtctgaaagcaaataaggattatttcagtctcagacgaaacctttaaagtcactcagatgaatgtctcactgggatttggaccctgcccacaatatttctgccaagtagttatctggttatgctggaacacctccaacgatggggaactcactatctttaaaggtaggttactccatcttgaattagaaaagtctttttatatcaagcataactctctcctttgtacttttaatcccttaattctgatcctttcctttggggctgtgcagaacacatttaatccatctttcaaatgaaagactgtaagtcatttgaagactagtactgtaacacacacatgcacacgcacacacacacacacacccctctaatacgtaatatctgctgtccctctccagtcctttttgctgtaagtgtggttctgccttcccacaatcttggtcagtttcttcctcaaacacacttcagtttgcctagaaccacttgaaattttaatgccaaagatggaccccaagtgccagttgtgatataattgacttggcacttaacccagcacatagtaaagaggcagccatgacttaaagatgaaaaacttttgttttaaaattttaaagataacatcagctagctgtatctctagcacctctcaccaccagtctttgtgatatcattgtttgtgaaagtggacttttgaactgtttaggaatacttttagttccatttgaagttgattattaagtatccaggaaaatcaaagatactacaaaaataattaaaggaacattagaagcatttcaggtatttttctgccgcatgtcagatatgagataaggctgccctctagtggttacttgcacatggacggctaaacccataatggtgccagtgaatttcccatcaggctagtgggaaggtcaaaggttgtagttattttcttaattggaatgagacatttctattccagattcaaaagtttaactcgttgtttttcatggttatcagaaatgtaactgtggaagggatactgaattttaaaagtttgcttggcaggaagtaaaggaaaaaaaatttttaacttaaagctgatttatttgctgtttggctcaatattaaatttaagtgaaatttggtttgtgagtcaacaattgttatgacatttttagtaatcctcgtatttttttaagtttcaaactccattctaattcccaacccttgaatatcttttaaaaagaggtcgtcatttgatgagctaaattcagcgtttcccctttttaaatctagagcttttctttttcaaaaatgataaacatttagtaaaaaagtaaactacagtagcttttggggggtaataaaacaattttaaacatggatgaaaaaaactattaaccccttggtttctgaagatttatggttagatcatttggttcacttaagtatatacagtttgcctaaaaaataagatagaggatatgtcagaaactctgcatgaggtagcgacaagcattcatttgcatattttttaggataaatagataatacaagtggattgtggatttggattttggtgttataacaagtgtgaaacaatggtaaaacaatctgatttctgtgtcggaatctgaggaatgaatatagatcttcctatttgcttaaatgttatttgttcctggtgctacacagaggtataagaatgcacgtttatatgaattttgcattgctgaagaagtcaaagctgatctgagctagaataaccagggtaataataatgacaaataatcaccaggcttgtaaaggataatagtgcttacgtgttcctattagaaagatgaaattgcagcgtttcatgaaaaagaagaaaaaaaataaaaagcaaggaaaaactgctgtttaaacctttctatcatagaaataaggcagtggttcagaagtgaagacttgtggttaagtttcagatcagttattgaagccaaccgttttacaaactgcgccacccagaagtgtgattttttttcaccacatgagaagtattctctttttcacagaatgttattttcatttttcggttgttggaaaggttttttttctccttctttttatttgttcatctcacttcaaatcttctgtagaacagtgggtgaaaataagtaaataaatttgtttcagcaaatacttaagtgcctattgtgtgctaggtaattcaggtaccacctttgtgcttttataataggagctgagacaccttcctcccaatcaagtgtcttaagccatgaatcagcatttaaaaaatgcactgagaagttggcagccacacttagtcagagaaggctgctttatggctgttggacttacacatttgcatttgctataagctacatgccatttaaaacaaaggagatttctgtgacatgccaaacaatgcaatgaaatgttaatgtaactggataaagtcaaaccctatacttatggatgaacatgatttgcttccacataagccataagttagctctaaaatcctgcctgaaacagtggttctgaaactgtagagtagaacccatactccagagagtcttaagaaggcggatccctgggtctcacacagagtttgattctgtcagtctggggtgaggcccacgaaggcatgtatttacacagcatctcagatgtttctgatgcaactggtccttaggcctcactttgtgaagctctctgttctagcctgtcagagccaggtggaccgcagagtcctccagtcctctagtggttcccaaatgtcattgatcttcacagtcatctgggaagcatttaaaaaataaatgcctttctccagcaacacctgcacagatcctgcttccaaaagcctaggaggggaggccaaggaatcttcttttgtaaaagatcctcttgtgaggataagacaggtttgggaaccactgctcggggctaaccctttcctcttactcacgaggaaagggaatctcagaaaggtaaattatattaaggtaaccattcacttctctttagttcactcccttcagcatggaagaggtgccagatgtgagcaatttctggcattgttattaacacacttgaaatatttttctgttaactttggccttgctatcaaccagcatgcagaagcaagtgggcagactgttccctcaaatctcttaccccaagtggcccaaacaggagagaaccctgaggctgttttggtgctggaggctgctgtgagacttttcaaatactgtactccttttcgtcataaagccttgtccagaagccccagcctctgcatgtgacatagacacaatgtattttagccttcactgtgtgcctgggctgggtcttgccaatactgtgaccacttagcaggagcaggctaagagtcttactgcagaagtcaaggccaactcagtggaaacagtgatgtcttttcaaggttgctttattcagcgacaaagtaaaggtttcagtgccctggaagctgatcagtgcttcctgtttagcacatggcctttctcaggcactgagcatctggtgtgtatctgccagtgtccaggctctggaggtgacatccaaacaggggagaccaaatgctgccttcgtgcagcttagattctagtctggtgggatagatgaaagtagacttcctctggctggtgtggagaaggactacctgcctgcttccacactgcgacaccagccccctttttcttttgaaaatgctggtgtagtatctatctcattattgtggcagatgtgatgctggcggccgaggggacagcagtgatcatgtcagtctctggtctctgtgagtgtacattctggtgggagaggtaggtaatacttaagtaaacatatcaatgaactagataaatgcagataataacaacagctaggccaatgtaaaaacagtataatggtttagaaatgcttatggcctcatgggtcaacatcagggaactgaatcaaaaaattttcccaactgatggtgaacattttgcaatagacctcacaggtcatctgctcccaacctggtctgcgtattaatctatctaaagagtttttaaaagatatataagcccaggctgtgctcttacagatttctgattttactggtcccaaggtgtagagctcaagtattgctacatttttaaagataactcagataattctggttgagaaacctctgaagcccaacaccctcactttgtacatgagtcaccctgtccgcagtgtagcaaaacaatgttgagtagtggaaacccccctacatagggtgggggaagatgaagatatgggttattgtcccagatctgcgatgcaataattgtcaggttaaacctcagttgttcactttccctgtttttaaagttaaagggttggacttggtagtcaccaagatcttttccatctctaccgttctatgaaagtgtttctattaaaacagaaacatgctctagtttcttgtttgagacttgggagaggcaaacaaatgcctcctactttccttattccctgtctctacccttaattgctataggtccttctatcagctaatcagttccttttggaagtgaaaatttaagacagaaagaggtaattactttatgctatttaaataaatttaagaacaagcaagttttcattaatattaataataaatatgcccagatttagttctagtaaattacagtcataccttatttatcaaattgtagcctaaagctttttccgtttttgatggttgatttaaaaccaaggggcgggggcagttgtttaaaaatggaaaccatggagtagccttaaccattgcgtaccacagtaattttattctttaccaaatattccaagccaggaacccaaagaaattgagtctctcccaatgtatcgtctgcagtttattagcaagcagaaacaatgtatctcttgtgatgccatcttattttataaaaaagaaaaacagaactaagctccagcatgaaaaaatatcatttaacttcctaatttgagacctggcatctttaaaaacttggatttcattgaaacatttattcaaaaagacagcagttcattataaaccagcatggtgtgatgtaagcaccttaagtttatttccttgtgtggaatttcccagtggggtttgataatattcagcagtttcagaagcgataaaggagtttgaaaagaaaatctgatgggagctggtaaatgaaattagagccatatctttttcaacagagatctttaaagatttgcataccgcctattttgtatatatctaagaaattgtacctccattgcattcacagccacgtttgccctagacacaagattatgaaaaatcctcctcctcttaagttgcatccgtaacatcaagcaacttttgaaaatgatattgtttaacaaaacaattggtttgatagaaatccatttcaaaagcaatgtttctaccacaagcaaaatctcgtaaaacagaagcattttgtttccactattgcagagaaacaaagttgtttaagatgagttaagatgtctcagggttttggcagtctttctaagccccctgctgctgttacgttcagaatcccttttgaagtggcctggaagtttctatgcaatttcagtggctgcttaggggaaatattggctaaactgctcatttcgactgttaagatggatcgagtgttttcagaatgttttcgtttgctagaaatatgttttgcactggggcttctcttgttgaagaaggttggttaccagccatctgaagatgcctcagggtgtttacagaaaatgtgggtgctgtagttatatttgagcacagccctcccccaacaaagatagtgtggtaatcagcaggaatgtgaaaacatgtatttaaggattgatgcttgtaaaagaggcgctgtaaagaaacatggttgttcagatgtaagaaatgactgacagctctctttgtaggcatgctagtaacaataaagtctagaagttcaacatcaaagcgatcacagcttactccaccagtgacttgcacatcaaagagggagcacaagacaaaggaagtgcactgaggtatgtttctgcctcatagccagatcctcagggggagctcccagagctcctttcatgaatgcatagtgatttttgcagatcagcgtcttcatttcataaatgaccaggaatataaaagcagggcaaatgaacgccataattgctggcatcactttaagtttggttcggaaagattcatcacaggagcgattggtctctctggtttccttgagtagtgaattctataccagtgtgggcaactctaacttcacctaatgtagtacagggaattattcacaaaataagagaaaacaaagtggatacatttcaaattggtggattggaattatgcttgagaacataaaactggacctaagttagtgcagtatgcctcttttttctttcctgttgattgcttaattttttgagattaaccttgtgggtggatgtctgctgaatcaggtgtgcattacttaacaggtgtgtgacataatgaaatttagacctgttaaaccagctcttaattaatcaccagatctatgcttcagttctctaactcaaatcatgtgtactccaaaatgccaaaagtagaacaggaagaagagtctgggtttgactttcttccctctctcttgatattacattgaaaataaaattaaccatgcaagtattatgagtggttttaaataatgtgcttttttttttgcttgcctttgaaatttaaagttcttttatagttcatcttcagtaatttactcatttttaagtgctattgaaaaatagtagtgctctgtgtagtcattaataaatacaaagcagctttctcaaggctctagggagacctaataaacacaactgtgttactaattgatgctatactgagctgacaaaagtagtgcatcggtaaacagaagttagaaagcaagaagttaaagaactataggggattatgtagacatcaagggttgaaaattataataaggcctctttaggggagcattaatttgcatggggctgaattaggacaaccaattatttctgaggacactactaagagctcatccaaaatacccccaaagtgaaaggtttgggaaagagttgggacttaggtgagatggagggggcactgagcatgtcatatttcctataactcatggtagttcaatagttttctcaatagcatgttagaatagctagttttctttgttaggagaaaatgctgatgaaatcaacagtactgtaatttctttgttctatacacacagtttatgttgaactaccacaatggaattttttttttaagcaggaagggcaggagagtggagacagaaataaaccttttaaatcttctttacgtgaaccccacaaggacataagcatttagcagattagagagcgtttggatttatagatactatcctctacagtagtggtcttcaatgtgtgatccagggaccccctgcggggccccaaggccctctcagaagctccaagagataaaaaccagttccataacaatactgaggcattgtttcccctttttactacggtgaccatttgtattaatggtgcaaagcattggtgggtaaaactgctggcaccttagcaggaagcaggacggtaatgccaagctgtaccagcagtcatggtattcttcattactgtgcagttgctgttaaaaaaaaaaaaaaaaaaaaaaccgggcgcggtggctcacacctgtaatcccagcactttgagaggccgaggcaggcggatcgatcacaagatcaggagatcgagaccatcttggctaacatggtgaaaccccatccctactgaaaatacaaaaaattagctgggcatggtggcgggcgcctgtagtcccagctactcaggaggctgaggcaggagaatggcttgaacctgggaggtggagcttgcagtgagccgagattgtgccacttaactccagcctgggcaacagagcgagactctgtctcaaaaaaaaaaaaaaaagtttcatttaagaatgtgcttgatgaagcagaaaaatttattaactttattaaattttgaccctcaagtccatacctttttaatgttctttatgacaaaattggaagtttgcataaagcacttctgctttatactactaagtaccatgtttgtctccagggaaaagtacttgtgtcattgtttgagttaagagctgaactagctgttttttgaatggaatgccacttaatagaataacagactataattattcagatgtggatatgtttcatatattttctcaaaaatgaactttgagtctgttatctcctgaaaaacagttcacagtatttactgcccatacattcaggcaaaaatctgaattttggaaaacttgtatccaaccccaggaatctgacagcttcccaatacttaaaaacttttctgatggtatgggtagtgatattaatcaacataattccttgatataaccacatctaataatgaaatgtgtcaaaatctggaagatatacaaaacccagtgaaccagtagtttccaagtgacccatggatgatattataaaaatatatgtaggtaaatgatccactcaaagtgcaaaatataccggtgtattttaatttaacaaagtacaaaaagtcagtgatatggcttcaggttccatattctaactaatctttaagaaactaccacttgttgagttttagtgtagtaccacagaagaatatccaaaattatctgaaaaggctattataatacctctcctttttctagctacatatctttgtgaggccagattttcttcacatacatcaaccataagagcataacacaacagattgaatgcagaagcagctatgagaatctacttgtcttcttttaatagccagatataaaaagattcacaaaaatgtaaaataatggtattcttcatgctaactttttgtcttataaaatatacttatttttatatgttaatatgcaatgtgtttattactattattttaagttgaattataagtaaattgtgtaaatgttcccagttttaacttctaatatggcaatgactgatgtataacctacaaaaacaaaagctgtttgcagcttttttttttttttttttggaaacagagtctcactctgtcacccaggctggagtacagtggcgcgatctcggcttgctgcaacctccacctcccaggttcaagtgattctcctgcctcagcctcccgagtagctgacattacagacacgcaccaccacacccggctaatttttgtatttttagtagagacagggttttaccatgttggccaggctggtctcgaactcctgacctcaggtgatccgcctgtctcagactcccaaagtactgggattacaggcgtgagccaccacaccaggcctctttgcagtttttagaagcataaaagtatacagagaccaaaaagtttgagagctcttgctctacaatttactgtaggagacatagtctgaaaattgtatgacaaagcacaaggtaacaatagaaggggctttaaattcagacagatttatcagatgagctataaattatattaaagaaagcactttcaaacatgaattcaagagcaaattttgtaatcctcgttttctttataatgtcttcatctttcataacagtggaagaccagaatctttggtgatattctattttcagagatttttgtttttgttttttttattaatatagcaaagacctgggcataaaatttgtggtttacagaggctttacagtttatctttaatcatctgcaacctatattagcaaaaatagtactagtaaatgatggctgtttttctttttgttttgggctggtgtggaggaaaaagcttttatacaattagtaccacttccagagctatcccagctcctgaaagatgtgaaacttttgtcatgaatgtaggcaccttggagaattttatcactgtgtgtagagatggaaagcccttgcaggcctgcgaccatgcaagtgatgggcaccttaacacatacaccattcactccccctcagaccttctccaagggggaagagttctgcccagatagctgtcagcacctgagtgtgacaaggaggctaagccctcgactaacagatacacttggcagaatcagttccattacactaattaaatatgtgaaagcccaaccttccctgaaatttcttgtgaaaaataacatgcagttagaaagcaatgcccaaatacttgtccttaattttataatcactttgttggcatctaacatatagacattcacattgccctttgtggctgggccatctgcctctttgttattatcaaatagggggcattcaggtcttgcattccatttggtttcctatcaaaaggctgtccattgagtgggagcaaatgtgttttggcacattctgcatttccagggtcttgcttctgactgttataactaagagagaagttggtgcccccagagccaaatcagtctcagaacactgggatacgttgctcccagcatagttttattagccagttaaagggataggctgaagcatactcactgtataaacagaggttgtgcaatggcccacagccacgctgcccatgagaaaaagcacctcctgtcttctatggatctacccaaaattaggagggctgaggagaatgagatggccccatttcagaacaactcacagtggtgatgtgggggaaggatgggagtgaagaggaaggaaagcaaggcaagccacgctctgttcttggagagggtgttgggaaggtgcagctgaggaaaccctggccgtttaaagggtgagagaaataactacatgcccattcgtggttaaaaagaaaacaaaacttctaactttccaatttgggaaacagaagtgtaagataattattctctttgaagtaaaataaaatggctcatgtttaggcattgtattttattaaacttttagcattttctggctaactgaactttaaacaataaattttataagctaagttttgcattattcggtgattttgacccaggcatggaaaactattttaaaaaaccaaagggacatttttttttcttgatctgggagtattgcctgtgaaaattcataaagcttacatttatcatttgtgtctgtttctctttgcatgttgcacttcaataaaaagcttaccaaagggcaggaggattccagtaattttttttttgtaaatcatatactctcagtactgaaaatattctctagactcgactttggaattttccactctgtcatttactaaacattttgtttattctcagttcctttgtaccaccacttcacagaggtaaactggacctatgaccttacagtagggaaactgaaggcatttatacttcaagtacacgtacaaagctgtaactccgtatcatgaaggccaagtatcagcctttacaggattgttttcttgctttatagccattggcttttgaatgacctgctagtcaaatgggaaggaaaaagtgaatcagacgatgtggtgacgttgctataggaataggaaggtcttctaagacttaatactgtctgtgtacattctagctctttgctgaaggttctggccctaggttaaggctggcattagacaaacggagctatgttttcaaactttatcatctcctctcttagggctctcggtggccttctggtttagctgaaggcagagttgcctaatcaccacataaaaaatcgagtagtacaatctccagacctcctcttcttctcctgcccctgactcagtagtttgatcttctgtcccgttctctcctggctcttccgggtgacacaagatacagaaataagaaagactctcagaaagttggcataggcataagagcaagcatggatctggaaatttttccaaatataaggcttaagtcccagaaatgccacgtattagctgatggatcttgggcaagtcatgtaacctcactaaacctcagttttatcatctatcaaataaagatgataataacatctacctcatagggatttttgggaagaaggaagtaacacatggaaggtacttaatgcaatgtctcacatgtgacaagcacttagcatatggcaggcactgaagaagtgttgttattaacatccccatcctctcatcctcttgtacacgtggtaaatggtacacatcacgtattcaagtttgaagttagggtaatgagttcatccagccttagccggtacacattgcattttaacaggggcctttgccagtgcccaagcatatgagttatgtggtctggtcagatgggggctgatggaagaagaacttgcatgaaatttctcatcatataacataagaggcttctaattctgcattttccaagccctgctatttgtaaccagtaatatatgttctaagcctatcatttataaagcgcttcctgtgtgccaagcaccatgaaatggattaccacatttaatacttacattagcctttcatcctcctttttacagaggaggaagcggagactcagagacgcagagcaacctgtctaggatcacagggctagcacatagctccaattgggggctgagtctgccagactcgcagggctgggctaaccctgctctgttctgacccaacagccccagcaccaccggagtctcagaaactcacattgttccagattccgagattaggtcatcatgcaaattgaggttaggggctttttctgaacactgcagtagaatggaagtagacaaaatacacatagaaatggattgagcatctgatgtgtgccaggcactataaaaagtgctggaaccagaaagatgaaaagaagtggtccctgccttcaaggagctcacaggccagggagggcccaaggtggaaataaaatcatgacatagtgtaaatgctagagcagaggaatgcaggagacgataggagcacagaggaggagcacaaatcagactgaggggttaggaacagctttttggaagaagtgaaggcttagctgagctttgaagcaaaggaaggttattgccaacaaatggtagtttgtgaaaatccttgaaagctagacagtgagcaaggcaagtcggggactgcaggagacaaggcatgtagaggagaccggtggggtctgaactatgacaggctctcaccctcattctacgggagttgttctttctactgaaggtgccgggaggccacggagggaggctgccagatatttttaaggcacatgaagaaacacgagaaacaatcagatattctcagtatcttcctttcccttaattatttcaagagataaaaaagctttttggatgcggcaaaggtctcttctgtgttatgatttgggtttctgtgcggccgctctgcctcttgtatggtgttgagagatgtatgaaaggcatccgccacgagtcttcaatggatttctgcactttgcttgatataaattgattcagggacttcattatgatgtcgctaagatgaatggggcagtagtgttttggcttaacgctgccagaaggagggaaaacaagtttctgtggtgccgcggttcaatcatgctgcttacagaagtagggccatgaaaggacggaggattgtgtctttgatactagaaaccctgtagccctgttggtgctacaagcgaatgcttaaattaaaggttggagccagctttcaagtattgactatcgagcaaaaagctcagcccacactcatgtacttactcagccttgttaaaataaaaatacactctcggctgagctcgtgtcacagccagtgtaattattacattaaagattgttgtttgaattagagttgctgtggtacacgtttatttaaagatatgcttggtaatttagtacatgttagtcaggactcatgcccaaactgtgaagaagtattcgttgccagctgcctctcaggttgtttttgtattcaaggtaaacacttgaaacttgacaaattgatccagaatagtggtgatctgacttccttgccacaggaccagtggcttaactcactcagctctcatctcctacccaggatgaaaacagcatcaaccacattggattattttgaggttgttaaatgaggtaatacatttcaggtggttggcccatcaataagcgcttcttcctaaatatagttttgttatctatattatgtatagatttgtttttaaatggtaggagggagtatgactaaaaagcccctcttttttttttcttgctaccaatggtaaaagccggatgatccagttgtctataatagccatgcatttattaaaccctgtgggttataacccctctgtttcttatggttcactatgcccagagcattcaagtgtttagtaaagttgtgaaaggctttgcaaatatgagggatgatgcccattttctggtaggtttcttatggggttctttcccccaacatacacatttctcagtgattgtcccctctttgccctttgctggccatgtgaaatgcaggaccacatcttctccaacagatgaatccacattaaagccactcactgacctgctttctacatttaaagctactcaactttgctatgtaattgtaaggctcccaaattcaaagcatggctagtgagcaatggatgagggtatacctagtattttttccatagacttatggaatctcatgcatggaatttagatatcaggcctccctgtcctcatctgggagtgctgggattcatgagctactcctatgtgctctgcagtacgttctggtgtgtttaaggtaaggtattattctgtttacataaatcaccctgacatcttgtactttttcatggattattacttttttaatgaggtaacagaaatgcagtgaggtcaatttatgtgttggcctaacattctaaaaagtgaattttgataacttcccagcagggaagaaaattttcatcgtagaaggtgacatagctaaatacaacagtcccatagctagctgggcattttatagactattagacctgcaagagaccttagcagtcatctagtgcaatctgctaactttataatcgggtggttgggagattaaacaccatgccaggataagttagtggcagggactaaaatcagggacccctcatgcctcttcatgatctttccatagttcatgcttcatctaagactgccacagagagctcagatgtaatattatgataccaaaaagtgctgtaagtgatgtcttaggcctctttaactcttttaaaaactaggctattcatttctatcaaaaggtttaattggcctgcacaattatttgtgttttcacagaaaagagaaaaaactaattctagttaagagtaacagcacacagtaggactcatatgcactggagctttaatttagtctttacaggcacacacacacacacaaaaacacaggaaaccacttcaaatataccattacgatgaattcaaactgtgtcagggacatcagcaaaacagtgtcccttcatgctgagtattgtgaaaatgtatccttgttgtttgctgtggtctcctgtgggaggcacatcgaaattactacactccccgggaaaaaaaaatagcaagaacagtaaataacagccttcagataatacagatgggtaaacatttccagaattgattatagaaactactgttgacaagccactagcaggcaaaatgaggagagaaaaaaaaagaacttttatctgccattcaacactgggcatacaaggcaggatacagacagggcaaaatagccgattaatatggtaatgtactttattgcacatgtaggatcatgagagaggcctgagagttacctggtccaagccactcctgttaccccagagaaaacagaaactcggaaaggttaagtggctgcccagcatcacacacttagcagcaaagccaattttggaaccttagtctcttgactctcagtctagtgctccaactactgtactgtgaccctctaattgaatctatgacggcacctgtgtcaggggtacaagatgaggctcatggaaatttatccaaatgaatagctgttttaaaatcatcattaaaactgtccatgggccaggcgcagtagctcacacctgtaatcgcagcactttgggaggccaaggtgggcagatttcctaagcccaggagttcaagaccatcatgggcaacatggtgaaacactgtctctacaaaaaacacaaaataatgataataataataataataaactgggtatggtggcacgcattatagtcccagctactcaggagactgaggtaggaggataacccgaggctggggaagtcaagtctgcagtgagctgtgatcataccactaccctccagcctgggtgacagagcaagaccttgtctgaaaaacaaacacatacacccacacaaaacaaaaataatactgtccatggttttaagcattctcctgaagacaaaaacttgttaatacggtaccatataaaatctcagtttatcttcacatccagaaaggaaggcatttttcatgcacatttagttactcaacaaatatttatgaagtgcccgggctgtgtttgtgttactgacggcccgtgatcggctatcttctctcttgtctcggagtcaaataagcagggggattgttggatctgtccccttcacctcccttctgtcgaaggatctcacgctcacattgtcttacttttctctcgtttttcctatccttttaatctgatctttaaatgtcagtctctgttctcatcttcctttttaacgagtgtgggtttctcatgtttatcttgctctccttttgctgacgtatttgcatcactttagctgcagttaatatctgctaaatcaaaccatattggcttgaatagcttccattgatttgtgaataaaagaatgcttcagctgcttggccctgctctctgtacgttctttgtcgccagtaggtttaacttactcaaaaccttccttgtctgcatccctcttttacccttgtattgttcatcctcccctgttcaagccattcacccttttgagctgtcgttactgtaagggagtgactgctatttcatttactcattatttactgaatgaggagactaattgtcatttttctttgctgttgccctgtttcccccttttaaccaccacccttccgcccctttatggtgaggaccaaaatcactgttgtcattagctagcctgtattgagcatctactacatatttactaagcatcattcagaagacttgaattttgtaaaaatgaatcctttgggttttttcttttctttttctttttaaagagacagggtctcacaggctggagtgcagtgttgccatcatagctcactgtaacctggaactcctaggctcaagtgatccttctgcctcagcctcgccagtagctggggctacaggcatgtgacaccacacatggctttttttttttttttttttttaattttttaaagagatggagtctctccatgtggcctaggctagtctcgaactcttaggttcaagcagtcctcccacctcagtggtttcttttgagaaggagtgcaaaatgaacaaggcactttcgttgattaatttaattcaaccaattttctatatataatacctcttaccacaaagaaatgattagattctaaatgccagaagatagaggtgtgaaaagacactaaccacaaaaaggccttttgtaaattgtattgtcagcgtattttaaactccaggaaatgccataatattgagattttttttttttttttagcgcaaaaccatctaaactgaaatccatatgaaaaatatcaaaactattcagtcaacttttacctacttcactttgtcatcaacaactccctgttccgtccttgcaaagcaactaatcttttttacttgtactaggaaaacatataaaaccatcctgacagtttgataatacaacaacagtgcttagattcaagataaatgtatattacaagaaaagtgaaagaagctctcaggtgagtgagctctgggtcaaggcccttcgagccaaaggagaggaggtcctggactttggtctgatgtgttccaggatctgtgcctggcctgcttcctgcctcccatagcagcagcaagtcctgctttccccagtgagatctcgactagacttccccagtgccttgtcagagaaaaggggcttcttccttccttagaatcattctgacaccacactgagccggggtatgcaaacagggaggtttgggtcttgagaatagatcatgcaaatttctttcttgtttcccttaactacatcagcagtagagagcagagaaagccttcactgccatgctgcctcatggaggtgctgaagtttctcccaggtaggagaggactttgggcttcttttggcatcactaccctcaggatgcctggctgttccacctttctgtgggtggggcaacccttgtctctggcagaacagaaaggtgcacaggggcagaggtaacagcaggagacataagcattgtcctatccattttccagcagagcaccactgtcctatccagagcttattttcctggaaaccattctctccataaaacagtggttctcaactgggggcacttttgacccccagggaacatttatcagtgtctagagagattttttgattaatacaattcgagagtgctattagcatctagccacaacaaagaattatctcacacaaaatgtcagtagtgccaaggctgagaaaccctgccacagagcatgctttctaccttctgttcatcataggccccttacatatgacatcttcattttcattttcaacccaaacacattttatttaacaccgtataacttcaattttaagtaaaggaataaatggaaaactttattggcatgagaaagaaaaaaagggaaagtaatgcattaccaaaagaagccggagataatcagtatgtatgaactcatgcaatggtagaattattcttgctaataaaagagggtatcggctgggcctggtggctcacacctgtaatccctgcactttgagaggccaaggcaggcggatcacttaaggccaagagttccagaccagcctggccaacatggtaaaaccctgtctccactaaaaatacaaaaattagttgggtgtggtggtgcatgcctgtagtcccagctattcgggaggctgaggcaggagaatcacttgaacctgggagatggaggttgcatgagctgagatcacaccactgcacgccagcctgggtaacagaccaagactcagtctcagaaaaaaaaaaaaaataataataataataataatgataataaaagagggcatctctctaaaagaaaaggtgcaaacccaaacatttagtgcccctaggcaggtggtgtgagtgtggcaggtagaggaggcacttggaccgctggacggcacatatgctttggaaagggagcacctcccttggctctgtcgccgtttggaataactggtctgtcatcaccaggtcttttttttttttttaagagaatctataaatctgaactttaatgtgaaattccctggttattaatggctagaaacatattttaaaaactcataggctagctcgttatggaagcagattaatggttttggctagttcatctttgttagtatctttatcattattgagattgtgtggttgaacattggacagatgagctctcacacgtaatctaaacagactcctttctgttctgaaggcttaagtcacctagaaaataagtccaaactccttaacagagtattcaaggccctttaggattaggtcccgccaacctggctacccactttccatccttatattgagccatttgctccactctaccctgcccttgagacacagtgagcctctctttgaacacatcacgcatgttcatgctgggacctctccttggcttttcttcactcccatcgcaactttcactgcctagggaagtgcgatattcattctctgtggcccaaatcaaatgacaaataatcttcccgaattccctaaaagaaatctggtttggtatattctgttattatgatctttataagttgctaccatgtattcatctagtcatctccccaacctcaagtaatgtgtaagacttggaggctaggaacccaactttattgggaagccaactttattgctctatttttcatataaacctagctttcagtaaatttaaatcaccttctgcttatccatccaccagtatgcactgtgattaattaacaaggcagtttctgcattaacaccaaactttccctcttccctgcctatgaccaagttttcaaaaaaaattaaaataacattaaaatgttattaacggcaaaagggaattattttttgaaacatctatgattttttactaagaaaaaggaaaacttgagtgatgagtaatacttattaaacatttggaatagcattaaaataagtatttttacagagttaaatatttgcgtctatacttagatgtataaaatactattctttgaacttgaagtggattttgaactctgctctccataattataataatcataagcttatttatgtataggtgggctatatagacattaaccaattaatcttgatcacatcacctaataggaagactttccttgataccctatttttagagtgcacatatgagtgtatgttaattataggtctctgttattaactttgcattatattaccgaaatgcttaattaacagtttaccagcatcaagagtgtaggtgggcaagaaacttgtatcagaattcacttctgttcaagccaggaggtgagtgacattcataaatccgtcaaatacctggccttgcatccaaggactattcattttccttaagtgtttaagtggttctttgagaggatgtgttgactttatcaattcaggccacatcataattagctaatttaaagaaaaaacaggggtggtatctatatatgtttgtaccaaattgagttttaatataatcctggttctctgagggtgatatggctaataattaagttatccccattaggttatactttcggaagctgctgttgcctgctgcctattccattaaaaactaactttatcactaattttaacatgaaacagatccatttggagaaaaatccattatgaatgagacagagttggctgttgaataacattggtgtaggctcaagtctggaataaatgtgatatagatgggacgatattggacaaatgcaatttatttcattattcagcaacaaggtattccaaatgtctctgctaatgaatacatgaaaacagattacatataatgtgcacactgtgagtcgcatttgcagaattatttttgccacctctagcactatctgaaaccaacactgaatagcaatggtacttgagcttctagttgcaagaaaaagcaactttaaaaattaaaaccaaaaaatgtaaaaagaaaaaagtaaatgtcttatctgtggaatttacctttatgggagaattcttgggaatatagcagttttatctcaatccaattgtgttgtcctctgttaaacctctattgtcccttaaaatcagcccacatgaaaagaagacagtgttcttcttcaaagctctgatggacgactttagagactgtttcaggaacactctgtctttttgctgagatattggtagaatacaatagataacatttaccgagctcacaagggggtcactgcttgtccacagcagtttgtaagctgttggttctggcattaaatttaaagtcccacaaagtgaagcaaaaatgtataataatgctattattgtactggttgcagggttttcgttcgggtgccattggggtattgagatatttaaatatcaatacttttatgctgtcatataattgtcttagaataatcactgttttgcgctgataaaatacttttaatctagggttttctcagattccctatcccccaaatatatctgagtgataaacttgttgaaagttcaacatgtcaaggatgacttgctctagcaagctgtagtcttcccaggcccccacctttcctggttaaaggattgtcctgatgagaccaaaagatcagatttaatatagcccagcagacttagaacacaggaaaatagtcttttgtcaccctcagtttacccctatccctagtcagctctctcataagtgaagttaaaagcaactagatgagagtgtggatcattctgaccaaatggttctcactggcagtaaaaaatggttccaaaagatgatcttatttggtgggccaaatgtaaagagcattatgttaagataaaatcagtaacaattgcattataagatgccatttattgcatttttttctctatgccaaacactgggctaaacactgaacaagcatgatcacttttaactttcaacaactctggggataacccataatggggataaccattctacagatgaggggaactgagaatcaaaaaggttaaaatttttgcataagttcacacagaagtgtgagctgggatttgaatttaggtgtctcatcccagagcttctcaacatgtctccacagccgtgctgtataccaattgtaagcatgcatctttctcagactttggattcattatctggatataaaattcatatcctaataaaatgaagtatgtagtgagaagtgtgctcaagtcaagcagcccatgaaaggctgtacaatagagggcaaagtgaaagccgcatgcaggtctgtggaattgtatggggatgtttcatacaacactgaatgccatgtctgctggaaaacattgcttgaaaataaatatgtaggccatcgctacctgtgtgtgtacttgctgtaatggagcaaacttccaatgaccaccaagaatgaaccacagtgaactagaagatgtgtcctctgataaacaatgtctgtgatgtagccacacaggaaaagccatggtttgaagctctggggagcccgtttcctaagagactctctggggcacaacaataagagctgctgtttactgagagtctcctgtcccccaagcactgtgctgtctcagtttggttttaggtgggtaagatccccatgctacaaatgaagaaactgaggctcaaagaaatttccctaagattgaccacatccgtggcagaattggaacagtaagtgttcttgatgactaaaatagttggaaatatacataaggggtaaaatctcatgaaggttccctaattaaattcacaaggtagactttgctttgaagtgaagtgagataccttctaaagcaaaagtctgtttaatattttccaccattagaaaaaatgcgtgcttaggccaaagtgcaagaagaggaattccatgtggaaaactgcaggtgtgtctagttaggccaagaggtataaaaggctgagcagttgtctggcacacctggtatttgcaccatcagcatcttgcacttagtggatgctaagcaaatatttgtgatttttttcaatagcagggatgtttgtctgaatatttaaatattcaccttagtttgattttactttggtagactgactccgtgttcactttgggagaatttcaacttatacgtgtccgccttaagtaacaagattcagaaaatatgattaagtatagcatttatttgagcccaaacttgaggatagccacctgggagtatagattgaagttgccttgtacactcggattaacagcagttacaagtgaatttttaaaggaagaaataagaggcagtttctaaattgtttaccaagaatttatatttaaataacataagctattggccaggcatggtggctcatgcctgtaatgtcagcactttgggagtctgaggcaggacaattacttaagcccaggagtttgagagcagcctgggcaacatagcaagacccctatctctacaaaaaattcaaagccaggcacagtggctcatgcatgtaatcccagcactttgggaggccaaggcgggtggatcacgaggtcaggagatcgagaccatcctggctaacatggtgaaaccccatctctactaaaaaaaaaaaaaaaatacagaaagttagctgggcgtggtagcacgggcctatagtcccagctacttgggacgctgaggcaggagaatcgcctgaacccgggaggcagaggttgcagtgggccgagatagagccactgcactccagcctgggcgacagagcaagactctgtctcaaaacaaaagcaacccccccccaaccccgcctcaaaaaaaaaatgtaaaaactagctgggcatattggcacatgcctgtcatcccagttactcaggaagctgaggcaagaggattgtctgagcccaggaggtcaaggctgcagttagctatgatcgtgccatcgcactccagcctgggtgacagagtcagactctgtctcaacaaaatttttgtaaactggcagggcgcagtggctcatgcctataatcccagcactttgggaggtcaaggcgggcagatcacctgaggtcgggagttcgagaccagcctgaccaacatggtgaaactaaaaatacaaaattagccggatgtggtggtggcaggcgcctgtaatcccagctactcaggaggctgaggcaggagaatcgcttgaacctgggaggcagaggttgcggtgatccgagatcgcgccactgtactccagcctgggcatcaagagcaaaactccgtctcaaaaaaaaagaaaaaaaatttttttttttgttaaacccataagctattgttctgtgtatcacagattccagtaacatgaagataatggaggcagcatctagtcaggaacaaaatggctttaaatagtcccccaccaccacccctgcatggggggagtgtcactgaagtcccatattatgtctctcagggcgtgataaattttgcatcacttatatagctcatatggttctgagctatttttcttttctcaatggatatagttttggattgagatgtactttccttctatagttcttgaccctttaacaaaatgtattggtattttgcaattcagaatctattacattatggaagggggtccaaaaaccttgagagccatgttgttaaagctttaacataaagatgttaaagcatcttcctcatgtgttcctggatctacaacacgggataaaattcttaatgttagtttcagagttaaagagtttaacttttttttattactttcttgtcatcacaattataattatgcctcattatttattattattttgcattctccatatttaaaaaaacacaagttggccaggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggcgcttgcagtgagccgagatcgcgccactgcactccagcctgggcgacagagcgagactccgtctcaaaaacaaaaaaaaaaacaaaaacaaaacaaaaaaaaaaaaaacacaagttaaaacttcccatgtataaaaacacttacattttaaaacatcactgccaacgtgtgtgtgctcatgtgggagtacagatgtgtatatacagacatgtacatttttaaagacttggttgtctctgcagtgaagacaatatgttttattttttattccatatacttctctgtattttctatatttgcttcaataagctggtgtaacttttaatttttttaattaaaaaaaatttagcgtaaaattacacttaaacattagcagctgctgctgggaaaaaatggacaaattgcccaggcagccacattagaagaagaaagtcatttgaatacagttatatacttatttttattgagacacatcttgctgtgtcacccagggttttgctctgttgccacagcttactgcagccgtgacccaggctcaagtgatccctcccacctcaggcccctctccccgaccagtagccgagactacaggcaggcacagactggcaccaccacactcggctaatttttttttttttgaggcagggtctcactatattgtccaggctggtcttgaactcctgagctcaagtgatcctctcaccttggcttcccaaagtgctgggattacagacaagtcatggcagctggctgagtacagttattcagcataagcataacaaaaacagaatggcagcccagttcctttgttaatgaaatagtaagggtgtaactagggcaagctggccctgtttatgtcacatgagtttgttttagaaagcattcttgagaacacaaacaaaacaaaagaaaaaattttagaaatacactcacattttaatataaaatggactgcgttttgtggctatgtgagaattttcaacataaatctccttaagaagggagtcaaatgttctggagagatctaaatttaatacaatctcatagggagcaaaataaggagttgctgtgataaactttttgctttgccaggtatgggctacaatgattggttgaaatcatccaaaaatgaactaaaatcacaaattcattttcacagatttattgttagaacttatgttgcttccttaagaaaacgcaactatattaactcttggctatggcagtcaagaataaaacagtcaaggggaaaaaaaacagtggctaaatttataaagttatgtgtatttggctttgaaatatttttggaacatgaaactggcctcgcttaggtaaagaatcaatttgccatgtcttgtaacatatctatttgaaggcattgagaagagatcgagaaactctcaaactgaatgtacttgtgataattatcaagccgtaatgcaaataacagaaaggtcattgtcctattccttgcacgacatctttctcttggtaatttgaagaacagggtctttcaattaccttttttgccttcctactacagcaatacctcacctgtgatgaatctgtcctctggcaaccttctctgtcacaaaccatctgagaagttaggaagtaagcaaataggcctttaggttgccaaaacagagacccaaagttcaagcactacagtgaatgcacttgatttcagaggaaatctctttagacccagtacatcctatttataattggtttttacacaagcttagttatctggttgggttccaagacatagctaattctaagacaaaatattaattacaagtagagggagggcctcataagatctagcatatgactacagaaggaaggaaaactacagatgaaggaggaagaaaaaacataaaaaggataaaaaccagggccatttagtgttggggcaaaatgtcatataaatcttagaaggccttcagagcattacagcatatacaataattttatacttttttcataagtgtctaataaattttttcgagaagagtaaaatactctttatttcgtattacactttgatgtgtaatattaaatgttctttatttgatttttattagattttgttgtttataagatttttattatttataaagtatatttgatattacactacacaccaaagtgtaatatcaaataaaaaatatttaactcttctcaactattacactttagtgtataatatcactctaaatattgcacacttttctaaagcctacactaaaatgcctttctgtaagtaaagggaaccgttttagatacagggaattctaatgagattggcacagtcaaagccaaaaatataaagtagacattgctacctgatcttcagaccttgcctttaagaggcaacagaacacaaaatacaggtgactcttgcttggttctgagacagtgaaggaaattcccaagtatttaaatatattcacataaccagttatataaatctaaacataaaaccaatctccaataggttttaaggtggtattcaccatctttatgaaaagttgaacattactaatgaagtccaaccatatctttagaagggggaaacagtgatagcatttactgaatcgaaattactattaaaattcaaagaaacatcaaacatacgcatttaaccacaatccagtcttagttaacaggactgcccaacaaaaatattcagtcagacattaatgatctgaattctggtgtatgagatctattaaattatggtacacacaaaaaagtcatgagatgttcctgttttgtaataaacaaggcagtggccaactaattaatgcccattagtagcttttttgagataggctatcattttcgttccagggatgaactttttgggattctccaaatactccatcagtgtatcctgtcttcaggtgatgcttttgttcttactggcgtctgtgtaagtgaatccaaaggcctcctgacctgtcctccatccagagaccatggagatgtggcccagtcttgtgtttgcctccctttcccccggtgtggcactgggcatacttctagacaaaaatcttggttttctcaacatcacccatatttaattctctctttcgtcattggcactactaaggttcccattcagaggccaaacatcctgctctccaaatttctaataaattttaaaataaaatttctgatgactgtttatcatcaagaaagtaaattcgattcaaaattctctacagagaaaagaaataggtcataatttagaaatatttctttaaaaatatttatgataactgccctctttgttttcatgtgtttacttggataacactccagttatttggatattcagctatcccaattacttactaaagctctaatcagctgagattcattgctgtttgctctggtgatgttctaaaatacatgatcacagagatgtctgaagttcgggtttacttcattatattctttgagagaactatccagaaagtaacttctatttccagtttgcagaatgtttctcttgtagcccaagggaatgtgttccttatgaatacaagtagacttgaccaactggaggaccaagtacagaatttcctatgtttataatgcctccatcccagagtttataacagttcattatggttatttaaactcaagcaaggccgagcttgtatctcattacataatagtacaaagtaactcagccaaaactttgtgttcactcccctggccttttttgtcttgtaaccaccacctctgtgatttttgctgcttccaaataaaggccaaaccacatgtgtcatcttctacatcctctcgtagtgccagaaagcctcactctctagttctccgataaccataacagttgtgagcattctatatcttatttaacttaagacagtgggttaattttaggtatgactatagagggataatgcaaattctttcacagcaacttgaagttcagccttcacagaagcagagagtactacaggtggcagaaaattattcctgccagcaaatagtagtagaacaagtttctttagaacaaaaggagaaaaagacacatccagtttcagtgggattaaattagacagtgggagttggctacctaaacagtacttttttgggtacttattgctgttcaagcatttggggatgtgctatgcataaatacatgctctgataaatcttttctttgtcctttatcattggattggggtggacaaacaagtgttcctggaggcagaatggcaagccaccatattcacaaaaggaagataaggaagtacaaactggatacatgaatggtgaggggaaacatccactgtaatttgcaaggtttcttcatttacgaaggcttttaggaagaagtgaggtttgaatcaaagatggagcctcccgcagaaccagaaaatgatgaagagaaaggggaagccgtgaacttccaggcatagaggatctctttcgtggccaatagactcatgaaacagggttatacctgttttatcacaaaagatgccacctttgggttatggtccacaggcacattccccagtcagtgacaatatcttcacctgcagagtgaacacgagaactaagaaaatagcctggacactcagaatagaaaaaacacttccctaaaatatttagacaggtaatacaaaatttatttaggtaactgccttagttctctgcttttatatcacctgttcataaaagagaaaaggcgggatagaagtggggtggaggtgagaataaatggcttaaattcagaagttgtcatgccagatttttctcctccctgtttctatttatgaaactttgcacagcaccctcaattttgagggtagatttagaatgtattttcacttggcgatggggaacacagatccccttgtccacagttgtgggtttataagaagagaaagcatgaaataaagatgggagagacacccaggatgagatccgttttttcctaaacactcacctgaaatgccagacattccaaaagcttttgcatttacagagagtgagaaatctctctgctgtctgtgcttcattggaaagtagagggactattgctctttcaagtgggggagatttgtgtaacagaaagaaacagcagaaaataggtcagcaaagtccagtgacctgcacagatgggtgttttgagatgtgtaagccgaggttccacaatcactacccagattcacttacaaatatcaggagtaaaggccggaaatagaaacatattttccaggcaagaaggagtggggaagagggagaagtgggttatcttttttccttcaaatcactaccatttccagcatttgaaaaaacattttcttaaagtcattttgctcaacagatgacagtatttcttgggaaagtagtaaaaaaaaaggaaaaaaaaattcaagcagttttttttccgtttcagccaccaccttccttttcttcccacctgtgaatatgaacacaagaccacttcattcttagggtactttattggccccattctgcttgcatatcccagcatcgtgcaatcactaattgtttcaaacagtaacctagtaccaaacagaattttaacattgccactaattcttttgaacaaggctgtgttggcaattatgaaacagggtagacgttggcaagtgctttcagaataattatagggttcctcgagtagtacagtgtaaacaattgctggtttaaaagcgttattgtgaacagcaatttatactaaaatttatatttgctccttgaaaccaatatatgtcgagagtgccccactccctctcctacctccccaccttgagctctcaagggctttggaaccttttgattttatgacacttttaacttagcaaggcaactacaaggcatgtctaggccacagtaaataagggtaagagtaatgcatttaatcaatgggcatgaatgaagtaatgaaactgtttcagctctggccacctggtgtgctcccaggatactgacatacagaaaggccattttggtacagagagaagctaagaactgcagtggcatcatttttgcctggcaagtagggcacgctgaagattatcacctcttctttggcttatgatggcatggatgcagggcacagaggaccaagacacaggaagctcttggagataatgcagctctaaagtggccacagagacttattacaatatattttttcctctctgtggaaattttaattttatcctatggtacattaaaaatgggtgggtacatcagaaaaccagggggtgagcgtgggggaaagaaagccttgatgattgggggagaatggtttttgaagggctcttctctcttctctttgggtgaatgctaaatggcagtccttcttttccaaacaggtgaccgtatgtgtcatcttcttgtctttctgttgatcctagtggcttctcttacccagcctgagaactcccctgagatttttcgcatcctgaatgtttctcaccaaagtagctagagttctaggataatgtgttttttgtttgaactgcggttcctggtttctgctctctaaagcccttttaagtcatattttccatgattgttcagtgctggctttggtatttaaataagcctttcaatgggtcattagccctgtaattaattctagctatttttaaatggtgccttggttattaaagagcccccatattcacaacagtcttgtctttcttggagaattactaagcatttgctgatttttttttagtgccaaaaatattgcaattttatctcattgtgaatatattcctcattgataggaagagtcaatctttttgaatgaggacagaaaatatttaactgttacacttccatataatagccttgtgcttttatttttctttcaaataatcataacaaatacccatcctgtaccccaggccctgtcatagctatatgtgtttcactttacttacattttaaaaaatcaattatcagcaaatcacagtacttcaatgggaaataacttcacagagaaagagaagtgactggattaaaatcacttactcagtgttggagaggaaaaaacccaacttcttcctctacccgcttatattcagtgtctggggccccacaaaataaacttacaaaagacaggttaacgggagaaaaaggattattttatatgtatgtgagggggcctcacagaaattaagtgaatacccccaagaaggtcatcagatctggaggcttatataccattttaacaaagggcaataaacttatggagaagtgacaagataaaggaaaatggtttgaggcttctaggggccatatattgtgggaaggtaaatatatgtgggaactaatggaagacaagggttacttcaataaggtttgttttagcagatttaagtcagtgcccatctgtagtgataagggttgtctcctcttcctggtatggggttggggcagagggcacctttacaaggggaaatgtatgccctgcctataggcagataggggtagggtagagagctttttctgctgtttctcagttgctttcagctcaaaataatcttcatgccaaagtgtcataatttggggtggcatattctgatcttctcaccagttagttgcagagctaaaattagaacttagaccatctgactcttagcccattcttttgatttctctatgctttattatataatattaaaatagctgttagtctctgtgatactactacaagaggcttaccaattctaatattagaaccaaccaacaagcctggctccacacccttggcacatgtcacaatcaatcacagcacagtgcatctcaaccagcccccaagcattcacttgaaatccatgtgactcggaatatgagctgaaactcacttgccatcttgaccttatagtaatcccaggataaagcagtaattcctggttcagaaaagcagatggagattaactttgattattgagtattatctgggatcagataaaaatatcaatagctcatataacaatagtaatagcagttacaattgtatgccaggcattgagctagttgcttacatatattcttgcatttgagcctcataacagccctgtgaagtaggtactgttatctctgtggtagagattaggaaatagaggtttggagaggttaaataacttgcccatgatcacagtgctaataagtggaagatttagcattggggtccaaggctgtctatctgtaaagccactccttgacatctgacaacatatatggagaggtccatgtgctgaccacttgtagcccagccctagatgtcacaagagtagttattaactttctcacctccagccttttcttttaatcctgtgaattcctttgacatctgtgggtggcaggctctagtaaatgtagttcagaagaagatgcctgccccaattgatttttttagacactttaatttgtgttggttcttgctgtagtttccacactagaaggaaagacctgaggctgtcattgggtattttaataaccctttcattccactccagggtagtagatattacatgctagaagcaggtggtaggatttcctaatttatttattcctttggagcacctgctatgtgtcaggcactgaggcaggcactgggaagacaggatggagaagaatgacaggttcctgctctatacatcttattcttaatgtgtggagacagctaataaatacgtggcattccagggactgataaaggctttgtagaatgaatgcaggtattcatagcaggtgacttgcggggagagggcgagggatgccttgggtttttcatttcctgtggaccctaggacaaatattaagaaaaacttttcaaaaagcaagataagcttctgtatctctgaaatgactgcagtgcacttgtggctcagacggagactgaggaaaatgtaaaaagacatggtgtaatttcagtgtaattttcctgtttgacaccactatcattttcccagtcttctgggcccttctctccctgataactctctgcacctgcagctgcatcgtgttctacctatgatgcaaggctcactgcctctccctaacaccaccactgtgaaccacgaaggatcctgtgttttgtgtcctcaaagtcaggtcccctgtggctaccgaagttcaaccacctacactgataaaagagcctcggctcactcttcccaagtgaattgtttctgttcacactggttctgtttttctctgtgaaatgaggaggttgggataaaccccagttgaaaaggtggcaggagaatgaacagatggtggcagtatcaccttggtcttgcccaagcttggtaaccttaggacagtcactttacctctcagtctcaggtgccttgactgaaaagaaaggggtttgatttgttaatcacagaggtctttatggacctggcattgaatgatttaaaaggttccatgtagctctttagagtacactaaacaaaacaaaaactatgatttactagaggctgtgcatctctttccagaggagtttcagaccaggaaagaggacagtagtacagtatcattgtggggcggtaggaaaaattattcaaggtcttttaactttcattcctgaggacagttagtgagggaaatgaactcttatgaggttgttaatgagatcagagcaaagatggctctttgtactcccaaactatgtttaatttcttaaactttagaaatggcaggttttaactaagtcagccagatgaggatgtgggaaccgagcagggaccaggatgagccaaagcatcagaatcacttacttgtgaaactgaccggcttctgcttgttatctgtcattttactccatattgaggtcagagtggtaaagctattttgcagtatacatttccttttgcttaaaagacatgagattatcaaaacaacagggaagggacgttactcactctcaccagtaattttcaaatgctgaaaataaatgtgcctagatatagtctccataaatatattaatgtgttgcatattccctatatagctatagttatttcttaattgatttcactctgcaatactgtgaaatcgccttatggaaatctgaaacataaaaagataccactttttatgactttgtagctatcctgttttcttctaaaggtattggttaagtgcattgaagcatgggtggtccacacagtggctcttccagacaaactaaattagcagaaggagcagcaaaaccagcagttatgcaaaatgtttctttttgttttctttaattgtggtaatgagttcattcaattttgaaagcttatctttgtatgcctgtcttccatgaaattttgaggtgtgaattcagccattcattgcttaagcttttattatttcagaattagggtagcattacttcttttccctcatcatccccttggagagtcaccatctagatgataatatatacttctatttatgtctttctcctagtgtccttaagccttaaggaaaagaaacaacatcaaaaaacattaatttttttccattgaaagctgatccatgtgtgtgctgacaataactttaatccctttaatgtccaagtgaggaggattgaaaactggtaacactttcattgatattttttaaatatgctcttatagcaaaaaaagtttgatatctttttggtgaccacttaaaggagaaactattgacgcataaattataaattctatggctttaaatattattttttgagatgaatgtgtttggggtagaatatgaacaacttaaaactttaaaatttccatctaaatttcaagtcttaaatgtgcctcttggttttttgtttgtttgtttgtttgtttttgagacggagtctcactctgctgcccaggctggagtgcaatggcacgatcttggttcactgcaacctccatcccccaggttcaagaaattctctgcctcagcctcccgagtagctgggattataggcgtgtgccatcacacctggctaatttttgtatttttagtagagatgggatttcaccatcttggccaggctggtcttgaactcctgacctcatgatccacctaccacggtctttcaaagtgctgggattacaggcgtgagccaccgcgcccggcccctcttctacacttttttcaaggtcggaagcagctcacatatagacaattacatcttcagccacttagttttttaatatcactttcgtttcataaaatgagctatgttgtccttacaattcagttgatggccagaagaaaatcagaccctttataaaaagtaggactttaaaaagcactggtgtcctattgtaggctgtttcacaatacacatagtaaaatatgaattttattgtttgttttgttgattgggaaggagatgggagggggtggagagtgacgttatagtttgaatttataatttgaaagcagagaaaatggatgaaataaaaagattaccatatgagtatcaccagatcctccctcccacacacacatacctatccccaggcaatctttctgtgagaatttaccttggtgtttaaaaatcacggcaatataaaagtgatattaaaaatagtatactaccactgtaagaagtatgacaaacatgtgagatcctgagaaactgcagaatattttctcattcaaagtttagtaccttggtcttatagtgtttgacactaaaaaacatagcaaatactcttttatatttagcctattccgtgatgccttgtttcttaaattaattcatgggcaatgaatgggggaggaaaaataacaacaacaaatatgccctggtgatatagtaaatgccactttccaacacttgctcgctacctaagaaaatcactttattttcttctctcatgcccagcttgattgcagagagcaagagagtagatggaaactgtggggttattttttaacgttatatcattaactccatccaacacaacatgcttaattccttgtttctcgtaactttgggatgaagtatggtgttttgttgcctgtttacaaaataggcgacagacacagaacataagagctgctacatatcatagaacatatcgagaatgccagagatttttcctgttttcttccacaagaccatgttaaactgtgtgtatcaagtttaataagagcaatgtaaagctacttgattacatttttatccacaacatgattttaaactaatgctattggccaggcgcggtggctcatgcctgtaatcccagcactttgggaggccaaggcgggcggatcatgaggtcaggagatcgagaccacggtgaaaccctgtctctactaaaaatacaaaaaattagccaggcatggtggtgggcgcctgtagtcccagctactcgggaggctgaggcaggagaatggtgtgaacctgggaggtggaggttgcagtgagccgagatcgcgccactgcactccagcctggggaacagagcgagactctgtctcaaataaataaataaataaatacactaatgctatttaccgtgaagtgtagtagttatacttcgtgcctcccagcacttgagggtttcatcattgccttacagtatttctcagaaaataacacattctcccctggaaattgttggctgactttagcaaattcaggccacctattcatttaagactgttgtgtgtgtttgattatctagaatgaattgccttaagagtctcttttggaaaagtactagcacagtgcccgaaatgccagggagtggaaagtcatggtctcggcggggaaatgactgcagtgttcatggagacagtgttttcgcttggctgacattaatgacaacccaatgctatgtgctcactgagtgttttcatttcagaagagcatcaaaaccactgagtcctttcaagtcgtcttcttttactgtgaaaccagaaaccatgccgacgactactttcagtaataacctgtgtcccaactgcaggctgaagtaaacttcttctcatataattttctaatttctgtgtaggggtagttgtagcaaacaacttagtttctttcagagcgtgacttcagaaagcgtattttcatgcagcagtgatgggtaatgaaatcagaatttccacaaagtctgccctaattgaacagcattatcaggaaaaataaaacatgagactcagagttttctcccaaagtcatttatgttattaggtaatgaagctgattttattttagcaaacgtactaggaggtatacttccacgtgaacattgccccttcaaagcagtcaactggaaaggctgaatgtccgtgcccataacgctgtcactgccaaaagctaatatataactcttcttctgaaatggctttcacctccttcagcaatgttttcatattctccatagtggccatagttctcctagaaaagtgagcttgatatttgaaaacaaccaatagttaatatgctgaaaaaggtaagtgaagaaaccaaaccaggccattttccttaaaaaaaaaaaaaaaaggccagtcatggtggcttacacctgtaatcccagcactttgggatgccaaagtgggtggatcacctgaggtcaggagatcaagaccagcctggccaacatggagaaacccgtctctactaaaaatacaaaaattacccagacgtggtggtgggcgcctgtaatcccagctactcgggaggctgaggcaggagaatcctttgaaccctgggggaggtggaggttgcagtgagccgagatcacgccgctgcactccagcctgggtgacagagcgagaccctatctttaaaaaaaaaaaaaaaaggaggagagggactataaagtacagctgtgtcttatctcattggcactgagagcagctgcataagaagtagctccaagtagtttggggcaatgacaacataagaactttgacgctcaatcctcattttggtgtcaaggttcctggagccagtgaatttgttggaagaaaatattggccactagctttcttctagaacattaatagagtggatgacaatgaagacaacaaagagcattcgaaggctatcatccaccacaacataggagcatctccacgcccacagtacgtgtcagttatccacattaccccactgttgatcgtacacatctttggttgtgtcagaactgctactcccctaacaaaatgctacgcaagcagtgagtgtgggaagctgaagggagggacaacacgagggaaaatcctgctcaaaagaacacagaatggtgactttcattgtcataatctgatagtaatcacggacaattctgacttcagccaccagttcagaaatcactaagaggcaggagagtttgatcatgaggccgcttggtgcttttactgcagtcacacagaattccctgtttccaggctcagcaaacctctgttacgcaaactcgggttgaggacaagggtgtgctggggaattggatgtaaattttagttgtgacattgaagctttccccacaggaagtcctttggaactatcattttattccattttatgtttaaaaatataaaaatgggctttattaaaatcccatttttttaaggtttatgagctgttagtgaagactatacagaactgctacctattttcctgtctctatctgtttctcctgggaactgttttggcttaccgcagatggaggaaaagagccacactggagtgaaatgaatgacaacattcccggagaagtctctcacgatctcaaaatccttggcccactggtcatttatagccattgctaaagtatttgtgaccagtttcctttagtttaacaattactctctcaatagacaagcatccatccaaataacaatttgtcctaaatcaaatccctggaatattaaaatacatcattagtttaggaaatctgttagttggccctcaaagtttttcattttttcttacataatcccttcttgctccccatttttcagttagagttgaataaggtagggcctagcaatgtcaaccatgatggagatgccacatagtatttgtcaggttagaagaagggtgagaaagcatgtagcaggtggaacggatggttccacagccccttgactccctgacgtagaagagactgaaggcaacctgatcaccacgttcaaaagttggctttctccattttaagttcttccttaaagcctctttaagcaaagtccctgaaatgatacagtagaaaaatcacacagacttatttaaaatgaattctatcactattcctgagatctcgcctgccccactgaggacattttgttttcgcaaagtgctttgaaatgtgataaaggatcttaaagaatatttgtaaaattatgcccaaagaagacattctttgaggttaacttgcagtgtctaaaagtcaagaatgaggaaggaaaggaaaataacagattcactttaaaatggaccacgctaattgggcagtgaaacatccttgtgtcacaccatttaccgtagcagaccagaagagggaaaaggcttgatttttctctcatagataccacagttcactctcaaaaacattcctaaaatggattgatatttctctgatagagcacctgttttgctactgacagtgttaagttccatactaatcagctcatctagcctaactgacaactcaaaaagctgattccaagaacaagaaactggcttcaatagaaatattatggtttattttgaagcgtggggacaggtaaggactaaacaaatttatctttgtgacatagtttaaagggtattttaaatgaataataattcctcataagtgctagccattcgtctcattgttggtgggtgtgtttgaggtgcggctggtttttaaaacaaatataccaaaggttatgaaccccccaaatattctgttccattcagaatttatttgtaagtctacgcacttattcaaatgatttttttctaaactttaattttctttttttaactcaatttcttggaattgctttcagtaactgcttcaggcctctttgaatagcagtgaaggcaaaatcagggcaagtcgtggtgaacagtttggcttttctggaacactgagctgacgccagccaccccactgggcttggttccccaacatctcacagcgaaggcacttgtctgatgcatattaagcttttatgttaccaccgggggctgcctcagaagttactcctctgtgtcctgatggtccttgacttggccttggactgtccttgacctccaataccttagacagttgcaggtgggaacagtgtagcttgaggttctaaaatgctttgctgatggaaaaggttttgttctgaaaagtgaattacaataggaaatggatttgcattactgacactatctgctgtgggctttgcctctattgatttaaagcaaaagggcacaattagtggccttcaaagagaggggaaaaaaaaataacctaactctgtcctagcacgttcaattaacttgtttactttgaagggaaaaaaaacttttatttttacatcaacagcgtattagcatggtgttgccttgtctcatctgtaatggcaagacatggttttgaaaaaaaattctcttcgtttcatagtagtaatgttattttctaacattaagcacaacaacaacaacaaaaaaaagcagggagagcacgaggggttcggtgtataaaaacggtgttctagctgccagaacttttattctggatctcgaagagaacagttcattgtatttcctttcctaaaccaatgaaaatgaaaaattagttactaggtagaattctcttccactttctatcccttttccctgacgagatgaaacctgctgggttttgccataaaaagaggtccctgttggggaaatgagagttcagctcactcttcacatcacagtgtaatacagcaggactggctctggaagattatgtagtgcagcactatgcctaagaacagaagaggaggctgagctctggagaaagagggtcacaaagcgttacaggcatttggtgaattttgctcactgcacaggcagttgtgagagcctccgaaccctgtagttcagtcttttccccactttaccagtgtgtgaggcctctctcccacttcctccacttaccacctctccaagatgccagcctcactgtgggctttccctagaaagaaacactggtttctttctatcgtgccctggttagtgttgtttctcacattaggcctctgtgttagaaataaagctgctaaactccatgtcgttatacaacaaaaggaatacagtgacctatccttcattcttctgatagttccctcaactccagctgcagcccctgccaaatactatcatccttaaaagatagacagtgatcccagcactgtgggaggccaaggcagctagatcacttgagtccgggagttcaagaccagcctgggcaacatggtgaaaccccatctctactgaaaaaaatataaaaaaaagccaggtgtggtggtgtgtgcctgtagtcccagctactcaggaggctgaggtggtaggattgcttcaggccaggaagtggaggttgcagtgagctgtgatcgcaccactgcgctccagcctgggtgacagagtgagaccctgtctaaagaaaaaaaaaagacagtgatgatgattatagctaacatttatggagcacttactatgtggtgggcactgatgctacaggcactttacttgtgtaccctgtaataatgagatagggctcgttttaaaggtgaggaaactgaggcacagagagattaagaaagtgtccaagttctcatagctaacaaatgtcagggtagagattcaaccccagactctagattttgcaaatcaaatctctacactttgtcttcaaggtcataatcaactctctcctttttccttaaaaaaaaaaaaaaaaaaaagttttcactttcatccttaattcctatgcagtgaagctaacgtaacaagacgaggtgcgctggtgggttctgtgtatcctttccgtgtccttggtgcccagtcacgcaggttctcagcaagtggtggcaggacatgcagctggatggactcgtgtgtaggcccacatgttgggggtggggggtgaggtgtatgtgtaagcatgtggggtgtgtgtgtagggtgcgtgtgcagtgtatgtgtgtgtggcatgtgtggtgtgcatctgtggtgcgtgtggtgtatatgtgttgtgtgtgtgtggactgtatgtatgtggggtgggtgcgtgtgtgtgccgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcctgtgtgccgtgtgtgtgaggtgtgcctgtgtgctgtgctgtgaggtgtgcatctgtggtgtgtgtgagcatggtatatgtgtgtagtgtacgtatgtgtggtacatgtgagcatacggtgtgcatgtgtggtatgtgtgtgtatgtgtggtgtgtgtgtgcctgtgttaccatttaagatggtagcagctattggcattaaaaaggacctgctattctgagctctggctttgacagtaagctgtgcccacagcagctgttagcaatcagagtgtgtttccatccgatgtgaaatgtgctgccaccacttgtgaaatggatttcaaaaccttgccgtactgaagtaccaaagtgtgtgaatggtatacttttactgcaaattagaaagattcacttattgcagtgataatgtcacactcactcactcaagctatcttaagtgacagagacacacattgccaaacagtggatagctgatagcagtgttttcaggacagtcatagaatgtcatctgaaatgtttgtctctgtaggcaaaagaagcaccttggactagaggagcagaaactgaaaatggaataggaaggacagtggtgcgggcctcgttttgatatctttacatggctgttgtgttcttactttgcctctagtgcatgacttacataaaaataagtggcttcaagataaatacacaggctatacatttcgttttcttggggaaaaaaatgacatttatgaggtgttatagtgtgtgcattgatgctcagatgtcagaccttcttaaaataaatctgacaatctcttagcttagtccagagcatttcttctccttatgtctcgcaactacttaaatccccaaagctctgctgcctctttctgtatttccctttcctactaagaaatagccaccagctcctgccacttccccttgggaataggcacagaaataactgtgcttcagctatccacaaatattgctatccattctcaggttgagcttatatgttgtaattaagaatggaaatgtttctttaatcagcaagtttaaagaccatgcatttagggaaagtcagaaacaagtcctcacgttgtttggtcattagtatgcctggctgaactggttgtcttagaaaagcattacaaaagagaattttttgaaataccattgagccacagttcagaaatacatctgtgatgtatttgaaaggcttagaacttgccatattttttgtttagatgttaatgaccatgtcctggaaactggaggtgaaggaactagttgaatttctaggagttctaattcttcaagatcttacaatcttaaagtggttaatatgaaaacatttacacttccgcttctggcaagcctaaataatttgcctgtgatttttaataaaaaccggatccttccctcatctctcatccaaagcttcatcctcttattaattctaaggacacttttttgaaatggaaaacagcacagaggtggagcagaaatacaggctgtgggctaattctcttaacagtcctcacccactaaaatgatctgtggaccaaggaagttttggtgtcatgacaccatgttcctgtgactataaatatgttgtctttttagtgttctgggcttgctatagagggatgtaaatgcattttcaaggtttaatgttctaagttatttccaatcttttaccatgaatccagtttatttagttggggaatatttcttgagtgacatctattcaatgagcagtagcagatcttcagaatgccatcggagctcatggaaagaaatgatgggttcctttgcctggtaagcttttatgacttaatctggattcttgttattttgacccatttctgcacatcttacttcatgcagctgggttttgtgaccgcacagttttggggggggggggtcatggaaattgtgcaggtggaattagtaatcaatggttgttaagaatttgtggggttatgtgaaatttggtgtgaagttaagacagctgcaaagtggagtggttttctcgtaggcttaggtgtgagaatgttgggggtaattggttaaagtaagattgtttcataaaatgcagtaagtgtaattctgatgttttcggttgagcagaaactagatcaccagatttggtatggttttaaagatgttcttttctgttgtgaaaaacagaccttgagcaatgaaagcaaagagttgaccccagtgctctcagctgtaaggaggatttcacctaaatgtagcgtaattgttcctgttaaggagaaaaaaaggaattggtatctagagtgaggttgatcgcaagaaaatacgtatgcagttctgtgagtcagatgactttttttgtctagtattatccagaattatgtaagggacaccattgttggaaacaacgttattaggaatttcccttgagcatagtctaatcacttagcaaaataaatgggttctctttcctgctgatatgaaatgacatttaacccaccccgagagattctagagaaagaggacttttgttaaatgttactgatcccagggtcctagaaaatcttcaaggactttatattttaaaatgtagttaattctagaatcttagagggaccttacgccaactgagaaccattggttaaatagccaattacctttatcttagcccttgatatcacataaccccataaatccttaacaacaaatacgttctgttgtttacaaaggcaaaagagaggaaaaacaaaaagaaaaaaaaaaggattgtattgctgatcctggtggtatcatttattgggtgagaacttacttatttagtatctgacccactggatgagtaggatgaagtattaggaagcttattctcttgctgttcaggtctttcactcaaggtttaaactggttaccaggtagataccaaaaaaggtatagagtcaactgccttaaacagtttgtgcactactatgtgataggagaattctagagagaactggatctaaaaaagccacccactgttcttctagatgaaaaatctgtttcctctctgatttgacagaatttccctgtctagggataaaagtgctcatttggatttggcttttagcagagatacatatgcatcagggaatgtgagtcagtttctctagaaagcttaatctagtagggatggaaatatattacaaaggattaatattcagttcccattgtcagaaccacctgcatattcacagaaagccacatgagaagatgtgcctggcttccttattcttcagagatttcctgcacacacagctcagctttctcttaattcagatggggcattctggcgcagtattttaactcttacacaactaagtctttaaaagactgaagaaaaatcgtcaaagttccaaaacttcaattttgtcttattttaaatttagttcacaaatgtttgatctcttgatggtttgtgtgtgtgtgtgtgtgtgtgtgtgtgtgtgtgcatttggcaggtatactcaacactttttattgaaaaatgttttttttaaagccattaagttttccggagaaattacaatccagttgaagtttttgagaagtggcttgtttagtaagatgcagaacattttttttaatggctataatttgatagactcatttgagtcagatgtcaacttaataataaggcttgggatgtctgtcagagggtgacatatatgtttattatgttaacaagtgggaatcgtgccatttccatgatgccccgacaagaccgtacaagccctagataaagctaggtcaaggactttgcatagagaggcgacctctccatctaagtgctctttttcttctaagttgtgaataagatagtaacatctggacccatcagtcccttgggaaagcatcttggaaaccaatgattaaaaaacatttaagtaagtctagctagcagatgagaattatggtactgtgtaatttttattctctttgtggcatagctggatatgggtaataggacacagcatcgcaatctttgccatgaatgatgtggcaagcttcctgaagcttcccatttatataggtttttcatcttcaaagagctttgtgagcactcatttaccaccacctgcctgggaggtaagaattattcccatttttatggatggaggaagtggaggtgtaagtgaattgcttgaggccacccagggagttcagtctcagagggagacctggaagggccaactccacctcttagctgaattgactcccagtgctttctttttggtgtcatgtcctcttgagagccccagatcagtgatggcataaatctaaacacatcaaataatcttgaataggaaagagacaccaagtctctctttcttgtggctatgtctacatcaaaaccctgggaaatctggacatagagaagaagccatttaaccctcctgaggctcattttccgtatctgtaaaatggggatgataatacctatctgcctcctttagggatgttgaaagcaccaaaatcaaagcaagctaacaaggataaaaactttgaaaactatatagaattctgcaaaaactcaggcattactatttttgccaaaaatgactgcgagactgcttactgaaggagtagggctttctatttggagatctaattgttttggtgaggttcagcaaggatgaaatactgtcatgaaagaatccaaaatcaagagaagaaaataatgtactagggaaacatattagtgttatatttaaaatgaacttagcagaccaagtggccaaacaagttcatcgttagtttgcataggatgcagctataactcggctctactcatccctgatggccattgaacatgcctgtgctatggaacatacccatactctattccaagccacaggtccaggtcgatggtctgttccccttccacatggagatgtaatgagagctctctgcaaacccttatggtgtcctggggcctcccatggcagagtggagagaaagcatgttgctccctgaactgtccactcctagcactatagagaaggggcactacccctggaaggagggtttgaaaaaagggagcttgtctgggtagacagattgaagaaaggtttcctctctccaggctgttgcagtcactctgcagcaaggctcacagccaggtgcatttcaacctctacttttgacccctcagctaggccgcactgggcagagcacaacctgcatgaccatctttagaagccctgaaacaagggggccacaaaattctagaagcctggtgctcctgaagtccctccagggaataaggtgaagactctgcagctctcccccggctaaccttgacacgcaagccaggccgccattcaggcagctgcagaagcctttaataccctggcagttttaaacaggggataaaataaagtgactaatccataaaggactcaagccattttactgaaaataaaatcaaatgccttagggtttttctttttaatctttattggtttttctgcttagaaaagtaatacatgctggttgtaaaaaattcaaacattagagaaatatctaacatagcaagtgaaaagtcctccatattctctgcactccagaaaaaaacaccatcaacagatctgtgtaaaagatagataggctttttaaagcactagtttttgaccgtttttgcaagacacacaaaattggttgacattcataagtatgacagacatgttctcataggtgtacccaaggttcggccattggccgtttcctggcaagccagcagtaaccccaccccattcagtccaattcaagaaaatatttggttgtgcaattgagctagagtgaacgatattattggggtaaccttgggtctatattagtttagtttttatgtgaaccaataaaaaactttaattttgtaaaacttttattagtaaccaattccctgtgacactcctgcaacttattgcaacataccactgtgttgtggcaaacagttaagcagcaatgttgtgaaggattgctgtggtagctggtaggaactgcctgtcatgttatttggaggataagcagcttttctctatccccacctcggaaagagcttaaagtctggaggaaagaatttcatttcactataaggcaggatttcttatcaacaacaacaataataataactactatttactgagtgccagctatttctaagaactatgtgatgggcatatatagagaatacatatataaaatgctcatacagatatcatatatatggtatgtcatttatgtatcacatccttgaatcttcaagtatgaaactgaggctcagagaggttaagtaatctgcccggccttaagaactgtcaaacgttgacattggtcattttagggttaaaattctaaccagaattttgtgaaactgagatcagtggcctagaaggttgatggttatttttagttataaactacggggataactcccagcaagagatgttgacatcaattcctgagtagtgtgttaagtttaaacaaactacttaggggatgtcttttgagccctggttagtgattgcttaataagagtgcaatgatgatgatgacaatgatgacagtaacaattaagtaagtgatgcctaccgcatagggtattggaggagtgagtgagatataatgcgtgacacattattagcacaaatacatgtagatattattattataaattagattattattgagagatcactactcacccacagaatgaagtactgggtgcctgtcatacaatttttatttttttaattctttgggaaaatgggcattgttctctggaccatgttatctcctaagataggtcctgaggaataaatgtcatcttaagaatgctagtgcccaagttcttgttccttttataattaaaaattcaaagcaaacttcttctagaagtgcagtgctaaatgacagcctagccccaaggaccacttggttaattagcacccttgcattccaggatttcctgatgcccgctgccacttgttgtcagctccttgaaactgcatttgcctctgcaggtgtggagagcctgcttgaattacacagggtgcatgagagagcaaattatttaggcaatagggctgaaaatgtgggcaaattagaatttttcatagcaagattgttcattgtgaagccaattcatgattatatgtgcgcatcttgctccagatattccactacacaataaacctctttgctgggatgaatatgtatgtgggctaatttaatcaatatacttgtgaacgttgacagtagtgctgtctgacagaactcatcctttgaaatgctggctgagttaatgtgtgcagtatatatatgggccaagattcataatttgtgttaaaagaagattgttttgagaagacaccacactacctggtgggaaactgaaaagcctacacgatgaaaggcaaagggcagagggatttttgtcttcctccttcttgttggactgaaaactcaaattgacaaaactaaactgcctccttttgaaaaatttgcaaggcattgactgcatttttttctcatggattcatttgaattctggaaattgactaaaatgggggatggagagggcttttgtgcattgttgggttaaatgaagggctgagcaagtgccctgctccaatctgcaaatgctcgctttctgggaatatcaacacgtgtgatcagatcacattcagagggtttgcttttggagtaggaggattttagtcatttcctaaagtgcatttgcaactgaaattgtcatctgagataagagaaccaagcaggaggaagcctaggagaatagtttaaccaatcagaatacctcaacttgctatccagaaacccttctaccaccttaccgagagattcccggtgaagcctgtttcaattaaatctgattctttagcccactggaactaagcacagacacatggggacaaagatctaagtgaatggcccccctgtttggaaatacaagtcaatctacagtgagtccatttatcctaagcgtcttggcctccacagatctcgtgactgtctccgctcaaatatcctccagatctgaaaacccctgcaagctgaagcctgactcaggccatcagtcctgtgtcacagtggcaccaaactctggggtctgtactacaactgctccccacccgcacccctaccctcacccctgccaggacatgagccattccaagggtggaagtgctggggccagtatagtactcccaaggccacccccatcatgagcagacctccgtgccaggcaggcatcttggtcacagccttaaacatcgttgcttcacttctaattagtaatccactgtgagtccaggccgactgtacaggaatactgcatatcattttcagtttgtccagatgcagttctactcattgttctcaatatgccctgcccagggccttcatattcttgtaaaggactaaatagacatgcttgatctccctcattgttaagatggaatgaagataactcttgaaaggcccaagtttagcgtcaggtagttttgatgctgacttaaatgctaggacctaaagaggtttttgttcatccctaatttctgtcattacaccttgaggtgagacatggacagaagcagctccaagtaggtcttcttcatttcatgtataaattctgtttaacaggtggttcaaggacttcatggtgcctaattattacattcctaggaatcagggtaaggaggctggttctcattctagcctactcaattcatgtagggaaaagcaggcaataactctcagctgatagcacctttcaggatttctctacttccacttggcttttccacgtctctgaaaaatgttaggcgtaactcgctttctctagagttgcagatctgtggcacaaacctttgccttgactatattaaacataatggaaggactgtgcagtatgagacattattagataccatatttcataaagaatttttcttgaagaaatcaagccaagtgttaacatgaggcagacttgcaaatgacaacttttgttgaatgcaaccttaaacatattaacttgcttaagttgcttaactcaaactatacctattagtgtccaaagtcaccattattggggtattagaaagcctccagagtatagaaaatacactggatttgagatctggaacaatctctaaatttggacagcaaagaaactcagtatgcaagcactaaaaaaataatggatagcttttagaatagcttgcactccctaaaagtcaccacagtacttgtattaggccctgagaaagggagttagcagtacacatggtttataatgaggttaaatccaatagtttcatgtgtgctctaagtatcgaatgcaacatcaccttaaatccaaagtaagtggttgtgaaatcatcccaggatatgggattacattagaagaaagagtgggctgtgtgtctctgtgtggtacttacactatgtgacatattctttggacaaagaaattactctgtgtaaggtctggggctaggtaagggctgtacagaaatgaaatagacttgggcacttgcagttgtgtttgtgtgtgtaactcagtaggtaatctaacatgatacccagtagtgaaaaccatggaaaatgaatttagcgtaatgacacattccaggtaaactggtgactgttcccatcctgtctatacagctcagcattggtctttatttcacatataaattctatttaatagttgatctaaggattttcttttgcctaattattccttattttttatccttaattatgctctttttaactctgaggtataatgtgtttgcttagaaatgtgctttgccttatttgagaactttggtgtgatacatgttatttgcgggtcttccagcatgaggcatctttaagtaatcagttgggtagaaacacatgccctctgtaccaggaactaaatttccagtgtaaagaactcagaagcaacacatcctatttgtcaggattcatcattattaaattcaaacaagatattaactctatggttgaaaggttctgattgtacacaaatggactaatttttaacacatggcaactgcgttaattttttaaaagataaggaattcttaccatcatatgtaactgattaatattttgaattgaatcattttcctaactagacctgactttttagagtgtatttttctttagcagtcaagctgtaatgctcagccaagacagatttatgatcttttaaaaataatgatagaaaatgagattggaggaaacatttcagtatctgctttgctctgaggcctaaactgcgaactctccagttcttgaaggctttgaaatgctgattccagtcttcttgtgggttcttaaacaccttctcaaatgacccattttaataacccgaaagctattatataacgagcagccataatttagtccagggctctagggggaccctcacagttcagcaatgaatagttaatgcagtataatgtttagcaggttattagttttcactatacaaatgctgatcagggaacgcttttataaggtgtttaaaagaaaatgtaattaactggttgcgtgcttctgttgcagctcaaattgaaattattccatgcaagatctgtggagacaaatcatcaggaatccattatggtgtcattacatgtgaaggctgcaaggtaagcctttttaattgttgttgtttctattaatgtttgttagaatatatctttgtgatttgtatgtctccacttatgtcttaaaattcaactccttagaattttgaatgataagaaattacaggatagaagaaatattttggtgttaaattacaattaaagaagttatatatatttttactccttccttcaaaataataggagattacaaaaaggtatttgagcattgcttgtttatcactttcaaccccagagttgaactcatgagcaatctctgtggcaatcttttttaaaaaagagctaactccagacttctacaatgtccctgtcataagcttataaaaagacatctccagtaagtttaattggaatgtcactgagttgagtcttattgttagcacacataatgttaacacatctggcaaaattgtgggaaagctatcaggaagacctgagttccagtcctattgcctccacttgtccatattgttttgaatgtgtcttaatctctttgtcactcagttgcttcatttttaaagtgggtataacacctgatctttctactggttaggactattccaagaatagaaggagaacctgtacataaaaaagtccttacaaacagaaaagtgctatttaactctaaatattatcagtattatttctgctatgactattttattatttctgaccttggtcatggggcaatgtgtacagcacatgcataatgtgcagatgagaaacagagatgtttatcccaataattcaagaccccccaagcccagattacctctgttattcaaatctcaatttattaagatttaaatcctcatgcttatattggaagggcctcgagacagcttacaggataaaacagtgcaaaataaacaggagagaagctatttaaacatgcaggaggcctttgagacagccgattgctacaaccaggcctgaatcagccctaaggctttttgaggctgaggcaaaaaataaaatccacgaatttggttagctttcctttcatgaaattagaaaatacaatgttgtaaaatacaaaatcacctatagacacaaatgactactgagagacttcaaggaaattaaccttataatttccttaattcttcattttactgttagtcatggtaacatttgctaatttgtacatgtacagatgcttcatgttgatcccatcttagcaaagcttcagatttccgcatactacagaaccatctatgccctttacttccaaaatctgccctccctcaaaattagttgactaattaaataaattaagcaaaatgagaggcccggtgtagtggtgtgtacctgtagtcccagctactcagggaagacagctgcaggtttatcacttgagtccaggagttcaaggttacagtgagctatgatcacaccactggactccagcctgggcaatggagtgagaccctctctccaaaaaagtaaataaaaataatgaaaaaacaaaatgaaataatctgtctggtctgtgccatcccaggttataaggtgagagtgatctgcctgtgaccactgtcatcgcattgatttttggagctgatttggctgacgtggccaggtagccattgcttttcaccctcaccctgtcttgtgttctgcctcccaaatctgtgtccctggtagacatgtcatggcctttctcaatagagggtttatagactgcagtgcttgcctgctgggagttccagtgctttttgtgcattgcgtatcacctgggtgtcttcttaaatggacagggttctaggcagcatcccggataccagttcaccatttgtcccttcattctgcccaaaaaactgatggcttcctctgaatctgtcagtaaggcaagtgattatctaggaattgacagaagtgattatctaggaatggagtctggggaaaggacaaggtgggggtaggggctacttcatatgaaataccccaacaatttggaagattaattaagaacatgctattgagtaaaacctaagttgactgagtaccatggcacaaacaatgtgaattttctttttactcttaatatttatcatgacaaaaataaaagcgataagaaaacaaaaggtatctattattccaaagttgccatttttctagattcccttccagatcttgtctgcatacctcctcagtgccaaagtggttttcagttatctgtggctctgttcctctgctctgttgactttatccaatgaaaaccacaaaataaataaaacataattttattaacagattgggcctatgcctagccagggacttgaacaatgttacatgtttatatttgatacatatactctttgttctccattataatttctctctgctataactaacacttttattcctagttataaaaatagaagtcaaaagacttctatttttgccattttatgttaattatttatcatgttctaaccaggtaaaggtggttctatcatgatcaattgtaaataactttgctgagatagtgtaattaaacataagaaaaatttcacattagacatatcaaatagatatctaatgagagaagaaaggtgatcagtcatcttctgagctaatcattttgtgaacgtattttaaattgcatttttaaattaacaagctgacaccataagaaactagaggacctgtttaattgctgaaataattattttggcacatagttgctaagcattgcacatgaacagcaaaaatggtagaagctttagtagctctttctgtcatttctggctgttcctagttcatcctctccccaacccctttgctgtctgtagagagacagcaggtgccatgcttctgctctgactctggaaccagactgcccgagttgaaatcccagctctgctatttaccagcttgagcacctataccactgctctgtgcctcagttcccccatctgtaaaatgaggactgtaattgtaataacttcatagggttgtcacatgcatttaaggaaagtacctggaagaatgccagatgcatcacaagcacttactaagtgttagctgttgttatcattgtcattactaggcagacttcttggtggcttggtaatgctgctctgtatagtcagatattatttctgggacatctatggatatagtcttgattgttgtgaccatttgcaatgtgttatgtagaatctgccaataaaaaagaatactatgagcactcccttgggaccaagcactatgtaagcactgtaagggatccaaagacatagaagaccacatctttccctcaagcagtttatggtctagttgtagagatgaggcctgtgtagggaaagctaaatagcaatgcaagaactaatatagagtaaggccacaatctatgatatacataagaagcacatataggctgggcacagtggctcacacctgtagccccagcagtttgggaggctgagttgagaggaagatgtgagcacaagagttcaagaccagcctgagcaacacagcaagactctgtctctacaaaaaaattaaaaataaaaaaaactggctaggcatggtggtgtttgcctgaagtcccaactactcggaaggctgaagcaggaggattgcttgagcccaggagttcaaggctcctggtgagctatgatggtgccactgcattccagcctggcaacagagcaagacccctgtctcaaaaaaaaagaaaaaagaagcacatatccactagacagcatacctaggtggtctaaaggagagttggcctagcaaggtttcattgaggaggaaccaaccgtgggctggagctgaggaaggattttcccagtcaaggtggctgggagggcattctgtgctgaggaagaaggagaacaaggaatggcagaggcaaaagcccagaaaaagggcagtcttggttgtatttaggggacagcacataactcagtttgattgaagcaaagggtcactttctgtggctagtggaagatgagggtagacaggcacaccatcctcaaatttttaaggactccattatgccaaggtttttattataaacgtattttacttgttctcttgaaagaatcagggaacaatgtattggcactgcttcagcctgaatattgcatttcggaagaacatatgttagaatccaggcctgcaaggtttttagttctgttcatacagacatttctgagctcttggaaaagaatttagtttcagccttgggtgagcatgatgagggggcataacgtgagctggggcaggcctgccaggaaggaggggcaggtcgtgccccatgccagcacaagaaaaggccatggtaacactagaggctgtagatgttaaagttcaatcttcaaagtgaataaaaatatgaagtgttaggaggaaaataatcattggttaaggtttgcttttgagaaatcatcttgtttgccattcaacttctgttcctaatttcatcatgagatacagtggctgctcagatgatgagggtgaacatttgatctcaagacacacatacattttttaatccatatccttttagatattttggctacacaattttaactgcaagttttttaatgataatgcacgatccagtattggggttagtgaattggtttctgattacatttaaaaccttttcctcttgataacactaagaacaaactggcattcatttgtccaatatacacttaccaatcaatacatttaagatgatgtcttattcaaagcttcctcttctacccactaaagataatttgagacaatgtctctgcgttaacaaatatattttcttaaacaataaaaaaggcttttcaaaaatatctagagtatataagtgacaccttcccccactgaagtagttaaagccatttctggagctttttatgtttaggttaaaaagcagctttatatgaatgttccttttaggctcaaattatcttttagaggattctaatattattatctcagttgtgaaatgttgctagtcgtgaactaattctgtccacttttcaccattgatacattcatgctcatttttattttaatacgtggccccagtattagagctgggcatttaaaatgaaaattccacctgggggaggacaagctgttattgcatccttacgatgcctgagtttcggttctgttatacacaggcagtaagcgaaaatttttgtttagctaaatcttccagtcctgtgatgaaatgcgcaagtggtagggctgtgttaaaacccaatttgcatcaagatgattcagatttttttttatttgtttgtttagatcttaatcatgtcccagtaactgctgcccttcctcagctcacagaaaacgcctggctcgaagccatgttgtagatagggccctgacacagcacctggcttggggcaggtccctcgtgcgtgcttgggaataaccattgctgaatgtcttcacttgtattggatctgagtatggcaaagcacagtcaaaagcagatatcgacacttaccaaatatgacacgtgggcagctttaatcagagaccacttgcgcatacaattctacagggaggccagtcactactgaacaaaaacgtagctcaggaaatctgaatttctgtgatttattgctgccagatgtatgagtatagggctggaccagctaactttcgtgaatgaggccgcctgctctttctaaagaacaactttttttcctcatatgcttctttgaggactcttatttctgacccccacccaactttaattttataatttcatctgcttgattttaatccatgcatgccctttatgtttacccctcaataaaatgaagttatcctctttttccccctctagccagataattaacttttggcccacactgatccagagatatttcttccttctcacccccatgcttctgaacattctcaacagaaagttgccaagataaataaaattgcaacacagtacatgcttctacatagaagattctctgcttttctcatctctacttttcttagtctcagacgtaaaatgaaaggtagacatacacccacttcagcagtcccccaaattccaaatttttagttgtactggaaaatacaataatttgggcaggcatacgagcattcacaataaatcacagagttatgaataaatcttggttgtcaaaagcaagtgtgtagccgttccaaagcgtctgccattagaattcagcaaggcagctgtcagctgttttcttgtaattaaacagccaatgagcagctaattaagacatatgtgtatacagaagtggaagtgggtatgttaatgaactgtaggaatcaattcattaagtgaaaattgtcaaaagaccaaacatcagatcagcatttcagcctctgtttcactgagaaggagccccacacaggaggggacaactcagaatcagacccccgttcaccttcccagccacacccacagtgcagcgtccagccagcccatgaacttagacaaaactattaaaactccagtaggaagtgccaggcatatttccaggcttttaaaatttatctgacaaatgagtgctttcctacctgtatggaaacctggtatttgataccctataaaatgccatctccctcatctgaaccattgtagggaactcggactacagaaattgaaaagtgtttttttgcgtgtttgttttgttgtttgttcatcttttgttgttgttgttgttattcagtcggccctacatgtttgtcttggtgctttttaggtggtgtattaagaagtctatggcctttggaataagatacacctaggattcaggaattcaaatcctgggccctccccttacctgctctgtgactttgggcacacggcttaacctctcttaagtttaactttctcatttgtaaagcagatatacatatccctactttgccaattgtaggttgttgcggattgcaaataatgatggcaaagtgtccaacatggtgcctagtagggagcaggtgctcagcatatcgtcaccactgtttttatcactgccaccattttttcctctggttgttcaacaagtatttattgacttctctaagtattgggttagctactggaaacaaagaaacaaggcagtcaggccctggaaaaggtagacattaataatacaacaaggtaagggctaggagggggataaatacaggactcttaaaggtacacatgggaggggcccctcaaccagctttgagagggcccaggtcagagaggttcccagagcaaccgaatgtcttctcagtgaatcctgaagggaaggagagagtttctttggggaactgtggagatagaagtttacgcttggtcattctatgactttgagaagagctgcccggacatgtggtcattgcctggtcatcagcagggagccattaagggctcatcagcagagaagtgacgtgatcagtttgatgttttagaaagatatctttagtaactgtgtgaaatggattggagggaatgagaatggaagcaggggtcccaattggaaggttgtataataaccaactcaagaagtgaaagacatggaaacttaagaaaactgcagtaaagatggagacaagtagatggatctgagaaataggaaggtgccaagaagcagcctaacttggtgatgcttgaatatgggtggggaggaggcagagattaagtgaagcccatctttctgccttgagtaactgagggaaagatgatgcctgtcactgagcaagaaaacactggagaggacagctgggaaacaggctgtgggtcattctcttctaggtcgggtgcagtggctcatgcctgtaatcccggcattgtgggaggcctaggcagaaggatcacttaaagccaagagttcaagaccagtctgggcaacaaagcgagaccctgtctcctctacaaaaaatttaaaaattagccaggcatgatggcatacacctgtggtcccagctgctgagaaggctgaagtgggaggatcacttgagtccaggaagttgaggctgcagtgagccgtggtcactccattgcactccagcctgagtgacagagaccgtatctctaaatatatatattctgttccagaaagtcaatgggggctctagaaggccaaaccacaactttgggtgaatgcctatccaaagtcagggggaagcattgaaacaacgtgatggagagctggtgacacagcaaggatgaggctcaggccagccacatgctggtaagctgtgaacaactggctctctggaaagcaaaaagtgtctatctgtatgtagataactttggtatctatctcattgatataatttcacataattttcaaacaataataaaatatacaatattctttattttaaatttcatatagacaaatgattctcactgaatgctctcatgatttttgctgaactcctacatctatctgcatggttacaactgaggaaagactagttccaacatgaatgttggttgatattttgtttacattaatgactaagaagggagtgaaacaacaaagacattttggaacttcattcattcgccaacaatgacatgaaccacttccttgctgactcagttaatagttttcaaataccagaagaacatttcttccactttttatgttattcacaatgggagcactggatatgatgtactgttaagtttaatctgcattattataattttcatcagtttttttttttgtgttttttttttgaggcagagtctcgccctgttgcccaggctggagtgcagtggtgtgatctcggctcactgcaacctccgcctcctgggtagctaggattacaggcacctgtcaccaagcttggctaatttttgtgtttttagtagagacagggtttcaccatgttggtcaggctggtctcgaactcctgacctcgtgatctgcccacctcggcctcccaaagcgctgggattacaggtgtgagccaccacacctggtctttttttttttttttttttaagacacagggtctcactctgttgtccaggctggaatgcagtggtacaatcatagctcactgcaccctcaaactcctggctccaacaatcttcccacctcaccttcccaagtagctgggactacaagcacatgccactacacctggctaattgttttatttcctgtagagacagggtctatgttgcccaggctggtctcgaacacctggcctcaagtgatcctcctgcctcagcctctcaaagtattgggattacaggcatgagccactgcattgggccatcaccttcctgcctcagcctctcaaagtattgggattacaggcatgagccactgcattgggccatcactttttaaatctagacaataaagcaaaataataaatcaaaccctgatctgtaacatttgccaatttctgtggtgtaaataatcccaccaatggccattttcaagccacccgacccgctctttcacagaatacagagtagggaagggatgcacagcatggtatagtatttccaccttcagatataaggataattgatgtagacaacctgaagaacattgataacagtaaaataatcattaaaaagtagttaattttttatgtcaggaatgcatcagttaatgtgtaataacagatttaataactagccttaataacaaaattcctgacattttagcactcagctcttgcaacctggtatgagccttctcctaaacaccatggcctctgtcccagtttgccaagcgcccatctaatgggatcagtgaaaaattcatagtatacagtcattttttttaaagaaaaagtattagggaatagaatttccagagaaggtaagacacgtatcagaaataaaagcacaaggcgttttgaaaagctaggtgaaataagggaggaacactggagagatgtctttgagacagtaggaattgaaacaaaaggtggatatgtagggactctgtgtcaggaaatcgagaatgtgtgacattgttttgtttgtcccacaatgaagaagatacatataagtaagagggcactggacttaaaatcaggacaagagattgagtcccagccatgggaccttggacaagtcatttaacattctaaacttcatttttgtttttggcaaatcagaaaactcgaatcaatctctggttcttaacaaaaggaagtcaaagtcttcggggagcttttaaaaaatatttactataaaaatgacaattgtggccaggtacggtggctcacgcctgtaaatccgagcactttgggaggccgaggcaggcgaatcacggggtcaagagatctagaccatgctagccaacatggtgaaaccctgtctctactaaaaatacaaaaattagctcggtgtggtggtgcacgcctgtagtcccagctactcgggaggctgaggcaggagaatcacttgaacccaggaggcagaggttgcagtgacccgaggtaatgccactgcactccagcctggtgacggaccaagactccgtctcaaaaaaaaaaaaatgacaatttttttcttttttgacttataaaaatgggaatttctcattgttcaaactactatgtatgcctggacgacatcgccaaaagtttctggtttgatatatagttctggtttgatatatctaaggtgtatcttttaaaagctctgtgggtgtttctgatgcatcacctaaaagtcaactgctgtacctgataatctctcaaagtctttcagcaccaaaggcctgtttgttttattctaattttctatttgcaatagctgcatggtaatctgctgccactaggtggtggtagtgcgccacagtcacactaaacgtatactacctgaaatgtatcatggtggctctctggctcaagctcaccatgtttgtaaatgaacatctccatgtattttaacatccataaaaagtgaacttttatgacagccaagtaatttgttagcttatcttttagaaataacaaaattgccaaattatgtacttgatacctttcccagctcacaacttcagcactttttttttacgcctcctcagttccacccaaaactccatgccctagttttgtgcttcccctgctctctgtatgacctccaatccctggaattcatctctcagctcactcacttcctaatccttttgcaggatttctccccaatcagacaaaatctatctctgtacttagaaacacactacttctaccttgaggtaggaaggtacctaccacactttctacttttcttcttcctctttctaatccttcttcctcttatgtgttatttaactcttagtatcttatctgtttaattttccaaacccttaatcctctgagaaccccgccccccaaggaatactgaaaagaagaggtttttaaaaagaaaaagaagcaacccaaaccctcattcttcctgaaatgcaaagttcagtattcgtctgagtcatggaggtttactcaccctgtttctcccttctcagctctcaccttataaccccacttcacctctcgcatctgatatttgatagttctccttgtgggtatgactctgttgacttaatccaaaagaaagatcgcctttctggttcttagctatgccactcccagaacttttcagcaggcatttgttcagctgacttagttgaggtataaatgatgctgtagagaataaggtgtgtctgcttgcgtgcctgctttccccaaatcctcaaaactgagacttccaaataagggtaatcctcttccaagcagatagtgtggaagctggacattggttcgagccacagtgccactgctcaaagaacatacggaatgcttcatgagtttgccttgcaacttatggcataattacacagacatctttaatgatagttattctgtgcccttgcagtaagtttcattgtttgtttgtttgtttgtttgtttgtttaaatgagctagagtgatttagaataagtaaggtgaagcaaatggggcagaatacttctggtcagaaatgaggaaaaatgatggactcatgagactgattttcttatgtgactcctaatccagatcaggaggcaactccagagagagatttttgtaaaatgtctgggcggtaggaagctgggtcagctaaaggtgctaaagtgagggaaaacactaatttcagagtagattgctcttgctactttattctgcataacttgttttttacactgcctaatttaatggttgccccatatgagaacaactaaggaggaattcttttgacacacaagagaagcagaaaaacaaaacaagatgacagtgtaagttctggagttaaactatgtgaagtcatatcctggctttaccccatgctacagcgaggactctgagcaagtcactacacctctctaagcctctgttttttcagccttaaaaccaggggaatgataggatttgcccaatattgcccttgtcacaagtgaatgacacaatccacataaagcatagagtgcctagtatgaagtcagtgctgttttaatggtatttgggatttgttttaatcaggtaccataagacacacagatctggaaatgactgtcatgaaggaagaagtttgttacacagtagtccccccttagcctcatggggatgcctgaaactgcgaaccttttagataccgttttctcccatacatccagacctgtgataaagttgaacttataaattaggcacaatgagagattaacaacaataataataatacagaacaattattaaaatatactgtaataaaagttatgtgaatgtggtctctctttgcttcccttctctctctcaaaatatcttaatattcttttactgcagttgacgcaagtaactgaaacgaggaaagcaaaacgacgattaaggagggagtgctggactcacaaatccctagagacagggcccatgccacaccatacaggggacacatggggaagcgccagggtcagtgaaggggagagggatgtggggaaacactgccaagagcctccatggtgttttccacaggaaggaaggtgcagcaggatgagcaggattaggataagtagctagtctgaatcattacagacggcgctaggaggtaggggctgtccctaattgtcttgtacctagccctagggtgaccagggcaggggaatcatggcgagaagcgtaagggcctgatgaagaaggtgtgctgggtgtgggctctagcccacttggttttgtgtgagaggtggctgacagcaggttgtttgctgtatgtaggagttatccagccctgcaagggcagtccctccagtgtctgcaaagcccgaagatgtctgcatccaaaatacagaataaaaagatatggttactacaagtactcagtaagactgataatctgtcatcatcatcctcatgcccttaaagcagagctaactgatgattaatatatgcttctatgttaacagtcttggactttattaatggtgggtggaagttaacttaatgtatgtatgcaaactaaaaagtggcatccttttcattaatgacccaaccattattcaagagctatgtctagttagggacttcagacttttgaaagaaatgaagaaataatgccagatacatgggctcgcacttggaatcccagctacttgggggaccgaggtgggaggaccgcttgagcccaggagttcgagaccagcctgggcaacatagcgaaaccctgcctcagttttaaaaaagaaaaaaagaagtagtgaagaaattggaaaggattctgagaagaaatatgcaaggtggaaaagagcctagaaagaaaggtgacagatgctgggatttggtcgtcagaagagatatctaggaaatagcatggcagccctcaagtactagctccacttaaagaaaaaaagaagagatcattcagacattcctcatattcggtgatcacacaagaaactgtagcaggcttaatgtgaagcaaacaaaactcaacttcagctaaagcaaaaacaaatacattcctgattttaagcatccacagtgatgcctttacacaagggtatgaacggtgggagagtctcaagaaagagataaacacctttcagcttggacagagattatgtgtctcaggggaaaatgaatacctagacagctgacctcttggtatctctttctaaggattatctgcctctgtgaccatttatattttcttgaattctctctagtaagcccccaaagaaagccttacttcttcttacttccttttcacaggggaaacagacacacacaaacaataaaataaaataaaataaaaaacatagctttagatatttttcagaagagagagattgctttacagaagaggcgggacttgatcaagggtagagttaaagtacaacagagagacagtctgagacatgaggcccccagccttgcccatgtcaaggttagcaagcaccttggctgaaagcaagaggagtgagaagtcagggtcctgccctgtcccatcccaggttggattttccaaagaactggaaactgaggtcatatacatcaacttggttgacaaaggcccccagccattacaaaggaaggcaggtgcacttcttctcaagctgcccaccataacttcccatctgcctattgtaggggggaaaaaaaaaaaaagcacagatgaacaaaaagaaaaataaaatctgattggccccaccaactactgccaacaatttggggcataattttccaaatcttcttttatagtaaatatatgggtgtcctttttttccacaaaacttggattatactatgtttagctctttagttccttttttaaacattcaatggtatatttttatcaccttttatatcaataattatatttctgaaataccatttgtagtggttgaatcccattgtatgagtatacaatatgactcttttaattcagtaatgttggacagttaggatctttctacattctctatattatagatagtactgtgaagaacacccttgtaggaaaatctttgtagcattctaaatatttctttaacgtgtattccttaaaagcctagctcagtgggtaggctttttaaaaatttttgatacaactgccaaattgacctccagaaaaatcgttcagtgggagagcacccttatcagtttgcctaccactctgttaattctttaggattttacctctccccactagtgtcgccctcattggggtcatctatcttcacaactaaagctttgaaggtaataattctcttttgtacccttcatggctttgcttcatggaaatgactctacttaccttattttttttctgcatacatccctagcttgcaaagccactgaaagataaatgagcaataaaaagataaaaaggtggatcatgcctgtaatcccaacactttgggactccaaggtgggagaatcacttaaggccaggagttcaagacaggcctggacaacacagcgagacccccatctcgaccaaaaaaaatatataaatatatatatataaatatatatatataaatatatatatataaatatatatataaatatatatataaatatatatatttaaaatatatataaatatatatatataatatatataatataaatatatataaatatatttaatataatatatataatataatatataaatatatataaatatatataaataaatatatataaatatatatataaatatatataaatatatataaatatataaatatatataaatatataaatatataaatatataaatatatataaatatataaatatataaatatatatataaatatatatataaatccaatatatataaatatatatatgtatgtatgtatgtataattagccaggcatggtggtgtgcacctacagtcccagctactcaggaggctgaggcaggaggatggcttgagccgaggagtctggcctgggtgacagagcaagaccctgccccctcccccgaaaaaaagcccccatgtgtttggaaattaagaaatatgcctctaaatcacatctggattgaagaagaaatctattgaaagttagaacatgtttttcactgaatgagaatgaaaatactacgtagtaaagcttttgggttgctgttaaaacatcactaaaaggaaaacttgacactctaagaataaacagtgaaaatcagctaagaatacagctcaggaagttagcaaaaacaaacaaaaataaagttattgaggtcagtagctccttatacatctttgtatcccctctcatttcccaaacagcacttgacacgagaggaacttgatgagcattggactggatttgttccatctttaaaggccatggttctgaacatgtggtatttctaaactgccagggatgagggaatattcccaatctgatctgccaaaataatccctccaagtgttatctaatgcttgcgatagcagattcagacttggggagtgagaaacgcctaaagggccgtgtgttgaagtgggctagtgaagattaccatggttcaccaggttcacagtgccctaggttgtggtgtggctgcattttccttaacttggatattccagggaagtgttttgtatttattttacaaacaatctcttagagataaaggctaaaggtaagtccttttgtatcattccatcaggcacattgcttttgatcatcagaagccaagaacaaggacctggtcctgtgcctttttacatgggcaactgtctgttgaagttaaagaaagttttgcaggtataagggatggaggattaggctctggggatcaattttactcaaggaaaaagaagtgactttaatttcattaatggtctcctggatgattctgctacaagtttaattctccattaaatattaatgccactcagtgcttagcatcctgcctttagtatcataccactcattctgacactaacctgttttatattttataaccatatcacagggctttttcaggagaagtcagcaaagcaatgccacctactcctgtcctcgtcagaagaactgtttgattgatcgaaccagtagaaaccgctgccaacactgtcgattacagaaatgccttgccgtagggatgtctcgagatggtgagctctcacagcttgagttgtacagttgcacggggttgtgaaagtgccttctgaaacctggactcagatctgccaatatctgccccgcctgccccctcctcattattccaccttacgccccgccccccatgctcctctggcagctacatggaactcacagcagctgcttcctcctcctcctcatcctcagagtcagctggctggctgatgggtgggggtggtgtggaggagaagtgtcttgtgctcagaacaccttcagatttttgatatttcagccattataggtgggtcgattgactgacggtaagtgtcatctgaaggccttaataaagatgtctcctctaggcattttcccctgcaggaaatgtgaaccacaactgttacttgctttacactagtaagtctattggaggttgggatgaagccgcttttatgctaactggatattttgaatcacatgccaaagccaaatatttgtacatacagaatgtgtgaaaatagtgcaaagcatggctcaatgacaagtgttcttttcattaaatgaagctactttaaggaatagagaccgtctaccattcaagtacaaaacatttcaagatcttcctggaaaactatcttaagtgcactgaataatcaacaccagatttcaagacagttatgcttatacgtggaaactgggcagaaagcacagcgggtccattttaaggatttttccaaatataccagctggctctcttaagagatccctttgaaggaaaatgtctcctccagtggaatttcagcctgtggaaaaatacttcagaatgcggagcaggctttccaacagtctgccttccccataatctgatgttcttagcgcctgtagatctacataggcacgagttcacttttgttcctgcgtattctaagaggcactctgtgcaccactacaaaagtgaagcttttgacattggaagatacaaatcacagaacttccaccatattctcagaaattcctgtgacatgcaactctgcagatttcatcttccgatggtactaaactgacaaagttaggtatatctcatcaatttgtaagtttaaatcacaagttgtgtgtgcattttctcaagagctggtccctttatttcacttacaggatataattactgtcgttaatattaatacaaaagttaaatcataattgcggagtcacagcagaaagtttcacctgtgggtattaggccccttgagtgtcctagaaaatttttttcaaaaaaattaagcaccttcagtatgccttctgaaaattttgcatataagaaatagcacaagttgttgtaggcatagaaagaattctggaggttaagaaattatggttctgaaattcagatcccacatcagcctggttgctgcctgagcagccccacccaagtttcttatctgagttgtggaaactggaaagtgaccagtattccagctcacctgtttcctctgtgaacaaggacagcgcgtcctctttggcaagaaaagaattcaccacctggccactgtgagggccttggttcccaacttcgtgtccatctatcctgcctcctgccctagactcttataactacgatcatagtcaaatgggtgaatgcatccaccccatcagctataaatttaaccacaatcaattaggagaactaagtccctccagcaaagactgagtctagctgaaaaataagtgagttcatggaagaattcagaccaggaaatcatagggttttttgtttgtgtgtttttgttttcagttatcttggtgtttcacaagaattcatttgatattctgaatgaattggaaagttattcattatagtgactgctccactttaaatatggggacacatcccaaagagaagcattacaaacagaaatctgcccaacaaggatcatacattataaggatcttatattataataccatatttgtcctttccaaatcctgatgctgtgattacttgaggctaaatgggaacagcagaaagtgtttaaagatgggtcctactgggagtggtagctcacacttgtaatcccagcactttgggaggatgaggctggaggattgcttgagccctggagttccagacctcaagccagggcaacatagcgaaactccatctctacataaagtgaaaaaattagctgggtgtggtggtgtacacacgtggtcccagctacgtaggaggccaaggcgggaggatcgctcaaaccttaggaggttgaggctgcagtgagccatgttcacatcactgcacttcagcctgggtgacagagagcaagactctgtctcaaaataactaactaaataaataaaaataaagatgggtctcagggttccacaggggctgccatgacccatgacccatgactggaggagggggcttcttaggtcaggtactctgatgtaattcaaagaattacagaggcctcatccagttcattcagacctcacaatgaagctgcagaagtggccatttgatcagggagaactgtcggagcgtacaagacggtgaactgaatgaacgctgaggtttgactgcttattccttgatgaaccctgtgagtctttgcttccctgtgccttggtctgaacgtgggagagaaagaggtagcctaagccagctgcacggggggagagtgaacaagcccattaagttatcagtggggcgcagtggaaacgggggatgtgacagcagggaaacagaagtggcatctctctgggcccctcctacctgcaccaggcctctttctgaaacatgagtttctctgggatgtgtgtttgctgttggggagctggagcgagtctgtgtgggttggaactgttttcacctctgaatatgtccttattttgtggtcatgcagttttggattgagattgtgtgagacttcaaaggaaaccccaaagctcgcaggagagaatattgaagaaaagcgcattgtatgtagtatggtttggcttttttcttccagctgtaaaatttggccgaatgtcaaaaaagcagagagacagcttgtatgcagaagtacagaaacaccggatgcagcagcagcagcgcgaccaccagcagcagcctggagaggctgagccgctgacgcccacctacaacatctcggccaacgggctgacggaacttcacgacgacctcagtaactacattgacgggcacacccctgaggggagtaaggcagactccgccgtcagcagcttctacctggacatacagccttccccagaccagtcaggtcttgatatcaatggaatcaaaccagaaccaatatgtgactacacaccagcatcaggcttctttccctactgttcgttcaccaacggcgagacttccccaactgtgtccatggcagaattaggtaatggcatgcatgcttctcctgggatgctctattcatgccctttgaagtaaaaggggtatgtctgactttcctctaatgagttctgctaaatgatgcaattcacctttaccatttgggccacttaattttctgccctgcccccttgcttttgaccctctgctgtttcccatggtttatccaatacatgcattgacctctcagcattagaaatggggcaaaaccaacggaagcagtctttgaattctgcagaaaactgtaagttcaggaaatggctacattaacttcattagtggtttactttagttatattccaaggattgctttatacctaaggtgacaaaaaaaaaaatggcagtccacaaactgaacttggcccacagacatatttttttgcccagggcagagttttaaaatttttgaatcagttgctaatatttaaatttggataattatacccaaaagttcagcttttttagcttcttgtgggaggggaaaaaatgatctatttacactgagccaacatttgtgaatgtcaacagccaactggcaacagccaggggattacacctttcaatgggcccacctgactcccgccatttatatcatatgcacagcccctgtaggcatctcatttttgcaactctgatatatagtataaatgttcaacagaaatcagcttctttacttaccaaaatgttctgatgatggatattggtgacaaaattgatgtaattcatataaggctcaccatgcaaaagacaaaaaactgtccttttcttattgctggaacattactgcttcttgggagatgtgacctagaaatgttgataacacagacaatgggcaactttccatttcgaggaagttgtgttaacatccgctgctatatttaatcgatttttaagtacagcactattattagaaaaactttgataagaacctttgtagtttttaaatttgatctgctcctcctggtggttcctcacacaaggttataatcctttgggatatgtcaattagttgctgtggagatgactaagttaatacgaggagagaatgaagacttcagacggaaaagaaacagcaggttcagacttgagcacagaaatcctcagttcacagaaataatggctgtgttctttagacggtttctctacctctgcaccccataaaacatcttttaagtgaaaatttatatttccagtaaaatctttctccaaatagaacaaattgaatgttctttacggtttttacacaagcatctctttatgggtctaaatttaaatcctcaagagcagggacattttaagcctggtctttaaccactgaacagcattaaaaggtgtattgcagctcttttgattaacagagaaacctctgaactagaagccaagctgagcagaggtaggtttgatttttttttttttttcttgaactagaacaaaaaccttccatttttgtcatgaaatcttggttggctgagccttaagcagaactgtaatgaaagtacaattttcagatatgaataaggatttgattgaaagctgacatgataccatgaaaaatgacctgactcactttaggtttgcctccaccttaccataaatactagtgactctgtcctgtttgcttgtcaaatattcaatcctgaaataaatccataggccttaggcaaagcgtgcccttgaacatggcactttggctaaaaaatgcactcataccgaagtggggccagaaatggctgagccgattccctgaggctcccggacaagtcagcttcctcttccatggtctcactttccagtgcagtctgggagccctgccccctcatgcttgctctatgtgcttttaaattagggatttttcacaggtgttgtggtatttaccaggataaattaaatgagatcatcactaggagaattcccaaacccaaaactaaactagcatttatctggaaagtatataattgggctctaattctcttatcccatttatacatgcaaagtgtttcagggagctaagagtatcatgaaagtggcccaagtcttgttgctgcttctccaaagctacttaaatttccctggtatttcttttggggcttaaagcctgctatctctttaactaagactcttgacttcattttaggctaaactttgtcatcagattttaaacaagtgaaaccaattgtataataggaaaataaattataaaccaacacatcctaagtccaattctctctttcaagtgtagtatgcacaacctattacttttagtgaaaaatatgacttcatccttggctaggaaattttgcccttggtgtacaattagtacctgaattagacattccagataaacgacctaggttttaagtgcaaattaggtttgttactataattgatatctaaagctttgcgcaggagaaacagctgatatactgggcaaagcatgagacaagaaatccgcttatatgggttgtggtcctggcattaatataagttatacaacccagtatacaccacgtaacatctgcgagctgtagtttctctactcctagaatataaaggtctgtgtctgaatcatagctctgctacttgccagctgtgacaccttgaagaagtcacttcactgtggttcagtttcctcctctgtaaaatggagataatactagtacctttctcttggggttgttataaggattaagtgagaaaacatacatattcaggatagacacaaattatgtgggactggcatatagtgaatgctatatgtgttaactgctatcataattattaatgtcattattatttgttaaacaaggacagtttggaccagatgctatctaaagttccttcccactatgaaaatctgtgactaactcagaagcgaggacttcccatctgaagtatcgaggcgctggctgtattgctgaagcagtcatggttggggcacatgacttgccccagtcacaaagtgaggtagactatagattatctgctgagctcagacagaagccaggtctcctaactcctagcccaaggtatttcactattccagactttatctgagagaccacgcttaaattctcgaattttattcagcctgaccatactcgcctttgctgaaatggagatttaaaaatagcaaagtgtctaaaatcttacacttgccaaatcgactatgaattggaatgaaaggctgttggtgagcagatggtgtgaatgcaaccactgccctctactggtatgtcaggtacactgcatgatttgttgtctcactttttattggctgttttaaataggtagggataagtggccacagtttcttaagacaaagtgaaaccacaagatgctaagtatcttattaactagaaatgaaacataacctggaaggaaatgatatgagcctcttctcatccttcactccacagcatccccccctacttccctgcgaagactcttcatcttcatcatttttttatcggcaaaaattggtttacattctagaaacgaccttatatagtgagagttctttccaaaagaggtagttcactaccttatttatgtattttcttgtttcttactccccattatttttgtctttactcacctattctccagcgtcattgattctaagacatgtaatttactggcttctctctctcactctcagtttctcattctttcctttacatttgttcttttatttgtgttttattttttatgttatttattcatgctgttttagtgtctatgtgttgccaagtagggccattcaggtttattatgtttcagtgtctctaaggagattctggtttccagctccatttaggtgaacctgctctgttttcacacaaacaagtctgcttctgtttgacaaaagcagtaacaaatttccaaacaaaaagatattctccctagtgttgccaagtttgcattcagcaccgttcttttaaaatgacttgcctattctatactcaaaaccctagggagagggatcattttttgatatggttttatattcatgggattttgtcaattcttttaaaaaatacttctttaatcatccttcccttccagaacaattattaccaagctgctccaaattgttagttcctggcatctagattctagcagccttctatgtggtcctcctgcctgagcttctctgtgctccaatacaccaagcacaaaactgcttgttccatttccccagatataattttctttttttttttttaagagggagtctcgctctattgcccaggctggagtgcagtggtgtgatctcggctcactgcaacctccagctttcaggttcaagcgattctcctgcttcagcctcccaagtagctgggattacaagcacccgccaccacgcccagctaatttttgtattttcagtagagacagggtttcatgatgttggccaggctggtctcgaactcttgacctcaggtgatccacctgcctcagcctctcaagtagctgggatcacagacagccaacaccacgccaatttttttttgtatttttaatagagacagggtttcaccatgttggccaggctggtcttgaactcctgacctcaagtggtctgcccagctcagcctcccaaagtgctgggattacaggcgtgagccaccacacccagccaatctcttccttttctgacagcttcaattacttttttctttctcttcttctgtaattcaactttataccttattatctagacttgaattgtccttccagtgtgttcatacgtgttcaccagattacaagctcctagagaaaacttctttggcctctaggtctttcatatcttcaaactccttatgctcaagtataataataactaatattctgtagcacattctaagtaatcctccccattctaagggctcaactcttttaattctcatggcagccctgtgaaataggtaccatttccctcattttacaaatgaggaaaccaagcacaaagaggttaaataacatacccgagatcacacagctagtaagcagcagagctgagatacagactcaaatggtctagctccagagtatgtggcttcacaactacactatgcatagccacatggtaggccctcagtaatgcttgttctgcaatttgcaggaaaaacaaaagaaatacctagttgtcaccataaaagaatatcattttctagtttttcaagaataagaataatccttcccaggtcaatgttatgtggcagatgtgtcttcataaaaatgccaagaagaagcaccacgtcaatcatttcctatgtctatctaggtcaatattttttcattcctagacattggtataaaggcacagaacaagggcaaagtcaggagggtctttgaagtcagcaggtcttatcttcaaatgctggctttgcaaagtccctgtcctccttcacgttcccaaatacaaaacagttccaaattacttgtttaaatgtgtaaagacagtcaaaactcgcacagcacattgttttctacttgttatttcttaaagcaaatattaaatcaccaattattcaaagaacttcgcttttcgtgtttgtgatctcccgttttctccttagaacaccttgcacagaatatatctaaatcgcatctggaaacctgccaatacttgagagaagagctccagcagataacgtggcagacctttttacaggaagaaattgagaactatcaaaacaaggtatgatctgaggaatttttcctcctaggattgaggcaatattgggaagggtgttggtataggaaagttggtcaagagttcacacagactaaagaatgaatgtcatcaggtttctgtttaaatatcttttttctgaagctactaatgtacttgaggctttgccatttaactcagatgcaaaatttcagcaatagcaaataatttctattgtgctttctaggtatacacatacctccttccatttgtcaacaggagaatagattaagcagcttccaaaagtctaaatgaattgagaattgtctcaatatcacaatcaagattttaaggtctggaagtttatgtaaaataatctcagcctaatgtttctggaagttgacaaggaagcctcatgtttctggaagttgtattagggagtatatacaaaaaaaatttagaagctgtgatcataactccagtctgaacctagcaatatgaggctgacaaatagtaccctacttgcctttttctgtaaaacacccagatcaacaagattatctaagtgaatccattttacatttgaggaaaactaacatccactggcatgtctggagagtgaaacatcaagaccagaccttgactcctggctcctaattcagtgtttcttccaccccatcatatcggtgggaacagtctgaaactaagattggggaaacaagttagcaacgaaaaagatccagaccattctgtaactgaaatggagagtgcgaatataaaaggaatttaacaggacatgttggggaatagcaacacattgctttgtttgcctttgaggtagcaggtaatgccagcagccaaagctacaaaggagaagcaagaaaacagtaagaagcaacaaagtatatgaaataggattttagagtcagagatgcttggatttgaatcctggctcccatatccaccagttttttgttttgttttgttttgagacagtctcactctgtcgccaagctgacacttgcactggcgcaatctcggctcactgcaacctccacctcccgggttcaagtaattcttctgcctcagcttcccaagtagctgggagtaccggtgtgtaccaccacgcctggctaatttttgtatttttggtaggaacagggtttcaccatgttagccaggctggtcttgaactccagacctcaagtgatccccctgcctcggcctcccaaagtgctgggtttacaggcgtgaaccaccgtgcccagccagaaaaaatattcttatgaaagtgaattaaaacaaggatgtcataaagcgcctagctcatagtaggtgcacaataaattcagttgattctccttttctcccttcccccaaagtaaagtggtgttaaatttcccaaggcaaaataattacttaaaagaagatccagaccgggcacggtggctcatccctgtaatcccagcactttgggaggcccaggcagacaacacttgaggtccggagttcaagaccagcctggccaacatggtgaaactctgtctctattaaacatacagaaattagctgggtgtggtggcaggtgcctctaatcccagctactcaggaggctgaggcaggacaatcacttgaacccaggaggcagaggttgcagtgagctgagattgttccactgcactccagcctgggtgacagagcgagactccatctcaaaaataaaataaaataaaataagatcccactttgccactcttcgtggcccagggctaaagcagtggcatgctttgctttcataactctgcagcttctgctacaaaagctaacatcttcctggaggatgttaatgtgtttccctctttaacagcagcgggaggtgatgtggcaattgtgtgccatcaaaattacagaagctatacagtatgtggtggagtttgccaaacgcattgatggatttatggaactgtgtcaaaatgatcaaattgtgcttctaaaagcaggtatgtgctttgcaagtgaattttgagatctcttcctaacctgctttcacccgcttattaaagaaatgcttggtaaggaaggtgtcgggaacagtttttctccaatgataatagctcaggtttttcttagcagaaatggagttcttttcaaaggttttaagatatattcaggaaacattccccccacttttcttctcttctgggtgaaaagattaatttgaaggtcacctacattcccaaattttcccatcacgtgtgttttgtttctacactccaagtcctccgagtttatgatgttaggaagaagaaagtagaactcagaaagatatacttgtttttgattcttggttttagtacatatgaataaatgctttcctagcaactctgagactctgcattgcgaggtagaagagtgctaaagaagtaatttataaatcaaccctcacttcagttaaacagggcttagcttcagcacaacagtcttttaattacatagaaaactctgcccttttggatagacagctgatgtgactgagaacccgctagctaaactgcacacgacacccaccatgctgttgcagaaggagtctctacatgagcagcttagaaacaaactcactaacatcagatgacccaaatgacccaaaccatttctgcctctgcttaggttctctagaggtggtgtttatcagaatgtgccgtgcctttgactctcagaacaacaccgtgtactttgatgggaagtatgccagccccgacgtcttcaaatccttaggtaaggggatatcaaggtgccttttcttcaaatcagggctataggaaaagatgcgggttgagtgaaagctctgcttggacaaaatgaaaactttatttagaaacaaaaattaaggggttttatacctattttactttctagttagtcactgtagaaaagtcatatagctcaaaagttttttgtctacattacatgtaaagatgtagagtttcattttatctagttggtaatcaaagggatttatatgacgtgtccttccagttcccttccagattttaagaaaccagatttgctggtgatatattattcagatgacctttaggatgtgagctgatacataaaattaagcaaagggcaaaagctttgcccttccatccccctcaaacagtaaccattaatgagactgaaatgcagatatcaaagaaataaaagttacagttaagtgaaaccatgatatataatttataataaataatttggggccaggtgcggtgactcatgcctgtaatagcagcactttgggaggccaaggcaggcggatcacctgaggtcaggagtttgagaccagtctggccaacatggcaaagcccatctctactaaaaatacaaaaattagctgggcatggtggcacacgcctgtagtcccagctactcaggaggctgaggcaggagaatcacttgaaaccgggaggtggaggtttaactgagctgagatcatgccactgcaccccagcctgggtgacagattgagactctgtctcagaataattaataataaattttggatttctataatttaaataaaatgaacatagttattaagaagaatggataagtatctaaaatgagtgatttttttaaaagttatatgacagatgatatatataatgaactgtcatgtagcacattgtcatttaaatatatacatttatatgtaaaatatgcaaatctgaaggaatagacaccaaacttaaccagtcttttggaaaacggattattattctaggggactttcacattctgtgttttcaggttggtaaatagttataatagttttaccaccagaatatgtcatttgttaacatttttaaggatgtttcagatgaaatagagttgaaaacaaaaatgagttaatttaacatatcagttagaatatggctattagactctataggttaaaagtgtaggctctgaaatcagtcagcctagctttgcttcttcttaggctgtactttctacctgtgtgaccttaggtgcattactttcctctccaagtctcagtttccttacctctaaaattgggataataataatccctccttcatagagctgttttaaaataagaagaaacccaaagaaataccttagagcaatacttgccacagtagtcacacaacaaaagttcaatctcattattttcaatgaggatgacagtggcaatggtgatgtgatggaagtggtggtgatgactaaacagatttttcttttaagattttaaactattatactgtagaaatgttactactattccttctgatcttcaaccactagatctctcttcaccttccccatgtttttctcctaagacaataatcaaaattctaaactgtctttgttttcattttggcaggttgtgaagactttattagctttgtgtttgaatttggaaagagtttatgttctatgcacctgactgaagatgaaattgcattattttctgcatttgtactgatgtcagcaggtaagacaaccaaataaaaataaaaatggttttcgaattgtctaagataaagaatttttacaaggcccatacgtttaatagctataaaatatttgggagctactaagagaggtctccacccttattaaattggattttaagtcttcaaataacaccctctcttttccacccatccaacacaaacatatattcttttgagaaaacctcatgcctttcagacaaaatgtaaagaaatgagaattgaacaaaatccagtccagaattaacctcctgataccaagagaaatgctgtggtggaatagggttgcctgtcttaacaccagtctccaggataacaagatttttaagacatcctatttttttgttaaaatccatttagatgtcatccactagattatctgaatttaatctgtgttttcaaccagtagtgcatgtttggggataatcacttttgctaagttactaccttctatttggaagacttagacataaagactttatcctaaattaacaacccttaagtcagttggaattctattgacaattttagttgacaaagattacaagaaaactttcctatttttcaaaaaagctagcaggatcgataatgaatatttcattccaaagtataattattagaacgtctcgaggggccatgatggtttcatttgcactcatatgagtatggcctcatatttaattgtttatcctttggaaggggaggatccttcctttaagtattggtaaaaatggaaaggtttaacaccctgttttataacttccttggatcacttttcactccattaggagaaattttgaaagaggagtgaaactggcctctgagtctctaaatattcattgtgatataattatccgtatcaaaagaatccggagaagaaggatcctgacaccatgtcagaggaatgctaaagaatatcatttttttatgcttagatcgctcatggctgcaagaaaaggtaaaaattgaaaaactgcaacagaaaattcagctagctcttcaacacgtcctacagaagaatcaccgagaagatggaatactaacaaaggtgagtgccaaaggcttctagttggcatggcctgaactatcccctggcacaaatcatgctgccaatatggtcatgtaagtcatatgaccaattcccaaaagtatcagaaggcaacaggctactaaaaagaaataaatttccatttcaaaaaaattctgttgagccacagctcattattcagtctaaattatacttactatcgttgattacaaagtgtcctgcagcaataaggcaatgtaggaaaaaaagttacattctagaaattctcttccatcaaagttaggcataaagcagagttaatattctgcactgacataaactgtaaaaataatctttgaatttattaattttttagagacagggtctcactccgtctcccaggctggagtgaagtggcacaatcatagctctatgcaaccctgaacttctgggctcaaaagatcctcctgtctcagcctcctgagtagctgagactacaggtatatgtgctaccacacttggctaatttattaattattttttgtagagatgggtatcttgctatgttgcccaggctggtctcgaactcctggcctcaagcaatcctccctcctccacctcccatagagctgagattataggagtgagccactgtgcccagcctataatctttgaatttaggaagaagttataaaggactaaaagacttaatcaggatgaccatatatactaatattagttctacttccattaaattcactagtcatcaacagtaaatgacttttgcatttttgtcaatttcccatcactactctgtattcaaagcataaggtttcatttttaccaatcattatctttcacaataaatatgattataatgtcaattttttaaatgtgctaatatccttcagtgccattgctagtagtatgtatttggtcttagaacaatcagccctgttctttcttattttatgtattttattgtgtgagatgatgtgagaagtttttggttttgttttcttgtttatttgtttgcttgttttttttttttttctcctttatagctatgttagaccagaaaggggtaactgggggttaattgctgttttgctttttgattttgcacctgttaaatgagcaaacgggcaggaatgggaagtggaagggaggagccctgtcaggagcttcactctccatctctttgcccaaatgcaagagtaccattaggatctctgattataaacagcacttaacatgtggacaagatctggtgaaaacatttcctagagaaggttattctgggttaaaataataagcagtttgcctttgtgaggtgctttggaatctaaaagtaattttgcaaattgtgtcattaccctcagctggtaaatggtcaatgctagggcctccatccaggccttctgactctattattttgctcagacccagcattgctttattacaggcaaaactccttatcgaaaagaaacgtgtagttatcggagttgactagtgccagttctggataaaatgtgtagaggatgccatcacttccagttgcagtgccttcactacccacccaccactgcccctcacccgcttctccatcactagacatctttttgcacagtggtagaaggcaggattccaggaagtagagcagaaggcatcttggagtagaagaagtcaagagccttgggttctgtatgagtctgctgctgacaagctgtgccaacttttgcttatgaacatcttttctagttattgaattattcatcttgaaaatcatatttaatgtatacttggcattctatgacatgactatatcatcatttatttatttattttttttaagagacagagtcttgctctgtcacccaagctggagtgcagtggcgcgatcacggctcactgaaacttccacctcccgggttctagcaattctcctgcctcagcctcccgagtagctgggattacaggcgcacgctgccatgcctagctaattttttttttttaggtagagacagggtttcaccgtgtttcccaggctggtcttgaactcctgagctcaggcaatccaaccgcctcggcctcccaaagtgctagaattacaggcatgagccaccgcgcccagccatcatttatttttaccaatcctctgctactggatgtttaagttgctttaagtgtgtttcaccattataaacaatgtcataaagatcattcaggttccctgatctttgatgcttatgcctgttcttgcctgacggtgtgtcctttctttcacttacagttaatatgcaaggtgtctacattaagagccttatgtggacgacatacagaaaagctaatggcatttaaagcaatatacccagacattgtgcgacttcattttcctccattatacaaggagttgttcacttcagaatttgagccagcaatgcaaattgatgggtaaatgttatcacctaagcacttctagaatgtctgaagtacaaacatgaaaaacaaacaaaaaaattaaccgagacactttatatggccctgcacagacctggagcgccacacactgcacatcttttggtgatcggggtcaggcaaaggaggggaaacaatgaaaacaaataaaagttgaacttgtttttctcatgcatatgatttccattatgcctacagatatggaccctttttctgtcttgacttcttgatcattgacctctgtttacaacagaaggagggtactaaagtcggaggatttccttttcttgtagctcactgcccacagactttctacagagtcaccaatctgtcagtaacaacagagagtccagcaataatcggtgactggtgtgcatagcggaggttgcggcattactttgcacaactagctctttgtttcatgaaggaagtttttattttttcaccgattattgccagtccgcaggatggcatgaaaagggtccatagcagtagcaacaatagcattataatatattacagggtaaatgggcatgaagactatatatagctaaaagagatattgtttatatattgttttaagtaatataaaatgtagttactggtgtagcttttcctgttgaattgataaggcactttcattttgcacctttttctttaaattaaatgctagcgtgttcactgtcgtgtcgcatgtgcaccagaaacacaagtttaactgagaaggcttggaaggtacgttgggaggtatttatgctgctgtttacaaaattatttttaagagactggctggtcatatctagaaatcaccacgttggattttttttttaacatgtgaatttggaattagaaacggaactctccctaaattatactttgctttttggtaagtttaatgatagatgtgtttatgcttcatacaaagttgaatgattgattggcgtggtggacatataccatcatgctcattttttttttttaaagctttttaaaatgccacctcatggaggcgagggggaggagaagctcattttacacaattcagtagttaaatatggactcggtctcaacttggaattcttatgctttgagaacaaatcaacaaccagaatatttattggaatctagcttttattataagaaggacccaaagattatatcctgagcaaatgcacactccccatgtgaggacatgaagtatttactttgtgaatgtttatgttcttggtataatctaggaaccctatgagtttatctcagagtgaactaattctagatttgttgtcaatagatgctataattcaagaatgttgctctccatatttgaaaaacgatggataggagggtgagggaagcatacaatgttgaaccagtttctcttatttaaatattaaatactttaagcctttaaagtgaagttgatgctagctgcaaacatttactcttgtatttatcttcactaggaaactgtggactgtaatttattttattaaatatttagaagattatttggcttgtgtgttcaggtgagaaatactgagttgtttttgtttaatttcatggtttttttttttttaatgatccctagtgggggaaggggaaaggaatagtctgataaacagatgtgcatattttaaaaacaagtgaccttttgggaatgtaggcatttagacgatgattttagtcgcactaggggtgggattcaaactactggtcaaagaccattttgtacagaaaagggaacatctccgatgggtgttaaggtaggagtttccatgcagccctttatgtctgagaaatagtctcctctgccattggggtccctgcggaatcttctacaggaattgcagctcttcacgtcatgctaggttaccagcatgggcttcccagagcacttcactctgtttctaactccactgacttttctgacttgtttcttgagggacttggaaaaggggaaggtattattcacacagatgt

SEQ ID NO: 15093 - DNA, 9531 bp, Human
  misc_feature (1)...(9531): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactaacaccacatttcattcttaggagtcaacaaggctttaaacaggggaaggatgccaacacctagttttccgtatcccgggtggtgcctctacttatggcaagtgtgtccatcagcagaaagaataaatcgcctcttggaacacttgccaccttccatctcgtttgatgacgtacacgttttctcctgagacaagcaagctcccacacggtcaaccccacaccggagccgagaaccggcctctccccaactcctggaccccaggaaagctggcaaagcgctgatccccagagtggcaagaggcttagggcggggatccagacacccagggaaagaagtgctgtcccaggaccccagccaaaagaagagactagactcactgaaggagacgagaataaaagtcctctgctgcgcagttcagccgctcccacatcccgccccaatgtgagagcggtaccggaaccgccaaactgaactgcgcgccggaccggcgacgtcaggggtcatggccccgccccgccgggactattttgaccaccccctacaataagtcctgtttgtccgcaaagttaaactttcgtttcaaggcacccagagctatttactatgtcaatagtcttcaacttccgtctgcaataattaaaataagagcagtggttggggagaagatacctcgactcgcgagagttggcctcgccccctatggattattccgcaaaaaggagtccctattttctaagaattattattacgtttggaagaaaatagataccgtaatttcccacaaataaagaaataacactctcgtttttacttttgtagtgtggtagagagatattttttgtatccgtgttggttcttaggcggggcaaggtggggcggtcaaggggaaggtgacatatacagcgggagtggtaagcacttccttttcctgtggcagcagccgggctgagaggagcgtggctgtctcctctctccgccatggtgagtggaagttctcttggctggccttaccccgtatctcggggccagtaaggaaggatttggggttcggagcatagaatctgtaggagatagagcgaggagagggagatgaggaccaaaggcgtctttttctggtgtggaactgggatgtgcggcgatacggcagccatcttagaggcaacgtggggttcccagcacaggacgcgccgggaagcagtagtggaaagcactgggtcgttctcaggagcagtgggaccttctgttagaatatttgcttatttagcctttttctggatgcttgtctctgcctagcttgggaatcatttctattaaaagctttctggttctcttcgcctaaaaattgttcggtgttatcaaaatctttgaatccttagccaactcgtaataagaccagtgttatatgtgtactgcttttccacaaatagtgttcgtatatactatgtagtgttgtgtgccgggggagttaagcgaacaaaacagacactgtcctgactgggatggtagttgcgttggactaaatacgtagtaatattctatggtagtaagagatgaaaacatagggaataggagtggtttggctttaaacagtgatcagagaaagcttaaagtggcctgaaggatgtgagaaagctggcaaagaggagctttagagtgaacacttggaaagtctgaggcaagtgctgggtggtcctgagaccgaaaaatatctggaagagtgtatgggagttgagatcagaagtagagaagatggtgtaggtcagcctcaggattttcagtttactcacagttgggaagacttggaggtttaaacaaaaagtaatatcaccagtctttccactggtgagctttggaaacacgtgtttagtagagggtgagggtgagtgggacagggatggaagttgggatgagtagagcccgggtagacaggatttgctgattaattggcattaaacagcatctccaaaccttacaatatggttttgatttagctattgtgctttataaggcttgctttgaaagttttatgataaacaattctttttgaaaataaaattgtgcagtagaggttgagattctaagggttctagtcatttactgctattttggtttaagggttgtttgcctcaccataccagtctcttctgcaattgagtatttaatggtattgttggcgtatgagaagagtttgcttcaaacattacttgtcaataaaaataatccttgtctttttctttaggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtatggatttatatcttctgcagatattttagggactgctttacagtagtgatgaaattccacttcattggtccgtgtttctgaaccacatgattttctcggatgttctgatgctgtttgctaccatgcataatagtcatgggttggtatgtatgatgaagcagctacaacttttatctcttctcaattttaggtcatcagactagtgctgagtcttggggtactggcagagctgtggctcgaattcccagagttcgaggtggtgggactcaccgctctggccagggtgcttttggaaacgtatcctttgtttcactacctaagactggtcatctctgatggaatttagcggcctgggtctggtttattgatgataatacggtgtaaaaatattacttttttttgtcttgaagagaaggggcttcatttatatggggttattttgcttgcaatgatgtcgtaatttgcgtcttactctgttctcagcgacagttgcctgctgtcagtaagctggtacagaaggttgacgaaaattcttactgagcaagaaataaccttgttgtaattactaaaatttgagaaatgtgattcttgactggaaaaatagatgtgtcgtggaggccgaatgtttgcaccaaccaaaacctggcgccgttggcatcgtagagtgaacacaacccaaaaacgatacgccatctgttctgccctggctgcctcagccctaccagcactggtcatgtctaaaggtttgtaatactttatataagagagtttgatagaagaaataagacacctactatttgatcattagggtgatttttattcacagtaacccatttcaagatggctagaagagaataatttgaatgtttttagcataaaatattttagttcatggatattccagttacactgatttgatcttgacaaatgagtgcattcagttatcaaatgtactccagaaatacatgttacatatcggtttaaaaattttttaatcaaaaatatttcgtatcagtgatacaaaatgccccactttttctttcacgtgaacctttgttaaaattgcacattcttttcattctgaagtgtctgattaaattttaatcctttactaaatactaggtctgactacttaaatctgacaaatcaatcaggggaatactagcgtaactggggaactattcaagtagtagtttagtatatccttagaaaacttccaacttaaacttgcctgttgcgtacccatcgcatttttatttaactgtcaaaatgatgagattccacttaattggtccgtgtttctgaaacacatgatatttgtggaaattctgacttggcaaacggaataccattttgcttttattggttgtataaaatgtttgattttttttttttctccaaaagtttcaggataaccaagtaagtgtcattggtttttgttaggtcatcgtattgaggaagttcctgaacttcctttggtagttgaagataaagttgaaggctacaagaagaccaaggaagctgttttgctccttaagaaacttaaagcctggaatgatatcaaaaaggtccgttcaatgagcacatttacagtttggtactccttgttcacagtttgtcactttgaatttcagaagataagggcagtatagctaatccttaatgtgtgagagaacaagaacctcagagcccgattacttgggtttgaatcctaactgctgtttatggctctgtgtaaccttggcaagttattgtgcccagtttaatcatctgtaaannnnnnnnnnnnnnnnnnnnnnnnnnnnnnnnnnnnnnnnnnnnnnntatcttaatcagaatactaaaactgctcactttgtaggtctatgcctctcagcgaatgagagctggcaaaggcaaaatgagaaaccgtcgccgtatccagcgcaggggcccgtgcatcatctataatgaggataatggtatcatcaaggccttcagaaacatccctggtaattaaactgcttacatatattgactaggtatactctgcaagtctactcagcttttgttatgatgagattccacttaaggtccgtgtttctgaaacacatgattttgtggaagttctgatttatggctgaaagagttgcaccattgatggttgaaacttcataattaataagttctcaggtaccttttatagctcttaagccataaagatgatttgtgtttcttttgttgaaatacaggctccctaatttttctttccctttaaaaggaattactctgcttaatgtaagcaagctgaacattttgaagcttgctcctggtgggcatgtgggacgtttctgcatttggactgaaagtgctttccggaagttagatgaattgtacggcacttggcgtaaagccgcttccctcaagagtaactacaagtaagtatctttcatatactaagcacagatgtttatattgtggatattaacattcagaattggcttacatgttttctaaatttattcccatttccccttatgtgcagcaacagtatgccaaaatgagactcacctggtctatatttttggttttttgttttgtttttgagacagagttgttctgtctcacccacgctggagtgtagtggtgtgatcgtggcttactgcagcctccgcctcccgggttcaagcagttctcctgtctcagcctcccaagtacctgggactacaggcttgtgccaccacacccggctaattgtagagttggggttttaccatgttggccaggctggtctggaactcctgaccttaggtgatccacccgcctcggcctccccaagtgctgggattataggggtgagccaccacacccggcctggtccatgtttatgagaagtgatagtgtagtagatattttggagagcatagtggctaaaaataaagcttcagttgagcttcctgttctttggttgattacttttacatgtacatgtcaatcttttccctttcagtcttcccatgcacaagatgattaatacagatcttagcagaatcttgaaaagcccagagatccaaagagcccttcgagcaccacggtaaagtgatacttagagtgtaattctcgccccaaccctatactattggttgtttcaaaaatttgtatgtgtataatgttaagtaaaatgttgatacagtatctgcttttttatagcaagaagatccatcgcagagtcctaaagaagaacccactgaaaaacttgagaatcatgttgaagctaaacccatatgcaaagaccatgcgccggaacaccattcttcgccaggccaggaatgtgagtggagtttttgtttgtttgtttgtttttgagtcggaatctcgctctgtcacccaggctggagtgcaatggcgtgatctcagctcactgcaacctccacctaccaagttcaagcagttcttctgtctcagcctcccaagtagctggcactacaggcgcacgccaccatgtccggctaatttttgtattttcagtagagacggggtgtcactatattgttaggctggtctcaaactcctgacctcaggtgattcacctgcctcggcctcccaaagtgctgggattacaggcgtgagccaccgtgcccggctggtttgttttgtttttgtttttctcttcctgatacattaagttcttacagggatttgattcttactgttttctgcctaatttgttgcagcacaagctccgggtggataaggcagctgctgcagcagcggcactacaagccaaatcagatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcagtgagaaacatgacttggtgtgctctgtaaagcttggttagaatttttttaaagtgacattttgttggccataatttagactgttacattttatatagtgtggtataaaatggggcatggatttatactaagtccatggagttcagtggaaggggaatgatttaaaaaaagttgtggttttctaaataatgtggcttgaaaaataggtgtaacaggacttggtcagaaacgcagaggctgttcaagtttagctccccaccagatggaaaataggttaaattctgtaaagatttaactttaaccacaagagggcacaactggagagcacaatttttttggtactgcagtaaaattgattacctcttgagaagtgttctttttaaccagctataacaatagagttgagtattttcacccatggtttgaaaaagtgccagaaggccacactggcccacatctgtaatcccaacactttgggaccctaaggtgggcagagcacttgagccaatgagttcaagaccagcctggtcaacatgatgaaatctcgtctctactgaaaatataaaaaatagccagtcatggtgcatgcctgtaaccccagctacttggaggctgaggcaagagaatcacttgaacctgggaggtggaggttgcaatgagccaagattgtaccattgccctccagcctgggcgtcagagcaagactctctgaaaagtaccagaagcatttttcaggactgcctgtgtgtcttggtgattatgttaaccaactgtgttcaaaagaagtacccatgaaatgcctccagatacaagggtgtttttttttacccataaagctaaactacaaatattaccctagaattaacctcttgtcctgtgtcaaaagtcttgttttgcatctggactgttaaactgtcagcttctctctgacagtctcgaactgtcaagacagtctcagttcacagccaaggtgatctgttaaccctccccatttccagggccaaatctcagttcttaagcacgtcgtttcttagcacggctttattttcatgctctttatttctctgttttgtgcagccttacccctttaaagtccactgtgagtcctaccctgcagggcctcttaacacagtagagttcatgtgctactgatttggtgcctgccttcaaacacatgtgcaagttttgtggggttaaagatagccacttggtggcacaccacattggaagtgctgttcacccggtcatttgaaacggtgtttgaccacttggtgcgcaaatggcctatcggattaaaggatagccaaacccaagatttcttcaggttctttacagctccatggatctaatttcaaaatcctgatcattactcatgaatcaaggtgttttgacacaggctgtaccccttcctgcagctcgtcccccgcggagtggccaggctacggcgggcgccggaagggggcgcactcctcgcctttcctcaatgtgtcgggcagccccgcctccccgctcggtttccgggagtcggcggcgatggcgtcatcaccgagtgccgggccgacagcagcccggaggttggctatgtgaccaggcaacatgctgagccggcttcaggaactgcgcaaggaggaggagacgctgctgcggttgaaggcagccctgcacgaccagctgaaccgcctcaaggtgaccccgcggccctctcctgcccctcctccattcctcccgagcgaccatttccccccaacctgggcctctgtggtgaccacctgctgcggccagttctccgctactcactagctgtggtggcgccaatttagaggtttacaaacaaacaggtatctgaatcacctggggagtttgctgtgcgcttcttaggccctatctttcagaatcgtgacctcgcaagtctagggtgaggctcagggatctgtgtttggcaagtgcagtcctacctgctgcttcctgtaaatgttcatcgccctcagacagcacgctgaggaagtgct

SEQ ID NO: 15094 - DNA, 209210 bp, Human
  misc_feature (1)...(209210): n = A,T,C or G
aacttttaataaaagtacatgaggacttttgatgaacggtttatttttcacagaagtgaagtgcaggtgaaaaggggaaattcctagaatatctgaaggatctgactaaatgaatttctacctaagctattgatttacagtaacttaaaatgtgataatttatctcctacaatggcctttcaaattaaatataaaagtaactcagagtaaagtatgcagaaaaaattttggtattgtaactgaaaatgaccaacattaatttttttctctcacattaatcaagcaccttactgttagaagggaaactgacaagcctcctcaaccgagtttatacaaaattcaaccccagaaagtaaagccaattcgtgcaccttcataagaaagaaataaaggacgaacctacacattacaatttgtaaagaaacttctgtagaggcaccatcgttctacaaccttatgcactttaaaatctgaggtaacaaggcatttgaagataaccaaggttggccgggcgcggtggctcacacctgtaatccccccagcactttgggaggctgaggtgggcggatcacgaggtcaggagtttgagaccagcctggccaacatagtgaaacccagtctctactgaaaatacaaaaatgagcgggcacggatggcgcacgcctgtagtcccagttactcggcaggggttgggggctggtgggggtggtagtgctgaggcaggagaatcgcttgaatccgggaggctgaggttgtggtgagtagaggtcgcgccgttgcactccagcctgggcgacggagcgagactccgtctcaaaaaaaaaaaaaaaaaagataaccaaggtttattgctacttccgtgatatcaccatatcaccaactgcgtaagcagtgctatttagttgaaaatacatggactagaccgaatatttctgcaacagtttaataagagacgatgatgcgactactgcagctgtccccaggcaattaaactcttcggcgaatttctttactattgcttttgaacagggaactgtttgctattttagggcactcgtgcggtaaagaacttcactgaaaaatgcaaatatgttttgctaatgtgggagaaagatgatgatcctctgaacctgtgacttggaaggggggataaaaaagaactatttcttgaattctcgccttgctcttgctgattcgatgcacacaaccccacgaacattcagattcatggcttgacaaagtggggataaccgggagctgcagccccgtctttgaagcttttgtaaagacaaacggtctgcaatgttaagccttaaattggcttttggcggactccagccttttacccttcgtttggtagatgttttcacctcgctgtcattaagcagggtcaggaaatggaagggccgtgaccgggtcgccgcgggcgctctgtgggcgatgagggtctcctgagcgagcaagaccagtctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgcctcctcatacccacacggcggcagagaccttcaccatagcgttcgctcaactccagaaccttccgacctccgctagttcctgcgggcctttgcccgcttcccggtgcaccctccccgggagacacctcagacccccgacagcctgggcaggctcggtgcctgcgggtgcgttcctgatcacccctcccctcttccctccccctcatcctccattcccttgttttcaccctctgtcctctgcccgtcactccccttgtcacctcttggagccccctcctaaccagcggccagtgggtttcccataccccaggatgtgagcctctttaacctgtaatgctgtggctagcccttggcccctttcctgccatggagaaccaggtgctggtaattcgcatcaagatcccaaatagtggcgcggtggactggacagtgcactccgggccgcagttactcttcagggatgtgctggtgagtggtaatctcagtgtccggatgccagcaagggggactcagggacttgagtagtcagcaccttgaccactggtgacctgagccagtggcaatggctactgctggcttcctgtggaggcagttttattgcttcaggcacagcattgataaattgcaaccactaaaacctggcaaatgtctaggaccctggggagatagatcaatctgactgaacccctgccctcagagagctcatggcccgggctgggacacacatatagacacaaccacgcaaatgcaaactgctgaatctagaagagaggttttttccccccaagtgtttcggggaatgtccttggacagattccagccttgtttttctactgagttctctgaacttggtgaccagctgagaaagggaaaaaggacaactttaacttaccatgtttgagcacactgtttcattaatttattttgagacagggcctcactctgtcgctcaggctgcagtgctgtggcacgatctcggctcactgcagcctctgcctcctgggctcaagcgattctcctacctcagcctcccaagtagctggcacatgccatcacacctggataatttttgtatcttgtagagacgaggtattgccatgttgcccaggctggtcttgaactcctgcgatttgcttgcctcggccttcccaaagtgctgagattacaggtgtgagttactgtgcccagcctgagcaaacttaaagcatcattgaatgtaagacattttacttagaaaaaaatgctaaccatgacagtatgacacatcatccgttattaaaatgagtccagtttcagagacggtaaaagtaagggaaaatgtgcatcttagaattggtgatattttacattcagatttttcagaatatatttcaaataaaatgatggaattttagagcagagtgtaacactgtaggtggcctgttcagctgatgtttcttttttgcagatagttactgaggagcagtgaggtgaaatggcttttccaaagctgtgagctcctgagtgggagagtcagtaccagaactaaaattttgtttcattgacttagtaggtttctttccctacatgttgcagccgcttctaatctttctggtattcatttgagatagacagggtgccttgtgcccattctacatgcagaataactgaggcatggaagacagaagcggacattccgaaaagcacatcactacctgcaagttaagagtgggcaaggtggcaggatcttgggaagaggaagatttgtgatgtgatttttcattgtcttgggtaacttaatcaaaatttgatttctataacttcattttgagttctagatgttactgactgcccaggccatgcagatttttgggtgccttgaccaggagctttccatattgtgcatcaaatgccatccttctctttgtatccggagttctccacacagtcatgcacatacagatttcccctcatgataaggcccaggctccttcatgtggtcctctgggcacatctggattggcccctgtctgcctggcacctgtgtcatctctcttcacggccccataaacttctgtgcctcacttacataggttgattttcatttctcccaggtgtccaggctgtctgcactctgctcttcaccggtcaattcccacctgtccttccaagccaagttgtgctttttctctgtgtcattcttggttatgtgccccacctctgtgtcgtcacagctttgtgtgggtcccccagcaaagcacatgtttgatcatgattctttgtctcctccactagatggtaaacttctggaggagatagatatgtttgtttttgtttcttcataggaccccaaaatacttgtttaagaagggagcttaaaagaggatgcatgcaattatggttctgtggacagaacactaggtttagagtcaaggaatttgggtttaattgcaagctgtcccactgactaggcaagtcagtctacctctctgagccttagtttccttatttgtaaaacagggaaacttgtaccttcctcaaagacttggaaagattatgtgagattgtgactgtgatgagaaagatgggttttctcttactcatttaaaacaatggaaggttgattattatgtgattatattatttggttatgtgattatttcaagaatagcccagtgtttaagaccacaaactctggagccaggttgtttaacttgcaagttgtactactggggcaagtatcttctgtatctcagtttctttatttgtgaaaaaaaagttggggaggggtgaaagtaatgcctacctcctagagttctgaggactccttgagttgatacatgtaaagcactcagaacaacttagcacatagtaagcgctccattagtgttgttattattgatgggattgttattataagggattggacttgggtcttctgtttcttgagcatctctaagttgtacctggctcaaggctgactggcttaacaggaaacacgagtggccccaccactagagctcagcatgccaggtgtctgcacacttttggctaggtaagcccaggtggagcatgttttgtcagaaaggcctgacgaaggacctgtggcagtgggtgttcagtgctatctcctagtgctccattttagcaaatgttcaagcccagatcatggcagactcctgtgatctgttctccaggtttacttcatctcttcatcaagaaaaggcaagaaccaagagacacgtcagcatctctggcttggaaccttaaactttaaagtcacgtggaacctggaagaatcccctcatctaattcagactcatttcgaatgaagaggcatgaaccccacagggggaaaataccttgctaaagccacccagctaatttttggcagaacctgacacagatgccagaagcaggttgtagtcaccgagtcagccataactgagtgtctcggacctgaagtcagcagttgagggctccagtcactgtgcatcaaatagctgggagaccctgggcaagtcagtcggtctctctgggccttgtcttttgtctgaatcatcagggactggctgaactatggaggctgacctgaccctcaaaggtagagacatttgggtcttctgttttgcagctttctgtgtttctctttttccctggagactgagttcctagttttgggaaaactatacaagaggtctggttagtgtgtgatgagagagaatgcccaaccctctcccctcttctttttgtattctgtggtctccaagctcagatttcccctcatctataagacttctgggccaggagtggtggcttaggcctgtaatgccaacactttgggaggccgaggtgggtagatcgcttaaactcaggagttcgagaccagcctgggcaacatggcaaaaccccatctctacaaaaaatgcaaaaattagtgggggcttggtgacactcacctgtggtcccagctattagggaggctgaggtgggagaatctcttgaacctagaggtcgaggctatagggagctgtgattgcaccactgcactctagcttgggtcacagagcgagaccctatctcaaaaaagaagaaaacacacacacacacacacacacacacacacacacacacacacagatttctgtctaaactgagtctgtgattttttcctttctcctgagttaccaaatactattggctgtttatgtcttttgtttggtgcttatactcttaagtgttttatattactagtctttcaggtttgtctttatctctgtaaccagtttataatcttcctaaagtcaaggatcaagttttattgtcctgtagcctacagctttgtgatctttatgctcgtggcatgttgtagatgctcaatgatgttttggatctgtcagatatttgtctgatttattgaaaggaagaagaaaagtatcaaaaaatggtcatcatcaaaatatgtaaacttcggttttcttttttcttttttttttttttttttgagacagagtctcgctttgttgcccaggctggaatgcagtggcgtgatctcggctcactgcaacctctgcctcccaggttcaggtgattctcctgctttagcctcctgagcagctgggattacagatacacaccacacatccagctaattttgttgtatttttagtagagacagggtttcaccatgttggccaggctggtcttgaactcctgacctcaagtgatccacccacttcggccccccgaagtgctgggattataggtgtgagccactgcgcccatcccggttttcttttgaaaccttctttaggttagttaggtacatgttatattgtcaagagcagaagaaggccgcttggaaataagtcactttagctggaaaatgtatataaaatcatcaaatgtaccctgctttaaaatgactagtagatattactgatgtttaaacttcttacctctttgtcattatgattgccccactttatttgctttaaagaacaaaatggttggttgtgttcacatgattctctcactcaagtttgctttgttctttctcccttttcctcgtatcaggtgaggagcatgtgcagtgccttgtttatgtcgatgggctaaggcatgccattgccactgagcaggttttcagttggttgttagaactctgcactttgatggggtctgctattcctaagtaggaaggagcctaaattaatttgctaacactatagaggtacagttcacatctcaagatcggagtttcctggaaataactggtgataacctagacttagagagttggggatgaagcagttgttttcccctcgtttttttaaacctacactggctagaatgagtgttcaataagtactgctgaaggatgaagtcagtgagtgaatcaccatcctccactgattgtagggtgctggaatttcaaagtttattacgaagtaagctttgtaatactccagttattggtgttttgttttatttatttgacactaatatggcacttgccatgtgctagacactcttctgagtactttacaaatactaactcatttgttaggtacagctaagatctgatattacacatgaggaaagtgaggcacagagagattttgtgcactcagctgtgccagagagctagcatccagctgtagctgtttggctgcaatttcatgttttcaggctttccactggattgcctgtgtgctttattctgtactccctttacagtttcctgtcaataaatactttctaactatgagagtgtagaaataattttttaacactaaaatcttttatagatgcttcctcaaaaagttgatgtttcatttgtgaggactagactcagaaaaaaaaatctcttttggctgtaatgagcaaggactgcctaagatagtcctctttgatcagttttatatgcacagatttatttttgaaaaaaaaaaaaagcactatagaggcaagactattatgcaaattgccactgcagcaaaagcttctaaagaattgcctttagaaggaagttgcagccactctgctaagtgccctgcttggaaaggctgtgggctccctgctgagaaatactgcgagcggctttgtcagccggctgcctggtgccagttctgctgcagcctgggagggacactgtggcagagctcctggagagaaatgaggtttgcaggccattggagttggactggacatgatggagggtcactttccccagagcgtaggtgttctatgcttattcaattaagctgtctcagtatactaattttcatgtgttttcaactttatagatttatttaagcattgatgtcagattatataccctttttagatttttgttgtaggctagattaactttatttcggtgtcattaagtatgttttctgttgcttaagagtaaaggttgataagaactgtttgtgttaaatgtggcataatgggtttatatcgtcatggaaacttgggtgtcgaactcctaccatgatgagtgcgaggcacagtgttgcttgttgtatatcaggaactacatttgttgaatgtcttcaatgtgctaggtctaagtttatgtttattagattaatttttaagctacatctataagtattaccagacccattttggagggtaatcaaattgaagctcagagaggttaggtgatttttttcccagagattcagacctacgtcagtctgactctcaaaacccctctctctttcaactgtagtatattccacagcctcccatagaagaaaccaagtttttgtaaatacatgacggtttatttgtatatagactgttgaactgagaataaaatatgttattaataaaatgtggaaaagtttccttaaatatttttcttcctggaatagagctttaaactctgggtttacgttgctgggctaagtgtgattatgagctaatgtttttatagtttatgctaacgtttcaaaaatctttcccaggttctcatatttcctgtaggatttgccacatgttagcaataaagaagatggctaattgtgtttctttattctttctttgtttaggatgtgataggccaggttctgcctgaagcaacaactacagcatttgaatgtaagtctggcttgtatactttcttgactattcctttctgcagtcattttttaaagggtttatgggtggcattactttagaaactgacaaaaacagattatttatgaccatcatatggtacatttaaatatttataaattgatataagtttaatgatgatactgaactgagtaatattttcttatttaatcatatcttgggtgagcatatttctacaatatagctttaattaccagcatgacctttatctgctcttgctcctgattgtgataatattgcaggacaaaatgaaacgtgtaaactacctgtaggccagtgattattgattaagagattttaatccattgctgctttaaaacatagcaacaaagtagagcttttaccatgagcattacatggaataattctgttttagtggggcttagcagggatgctagatggtgacaggaacacttcaggtctttagtccttcctttttccccacagttggcctggggacagggccagggtgacctggggactagaaaactgttttgtcatgaaccaggtcattgcagaggacatcatggaatgagtcatgctacgatgagatagtcagtagcataagggcccggatgctgagagggatgaagtaagaactgtagttttttttttttaagatgagggctacttttttcttttctttttcttttttctttttttttttgccgcagactctcactgtgttgcccaggctggagggcagtggtgcgatcttagctcactgcaacctctgcctcctgggttcaagcagttctcatgcctcagcctcctgagtagttgagattacaggtgtgcaccaccatgcccaagtaatctttgtatttttagtagagacagggttttgccatgttggccaggctggtcttgaactcctgacctcaagtgatccacccacctcagcctcccaaagtgctgggattataagtgtgagccactgcacctggccagagggtcacttcttaatgtagaaaaatttcagtttttccacaataggatacttttttgtttctgttttttatgaagatggttacttacagagaatacaatgagtacttcctttttggaggataattaggcatttcttatcaacatataaaatgtgcaaaacctttgacttagcagatccactgtcaggaagcagttcaacagaaatagctacacatttgttgaatgcccatcaaacaaagtgttcattgtgagatcatgatgataattattgttatttttagagacaggatcttgccttggtgcctagactggaatgctgtggcatgatagctcactgtaaccttgaactcctgggcttacacaatcctcccacctcagcctcccaagtaactgggactacacgcatgcaccactatgcttggctaatttttaaattttatgtggagatggggtcttgctatgttgtccaggctagtcttgaactccttgcctcaagtgagcctcctgccttgacctccctaagtgttgggattatagatgtcagccactgtgcctggcccactgtgggattatttatttattttggagatagggtctcactcttttgcccaagctggagtgcagtagtgagatcacagcttgctgtagccttgacctcctggctcaggcttgtgggattattttcaatagcaaaaaattagaggtaaactaaatgcctattataatggattaataaattactatttgtctataattcaaagcattcaacagtgactaaaaagaatgagttaggattttttacatttgtacggaaagatatctgtgaaatattgttgaataaacaaataatgcatatagtatgatcccattttgtaaaatatccaaccacgcttccccaactttatgtgtgtattgaaagataggatctgaagagtgcctactacagtactttccagtgacttaccctgtaaagtggacttggggcctgaggcttgggttggtgggggcgggagggggtggatgaatgatcacactttttactttgtatgtttctctattgtttgaacatttttcaacaatcattgcctgtttttaaaagctataatgagtagaactcaatgtaattagtattttattagtcacattgaactctgtactatagaaaaatagtacatctgtctgaaatacatactagtgttgcaagctttattcagactctttgcagtaactccttgcaggttccacgggtttcatggacagtctgatagttaacattcggagtacttactgttgacagatgctttgctaagagcattccatgggttatcttatttcttttaaccatcacaagatccccacgaagtactcgttatttttttgagacagagtattgctctgttgcccaggctggagtgcagtgacatgatgatagctcactgcagccttaaactcctgggctcaagtgatcttcctgcctcagcctcccgagtagctgggactacaggcacccacctccacacctagctaattaaaaaaatttttttgtagaaacggggtcttgctgtgttgctcaggctggtcttgaactcctggcctcaagtgatagtcccatcttggcctttcaaagtgctgggattacaggtgtgagccactgtacccacgaagtacttaaaaggacattattagctctgttttttggttgaggaaaggaaatctttaagcaacttgctgaaagtctctcagctgttaagtggtaaagtggaatttctggagtagtttccagagtgtatattctcaaccactgtactggacttgttttgagagttgtcataattattgaaatcatatattctggttgttcttaagcatggtaaaaagaagtttactttgtactttttacttgcttttcggatccccaaagtggcttgatgtgcctgtgcctgcctcattggcttccagttagggttcataataataataatactgattattttaactatcattcattgatagcttgctctgtgccaggcagtgtactagatgacttgcctaagttgttagtaatctttatactgagtctgtgaaataggaaaattatacctgtgaggaaacgaagcttagaggcctgaaatgattgctgaatgtgattgcttggaacggtgaagcccaggttcaaacacacatctttttgactataaaacttgcactctttatccccaagtgtgtcaaaagcctgttaagtgtaaatatagataaacctctactactccaggtttacgttctgtgatatcatgctctttcttttgccccatcaatggcagcagctctgtgcccatcttcatgtgggccagttttaaatgaaaaacaataaatacaaaacatacccacagacaaaataatgacagttcttagttgttttgtgtttggattatcatgtactttccactatagacttgaaatcctaggctggcttttttcatgattattttgtggtgacttttttttctgaaccagaaatccgaaccaataaatggaatctatgtttaagaaatagttgaggccgggcgtggtggctcacgcctgtaatcccagcactttgggaggccgaggcaggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccatctcaaaaaaaaaaaaaaaaaaaaaaaagaaatagttgagaagatatagcttataaggaattttggaaatatttcagtggcttatgggtataatggaacaacccttgaataaatacaactttaataaaagaaatacttatagtaatacatttttggtttttttgaaatggtctggctctgtcacccaggctggagagtgcagtggtgcgatctcagctcactgcaacctctgcctcccagactcaagcaatcctcccacctcagcctcctgagtagctgggactacaggtgcatgccactacactggctaacttttgtatattttgtagagatgggctttggccatgttgcccaacctggtcttgaactcctgggctcaagcaatccatgctcctcagcctctcaaagtgttgggattacaggtgtgagccaccgcacctggccttatagtaatacatttaatactgaaaatatacctaacactaattgatatcttatataaaagaaatggtgttatagttagtgatatgaattaagcaacaagagatagggtagctgtcaaatgtacctgttttgtataaatgtagagaaaaagagttgagtgagtggaaaagaggggaaaggtcaggtaatgttacagattctccagttctgagaaatggcgtctcttcaatgaaacctccggtgattccagatggcattaatctctctgcacctttactagagcagggaaccccttcaacctgccttctggtgtgtgtgtgcatgttaacttccctcattacattttgagtcacttagtgataggtacgatgttttattccactctttctctcttcttagtaatgagcttgctgccttagaggaacacacttgttgaatgagtggaacgttatgtgtgtccatattcaaatgaaaattataaaatgtatatggtctaaatctaaatgagtaatttgcgtttttggattatttgtgttatagcctgagcatgggatataattggttggtggtggacagttcaggcctccaaatcaaattcccacatttgactgacccaagggggtcaaacctgaggagctgtattctttctgatttctttttctgggtgtggtgtttccaaggggagttagggctggatgaggagagggacatctgtctgcagaactcaccttttgggctgatggtcctaaaccttgttttcttattaaaaggacctcttttaggtccttattctccattacatctagagctcacagttctacaggctgtacaagcatggcactagcatctgcttgcattctgctgaggaagcttttacttatggcagaaagtgaaggggcagcaggcgtgtcacatggcgagagagagtggaggaggtgccaggctccttcaaccaaccagtttctcacatgaaccaacagagtgagaacccactaccatagagagggcactgagtcattcatgggggatccacccccacgacaaaaacacctccttccaggccccgcctgcaacattggggatcactttggaggggacaaatattcaaaccatatcattgtggaaataaatttgtaagataaattcttagagttggaactactgagacaaagaatacccatatttaaatttcaatatctattactgtgtttgctcaccaaaaggtagaaccaatctacactcacaccaacaaggtatgagaaggcccatttccctccaaccccatcaactctggatattagcaaaccttttagtcaatgtcagtttgataggtgaaaatattactgtgttactgttttattttatattttttaaattgtaaatgagcttgaatatcttctcatttgtatttggctatttgtatttaatttccttttttttttttgagacgcagtctcactctgtcgcccaggctggagtgcagtggtgtgatctcggctcactgcaacctccacctcaggggttcaagcgattctcctgcctcagcctcccaagtagctaggactacaggcatgcgccaccacacccggctaatttttttgtatttttagtagatacggggtttcaccatgttgaccagactggtctcaaactcctgacctcaggtgatctgcctgtctcagcctcccaaaatgctaggattacaggcatgagccaccgtacctggccagctatttgtatttcatttctataaactatttgtcgtctttgcctgtttttctatttggttatttatctttttctaattgatttaagggttttccaatattaaggttggccctttgtcttgtgtgttacaaatgtttttgttcagcttattgctcttttcggtttgttctggtcttcttattctctcttcttttttccgtggagaagtttaaaatttttacatggtcaaacttacttattttcctttgtaacttctgggtttatgtcatgcttagaaaggtcttctacagtccaggatattgaagaaacattcattgatattcttttttccttctactttaatgaggttagacacacacacacagttatttatataaatttgtatgtgtcgtattgtgggtttttataaaaagcatgtatttttattacaaagttcagaatttgtttatttttctttttcttttctttcttttttttttttttgagatggagtcttgctctgtcgcctaggctggagtgcaatggcatgatctcagctcactgcaacctccgccccctggattcaagtgattcttctgcctcagcctccctagtagctgggattacaggtgcccaccaccatgcccagctaatttttctattttttagtagagacagggtttcaccatgttggtcaggctggtctcgaactcctgacctcaggtaatccacctgcctcggcctcccaaagtgctggcattacaggtatgagccactgctcccagcccttgtttttcttaattcttgcaccatcttcagtttattttggtgaaataaatcaggtggggatccaactttatttttcaagcagatagttgattccacaccagttatggaatagtttttcttttcccagatgtgagaacctttctgagatgaaggtaaattccataaccataaaaaatcctgtgtgtttgcatttctgggtcctacatatgctgtaagagcttgacattcatataggcccagagacccctgctgattttcacagtttcattagcagattaatgagtacaccaacacatgaggtgataaaaatcaaccgtgcccactaatgcatttcctgtgcatatctgttacttgtgttcctctgccagcattttctctagagaagtaactgctataaaatgactgttggattggtgttcgtggacagtaaaatctcactggtgacttgaaacatgcattttaagtccatgtagacaaatgctgtcttaaacctataaaaaccatgtggtttcacttttctattacactcatgtattctaatctgtagctctcagaagtatcttcacacttgtcaaaccgtgtgtctgagtttggttcagaaaacatggttatagaataaatatttattgaatttgtgcctttcttcaaccccattttatactctctccttattgcacagaatcattttcagctgttttatgaactgctggaagattattttgtatttagggtggaaatctttaaaccaacacattatgtctcattttaaatttggcatagtatgaccatttaaagctaaattgcaattctggaagttgtaaattctcagagtataggaaacaactatagctgataactggagtgacacctgtaggagatactcttgtgttcagctagccatgacaatcttgttaagaatagttgggtgggagcctctttttgcttcagagaagagtctaaatcataaaatatttggaagaaatgaagtttcatttccttaaactattgtatatgtaaaaatataaagggtcatttttaagtaaaactaggtaagttagtgaaaaatggtcacaataaacctacactgagcctgaaaattatttaacatgtaagagttaattatgcatcctagaatttggggcaaaataagagagctttaatttgttgaaattttggctggaaatattactgatgcaaaaagtccaaatcccttttagtcttatgagagtagtcatttcttattaatagtcttgctaatttgtatgaaaattaagaagtttgagtcctttactcaagcaccagactagttgttccttaaggtcagtggacagtgcagcttatttttgaatccctaccataatggtacctggcacgtaataggcactctatgtgtgtttctggaatgcatggatggttgaagagtgaagtaataaggataagctttctatatcccattcatcagcaagtcctgttggctctatcttcaaatttatccagcatgtgatgacttcttaaaacctcagcttggtttaggccaccatcatctctcaccgggattaggacagtggcctccaaactggtctccctgttctacttttgcctctatacagcctcttttccacatggcagccagagtgattcttttagaagtcaggtgacaccaccacgctcacaaccctccagtgatttccatctcactccaaagtaaaagaccaagtccttaaaatgccctccaaggctctgcattttcgcatctggcctcaacctgtcccaccattgtttctctgaacccgtgtgtttctccccaaacctctcattctgttctagccactctggcttcctttcggtctgtcaaacatgccaggcattcctctgacccagggcctttgtattagctgctgcctctgcctggaacagtctttccccagatatcagcaaggcccactccctcacctccttcagtctctttccactagagtgtatgttccatgaaggcaggattttgtttgttttttcttttttcactgttactgtcccagtgcccagaacagtgcccaccacatagtgggtacttttatttgctggaaggaggaagaaagcaaagaagtaaggaaggaatcaggaagagggaagcaagaagctaaattaaaactcatggatatgaagatgtggccatggaaagtacggcctctggtcctgcccacgtcattaactccgtgcctgagaagggctttaaacatgacatcttttccggtagtttcctgttgatgtctttctaacttctataattatgttttcatttcttttctcttacctgggaaaagtgcctttgcagtagttctaattgccacctggcacagaaggagtgtgacaaatgacatataatatattgccttaactttctgtagctctttgtagaagctagattgtttctcttgaaagccttcttgagcccctgtcactgcagtgggtgctgtttggctgagagctccctggagtctgctgtttatctgctgtttactcagtaggccattgtgaccgccccttacctgaggctgcctctcctctctattgggcctttatgtttctcttcttggtttttcttttggattgcatgttgcctcaaataaaattgctaacaacatatggcctgttatgattctcttttcccaaactctgccattttgtatatttgtgacacactgcagattttgtgaagattgcttcataatatttgtttaccatctgctgcactctatttggtatcttgctaggattttttcctccattttaagtgacattaacaaaatctagccagtacataggctttctggttctacttttgcttccctaatgtgctggaaaatcatattactatgctccaggcaactagagaagcctggaattctcattgtgaaccaatgtatcagatctgtctgctcccctacccccaccccttttgttggtcatatccggtaacgcttttttggtcagatggcaaagaacctccatgtataagatagaaaaagctcaaattattttcttgcttcttagtaccactactttctagtgttgttctctaacatatttgtacctctgaaactttgtggcagtttagtaagtttttatgatttatggttccagctagtgtaatttttacagcttatccagcttgataggcagctagcctgaatcttggctagatgggctgtatatatccaagtttttgttcagaaaagtattttaggctactgtcatagtaatttgcttagtatgtatttctgctttcttacccttcactaacttttcgtagctgtcaattcactgtctttagagagaagtgcatttttgctttacaggttaaggtgagtggtttgctcttgggctgccatcaaggggtcagagacagctcagcttttgccttttggctggagccaccagtcttctcatggatatggttacttttctaactcagtttcctcttggacaaaaacaaggagtctttaataaaacgactaagcatagatattaaagagcaaatcagacagtctcccaaagagcagtttgtaaagaaaaccaatacctatataaagctaggtatcctattaacccacaacaactattcatcagtatgccatataagcctgattttatccccagcctttattagaatgcctctttcaacttatctgaaatcttcttttggagtcagaccccctaaggggagagttccaacattttatcactgggttgatgtcaaaagctattctaaccttttggcttcagttttctgtccacttaagcaaatgctcttgtaatgtttcatagctactttttatgcaacttctcttcaagaaattattctggtagctgacttctttcacagatctttttcttctgaaataatccctcaagagatttcttagaaatttagaattccaaaatattttggtttaagtagccttaaaggttcaagctctagctttgagaagttgaagaactctccttttgttcttgattgtgatttaaatgatttttatgtaatcggtgcccccccctttttttaaataaattataagaagggttttcactcgttttaccaaaatataagcacttgcccatcctatgtgaacaataccttattcaggtcttgggtatattgaaattcaaatataagcagtctctttttaaccataatctctatagctagcttagttgcagaaatgagatttattttaaaaaaactactttattcaggctggaatttgtttttatgccaagttcagaacttcataaagaacaaatcagtttagcctacatttaaagagaatttgacctggttttaaagcaaaaatgtaaagtgctttcatgtgtggtgatatgtaacattacatcatttgtactttgttttttcctgtctcctgcatttttaagaaaactttcgccttaaccttgaaaatattagtttctagaacttatatatagacagactcctttcttctctctctacagctggaatggcatttctcccccaatttggctctagagattctatatctaaagcgaatgaaagaatctttatgtgtgtaacatctctcaggactgtgccttcttcattactgcaagtgaccagtgtatgccttttactctgaaaacaggcaactcttgatagcagaatactggtagtgactctcctagatttagacagtgtgatcttgatgataccgattcacactgagttggggaactctgcagcagtgaaccaggatccagaaacaagtgcttggaaagaaaacaagtgcttggaaagagtgagagctatgggtcactgaacaggactggtccaagtgctggtttcgatcatgctatcagattgctgttggccactgaagagataaagggagaaagtattttgcttgaaattaggctaattgtgaaagaacacaagcttcctcctagggtccccatagcctagtcaccaagcagggggatatccttggaactacagccagacaggagggaagacccactgacttgtggtaggggaagatccctgtgttgaactgaactccctctgtactttcagtaagcatcccctgaccatgttgggcaagcttattctcttcatgatgagagatttgtctgaggttctccaggcttgggatcagaacagtctttctatatgatcaaatcagcaattatatgcccaagagtgaacaaaaataataattccgattgttaacaccagaactgaggcatcctgctgagagcctgccccttccaagttgtccccttgggaggctctgtacgttgctccagacgtttttggcatttctttcaactgtgcatttacagtctactacataggctgtcctcactgttgacaaatctttatagaaggatgaagagttaactatatatttggaaatagccataagtcattcttagacatgcttggcagatgatgtgggtaagtgatcaggccaacaatttcattttgggttaaaaatgagatttaatattctcacatagtctatcttcaggtttttaaagcagttttgaagagatatttcaaaaactactttgaataagagaagtatcatgaaataaatacattatttctagatgtggcctctgatgatacttactcaaatttacacattctggttatgtagtttgtgaagtcttgtcctccagccttaagacttaaattatttcaaaatagcatgaatagcatttgaagctttctatggctggagagtatgcaaaacaagtgaaactgttcggaaaaagagctgctaaatagaatgggggagacctgtattagagctgctttacaagttaaccttgcactaggcctaggttctcctgtggaaagagaataataataatgatgttcatgtcgcaggtttgttatgaggttttcaaggaggtattgcatatgaagcatagatcacagtgcctcatgtattgtagtgttcagtaagtgttagccatttttatcatgctgttgtgagatgatagattgcctgggagagaggaagaatggagaaatcggggtatggtgctgtttgggagatttaaaaagtgtggatagtagaacaagactggcctctcgttggtttttagttccgctaaccaaacctgttttgtcatactccagttatatttactttaacctagagatatgttgtgaatgacatgagcaatattttaattttctgctatccctaaaagaaagttttatattgagattctgatcatattccaaatggaaaacaaaacaacaaactaataatgtcaacatacccccaaaatgtggtgttgagggttagaatatcacattgtaataaaccgtttatattatgttccctttgtgcattaaacaaatgcacaccttatcatttgcattatgtgcttttaaacagatgaagatgaagatggtgatcgaattacagtgagaagtgatgaggaaatgaaggcaatgctgtcatatgtaagtatacgacaaatgaagactattttttaaaatcttaacgtgattgaggatgctgtttcttgggcatagtgaagacgagtaaataaatcacagttgtcatacatttttctatataataggtaaaggtttcaaggatttccgtatgtgaaagttaagggcattattttcaaaagacacttactgatcatatcataaacattaagaataatgcatcttaatgacttttgcattaggtatgatgcagactaaatggactatcaatttcctgtattttttatgcagtacttaaagtaacggctcattaaaaatgaacccctgggctctaaaaaatttttcaaaatctactttcaactggagatctctctcacccttccagactatagtttacaatgtagctgcaggcttaatatggatacacgatttaaagatgtactgttggttatttatgcactacccataatactcccaccgaaaatgaactacagggctacttactgaatcaaagtgatctgaatatattctgaaacgacttttcttttgtgtttaaaattttactgaaaatctgcgttaacagttatctgatactgaagtaaacaagagaaaagggcatatttctaaagcttcaatactaagcttgaaaaattcagctatcatgaggagacataggttacctgagtcttgatttgtgccttcctctcaagttttgttttgttatatctgagtctgtaatctgtttacaaaaccttttcccgtggcctggtagaaagagcattggactggaagtcaggagaccttagctctactgtggtttcttggccctaggcaaatcacttaacctttcagtgctgtagttgcctcatctgtcaattgtggataataatacttgtcctttatactgcacagggccattgtaatgatcaaatagaagaatagatgtgaaagccctttgaaaagttaaaagttctatacaaatgcaaatgatggaatcatttggaatcatgtggaaatgatggaatcagggctcttgcttttcactgagaccctaatcttagtcaacagttaggttgtaggtttttgatagacttcagcttcagccaggatattgtttcattgtaatgaaaactgtaaactgtctgtatgggtttctgccaatagttttaatttagggtaggagaatagagaacaagaaggataggatgattaacagagcattgcattccaaccagcacagaataggaaaagtcaatttcccattgacttcgcattaacttatgtgagagtctttgtgtactgagaatttagagctgggctcatcagtaccttgaaaggcagagtaggattgtctgctgaaaaggtctaccactggtattgatagattggctaactctcctgagaatgtgacatgcttatttttagaaaacccacacacacagatgggttctaattttctcacatatgtccattgcagagaactgacatcaatatactttcattatgtattcaacttaaccacatgcaaaagatatgtacttttgggtatgatcttacaaattgtgctttttgaaaatgttagtgggtgtggtcacagtgataatgatgatttccatttctaagttactgctatatacaaaatgcttgaggtatttaatttttttagttttaataatcactctgtaagacagatattatcatccttattttttagatgaggaagctgtggttaagagataagcccaaggtcttagagctagtatgaatgtgaatatggaatttaagttcagtttcttttcatgcccaagctgttgctcatttactgttttacactgtctctcccccaccttcctctttgcaggattttttttatgtcatcactgttatttatttttttttctccgagatggagtcttgctctgtcaccgaggctggagtgcagtggtgccatcttggctcactgcaacctctgtctcccgggtttaagcaattctcctgcctcagcctcctgagtagctgggattacaggcacccaccaccatgcctggctaatttttgtatttttagtagagacggggtttcatcatgttggccaggctggtctcaaactcctgaccccgtgatccacccgcctcggcctcccaaagtgctgggattacaggcatgagccactgtgcccggcctatcatcatcattattaaattctgaataatttgggtttatataataccttagttgtgatttctgcaccatgtattccttacagcatatgcttattttctcaaattcagtgtttaattatttttgtgttgtaggaaaatatgattacataatcttacattacatgtccttagtttaaaagtttctgagattacttgggtccacttttttttatctgaatagaagtcatctatctcattgatgagataattttaaaaaattttttgtagagatagggtcttgctttgttgcccaggttggcctcaaactcctggcctcaagtggtcctcctgcctcagcctcccaaggtgctggaattacaggcgtgagccaaggtgcctggccaggttggctgtcattttgatctgtcttggttcttatgattgaaatttaaggagaaccatttggacgtaaccttacagtaggttttgattggtagtcctcatgattaccagcatgttcctacaaatttgcattggtctttattttgtaggttcaatttggctctgaagtttgagtccaggatttcgtataaaggcatagggaagatactgacagattaccacatttttattgttttttgcaaaaagctgtttttttcttttgtttttggtcttgttttgtttttgagatgaagtctcattctgttgcctagggtggagtgcagtagcctgatctcggctcactgcaacctccgcctcctgggttcaagtgattctcatgcctcagcctcccgggtagctgggattacaggtgcccgccaccacgcacggctaatttttgtactttttggtagagatgggatttctcgatattggccaggctggtctcgaactcctgatctcaagtgatccgcacaccttggcctcccaaaatgctgggattacaggcatgagccaccatacccggccaaaagagcttagtttttcatatagaattcagtacacctgtggtcatcttagtatttctttaaaagccatatgtgggaaagcaaaaatagaggcacttttaccattagtcctttaatcattctttttcattgattacaaaggttaagtaaataaacagcctatatctctgcataagaataaaaacaaatttgcaacctctgagttgaaacttgaagaattactttttccccctcttggatgcaggcattttctggctttgggccagtacaagtgtacatttttatcagtaatttaaatagatttttgtattagacctgaaaatgttgcctttttaattgaaaacttatcaattatttaaatcactagcagcctgaggctgttaattttatgagtgccataataatggcatacagtggtttttgatacatgtgacacgtggaatattgtattatggtaaggatttgtcatgacaataggttgttgtgtgctgttaaataataaccaacatattaaaccaaagtctgttgtcacacattagtaccattttatgtaagttatttagaagttgtattcttttcttcattagagatatttttaagagataaagagaagaaaacaaagctataataaattgtcttttaagaaaatgtaaagtaatttggtctccaaggagatatttaatgtattgaaagaattcagcagccaagtgttattacagcaccattgtgatagctgctctgcattttgttatgagtttgtgttaatcaacaatctgtttttatagcatagtttcttgtaagttatgttgttagaatattccacttctgggatcacggcttttcctctgacactattgcatctttttaattcctccataaagttttttttttttttttttttgagacagagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagatggggtttcaccttgttagccgggatggtctcgatctcctgacctcatgatccacccgcctcggcctcccaaagtgctgagattacaggcgtgagccaccgcgcccggcctaaagtatttttttaattagaatttgaaatgctttattagaaaaaaaatacacacaacctacatattctgaaaactaaatacctgatcattgctaattaaatattcccttaatgtagtttaaattttgttgttgttgttctcatttcctcctctcattttctagaaagattgaaaatagcgtgctgcttttttccttccatttttttgtgtttgttgtctggtagttctatggaggcccagttctaggaggggattattttactgttaacctcttcttttgggtgacctttcattaagaaattcagccaatacatcttgcttttgtaagtagatttatatttgtttctgctaaatcctgtgtctagggatttattacacctggttctcttaatattgagaggcttgtgtgagtagaacacagtattaacaaaaataattttcatcattttgtctattctcactctttatatcattttttcccacattgccaggagagtatggcatacattttactgtagtgcctcccattatgagaccttgtattatatttagtacaagagtccttatatttaagtgaagtgtaagtattccctttggtgtatttgaccacagtgtaccctgtcagacgttgagtactatgagggaaaaatactttttgacctgtggagcaccttataaattgggatatgattggctttatcctaatatacataacttggacattgcctctaaaatcatgcagttactcaagtagagttggaaggtaaccacagaggttttgttcaactctttcattttacaaataaggacattgaggcccacagagaatagaagattcagatatcagttggaagtcacatggctaattaaaggcaaggcctggatacagactctcagtctctttgctcctggttgttttaaataaggtttttgttttgctctctattatagtcctgctcagctttgcaaatactgctttttcctgagtgtaaaaaataatacttattaccaaaatgtcactgtacttgagtttgtagagaaatgtaaaaaatactctgttggctgggcgcggtggctcactcctgtaatcccagcactttgggaggctgaggcgggcggatcatgaggtcaagagatcgtgaccatcctgactaacactgtgaaaccccatttctactaaaaatactaaaaattagccgggcgtggtggcatgcgcctgtagtcccagctactcgggaggctgaggcaggagaattgcttgaacccgggaggcagaggttgcagtcagccgagatcacaccactgcactccagcctgggcgacagagcaagactccatctcaaaaaaaaaaaaacaaaaaaaaaaaacaaaactctgtgggcgtctgaaggtttaaaagttttgtccttacctacaaggctgtgttttaccttgtttaccaaattcattgtccatttagaagttgaatatttaatagcatcagggccttagctattaggaagttttctttaaagaacaaagaggttagaagctcattttccacatggtgctttcaaatatgccacatattaaataggttctactttgaacttaactttgcaggtggcaaaatcagttcagctttcaatgagttgttagtcccctaattcaatgcaatttatccaaacaactgattacacagtatattcttcagagaaggtggagaaacggtgaaaagaatgagaaagggaaactgaaggaaataaattgttttggggatttgtttatttactcaaataatgacatgctgcaagctgtaagtaaggtttttgttttgttttcttatcctagtcaaaaaagaaaacttttttccagagacagattattttaattctcttctctgtttggaacacttggatgcctttgaaatagtgataaaagtgtagtgaccccttttagcccctgttgtgatctatgttggagcctgtttggtagcaaggagcagaagcatattcaagtttgcatcagaacgagggatttattatgtggctcttggaagcaaaggaaaagataagcacgagtaggcctcagtcttggtggcaccagggcactctggggaccactggaataggaggtttggaccaccaacattttgtcatttatatggctctgctcccagttcagttccatctctgtggagggttccgcttagcctatttataacaaaatgtctcatttggcttgctgtctgcatggcctgatagtcctgttttatttaagtggcaggttccctgaagctgctattaaaacttctactttaagaggaatagcacaattgctacagcctaaaaatcaggtgaaaggtcagtgtggacactaccccaagctaaccaaggtaataactctgaaagtttcagctgagaggatcccataaattttgggcctgttgctgaatacaaatttaaactccttctgccaacacatattaccttaaacatagccaatttgaatttcatctgctattggctgcccaaacttctatgaaggccatctggggctccttaaagtcctttatggttttaaccaaatggtgttatcattaaacttggccaacttgctgtcattttcactttcaagtcattaataaatacatctgtccaataacatgagcctataaatagggcccagagttggtccctgttgaccttcacattgtgattttctttctcatcatctaatcaatctgtgaccatatgtggaccctcggtcaagtcttttaaggaaaagcttgtacacattgtagtctcctcatgacaggagcaatgagttattgaggagtcagagcctgaagccaggtaagtaaatgtagctattaatttgatattcaaaatagattggcttcatatgttatttttgaccactggggcagttgtgtgctctgtgagaggtcagcatcataaaggaaaagcctcttaatgtaaagtatgagaaataattgaaagaaggtgtaactaatgacacatctgagtagcgttataattgaatttgtagccatttgatagagttaagattgttgagttcttcactgggaaaactaacaaattaactatggactgcaaatagttggttagtttattgattattgctgtaattactgactgagctacatataatagggtatgcttgcagtattgacaacaggaatttgaaaattttatcattagtatgaaaaaaacagcatgagtattccttataagtgaaatactgtaccaattatgttgtctgttaggcatgctaaggagagatttgagaaactctcctgttatagatgtatggaagaataataagtaggcctggtatctcctctgtacgtgagacttgctgctgaataagttggaaggtatgaccaatgagagtcgttactatgtctatatcagttcctctctggattcttcctgtaaacatttgtgccctgtctgtaatgtgctaggcactatatggcagtgatttctcaggtttttgaaggcatagtcctttttgaaaatctgtaggaagttgtttatttttttcccccagaaaattcacataatgcagcatttcaccagcttcaaggatctcctaaagcccatatagatcccaggttaatacctctggcataagaggaaataaaatatacaaggcatggttcctgcccttgttgagcttccaaaagagaaacagtgttccccacaatacctgtttactttattatttatagtactgtagtaattgaggggaagggaggggatactgactcaacctcaataaaccagttaaattctaccactgtactttgtccagatatctcagtcgccttgttttatggtttctgtgtcaccctattgttgcgaacatgtttcttctatgtactcttacttggaaatgagagattcaaggcaccatttcctatttcaagattttttttttcaagtactttttaagaaggtttcccatataccagctcctttaattttgatcttcttaacatctttataagatcagcaaggcaggttttttccccatttttacagcagaggatacagaggcataaacaattgtgtgcctttcttgaggtcacacagctagtcaatagagagctggggcctgaggtcactcactcgctggtttgtttcctcattcatccaatcagtttttcatgcagcaaatgtttattggatagcagttctctggccaagcactatgcaaggtggtgggggtgcagtgagcgtacagttcatgccctccaggagctcatggtccagtcagggagattaacaaaaaaggaaacagagttcagtgtgggaagacaagaaaaactcataattaccaagcggagtgataaatgatataatacacctaagcattaggtgctccatgagcacaagaagtgtctaatctagctttggggaccaaaaaggcttcctgaagagggcagtgtccaggtggagtaagttaggacaaggggactaggaaggatgtttggggcagaaagaacagtgtgtttaaagaatgcctggtgagtcagtaggagctgcctgtgattcagtctgtatggacagtgacgggggagagggtgggagatggggcttggaggaaggtgggttagaccatggagggccttagcccagggaagtgacatgatcatatctcatattgtcagaggcatttgagccatagcaactctgttagtctgttttcatactgttatcggaaaggggtcccaatccagaccctaagagagagttcttggatcttgtgcaagaaagaattcagagtgagtccacagtgcaaagtgaaagtaagtttattaagaaagtaaagtggtgaaagaatagctactcactccatagagtaggacgttcccgaaagtaggaggatgaatgtgcccaccctacgtatgatgtttgtttatgtataggataaaaaaggatcatggggagatgtgctctgctacaagggtttgtgataaaggattcattttcttaattactatattttgcaagaattgatattattattattatttttttttttgagatggagtcttgctctgttgcccaggctggagtgcagtggttcgatcttggctcactgcaaactcacctctcgggttcaagtgattctcctgcctcaacctcctgagtagctgggactacaggcacctgctaccacgcccagctaagttttgtatttttagtagagacgggttttcacgtattggccaggctggtctcaaactcctgaccttgtgatctgcctgcctcggcctgccaaagtgctgggattacaggcgtgagccaccgtgcctggcctgatattattttgtttaaagcaaaattaggaatgcttctgttttcaagatattagggtatcaggacattcctgaatctgggtatgtttagtaaacgttatcaatctgttcccttaatcataaatagctagagcctaggaatacctaacttcctgggaatgtagcccgggaagtcccagcctcatttttcctagccctcactcaagatggagttgctctggttcaaatgcctctaacaacattgctataaagagctatttgagactgggtaatttataaagaaaagaggtttaattgacacagttctgcatggctggggaggcctcaggaaacttataatcatggcagaagacaaaggggaagcaagtactttcttcacagggtggcaggagagacagttgggtagagggtggggcgggagttgccacacacttttaaaccatcagatctcgtgagaatccactcactatcatgagaacagcaagggggaaatccacccccatgatccagtcatctctcacaggacccctcctccaattaaacatgagatttgtgggcggggacacaaatccaaaccatatcagactccatcttgaatagaagctgggtaaaatgaggctgcgacctgctgggccgcagccccaggaagtcaggcattcttagttacaggatgtttagagttaagggaacaggttaatagcatttaccaaacagattcaggacttaacagaccaaggaaatgtcctgatgtcctgatatcttaagaacaaaagcattctgagttttgctttaaagataatatctttaaataataatatcttcttgtggaagacagtagttacacaaagatgaataatcctgtgtcaccagccttgtagtgcagcgcatctcctccatatggttttttgctttgttattttacatataaacaaacattgtacataaggtagatgtgttcctcctcttgcttttgggaacacccagctctgactgggtttattggtggagccattcttttattcctttactttcttaataaacttgctttcactttactctgtagaattaccccaaattctttctggcacgacatccaagaaccatctcttggggtatggataaggatccctttctgataacagtatttctcaagagtggcttggggtagagaatttatgaagcgtggaagccacttagggggctgttccttgtgaaagacaatggtggtcactggactggtgagaagttaacagatttgagaagtggggaggatgtcaagttaataaaatttagtaggctgggcatagtggttcatgcctgtaatcccagcactttgggaggccaaggtgggtggatcacgtgaggtcaggagtttgagaccagcttggccaacatggtgaaaccccatctctactaaaaatacaaaaattagctgggcatggtggtgggcgcctgtagtatcagctactcgggaggctgaggcaggagaatcacttgaacccaggaggcggaagttgtattgagccaggatcgcaccattgcactccagcctgggtgacagagcaagactccatctcaaaaaaacaaaataaggccaggtgctgtggctcacatctgtaatcccagcactttgggaggccgaggtgggcgaatcacgaagtaaagagatcgagaccattctggccaacatggggaaaccccgtctctactaaaaatacaaaaattagctgggcgtggtgtcgggcgcctgtagtcccagctactcaggaggctgagacaggagaatcatttgaacctgggaggcggatgttgcactgagccgagatcgtaccgctgcactccagcctgggcgacagagtgagactccatctcaaaaaataataataaaaataaaacaaaataaaataaaatttagtggttaaatacgggggagaagagaagagagatggtttggattacttccagatttctggtttgggaaacagggtcatagtgatggtatttcctgagaccataaacccaggcagcagaagacaggtctagggtctgataggggataggagaggaaatcagttttggacctgttgaattggaggaggctctgcacaatcaactggttatgtttcagaacttaggagagaaatctgggctggaaataaagatttgtgattcatcagctcctaattagtctcagtgattcctctggtagttgaaactttgaagtggctaaagtaactcaaggagagtgtaaaatgagaaggctaatgaaaaacagtgggggaaatcctgcatttaaaggagagatggggtaataaccacttacaggaaaccgaatggagtggttggagaagtaggaaaacccatggaggtggcggggcgggggagggcagtgggggagtggttgttgccaaagaaagagccagaggtcacctaggtcacccatcagcacagatgtcttcacactgcttcgccagcctctgaaagatcagaggatataacctaacctgcacagggtgtgagcgaagccacagctctccaccagctcagcagtctaccaggtaaccctacctatttaggtaaatgttttgaggtatgagaaatatgagataacctacttcttaacttgtaagcaataaatatacgttttatgccctgagtgcatggcatggcctagaatgaaaggagtaatttttttgtttgtttgtttactgataaaccatttgcttcatctgttaaatagaggtgatgatacttatagaataggataggattgtaaaaaactaagtgaataaatgtagatatgtagtgctgagcctaacacacataggtatccaatgagtgagggttagttctctccctctatctctatctctctatctctgtctctgttttctcttctttttttctttctttctttctttctttctttcttttttttttttttttaagatggagtcttgctgtgtcgcccaggctggagtgcaatggcacgatctcggctcactgcaacctctgcctcctgggttcaagcaattctgtctcagcctcctgagtagctgggattacaggtgcacaccaccacgcctggctaatttttatatttttagtagagacaggatttaaccatgttggccaggctggtcttgaactcctgatctcaggtgatctgcctgccttggccttccaaagtgctgggattacaggcatgagccactgcttccatccttctctctttcttaatagaaaatttgtgcctcataaacttaaactgtgctgttttggaactcaagttttttaaaaaatatggcagatttccatgaagaaaaaaatgtaattattgattgaattgtgccattagcattagaattagatttataacaaatatgaacactgtagtaaacttgcaaacaaaacaaagcaaaaaattgtacttgttatccccttgttgaatctggccctctgtttcaaattaattagatttttggtaactatgctaaactttgtcacatccttattaaaatgactgaagaattttgaagaacagctcagagggactctgaaactaatctgagtctagtactggagattccattagcaattgcaaagctgattgatcttttacccagttagcttattgattatcgctgcagttactgcatgtaacggattatgcaaggggtaacaggagaaaacacattttataattgctgctgatgtattcagtttggacacaatatttcatactctatataattatttctgcatttttaaatgctgcaacacttctaagatagaaagtttgcttaatattgtttcaatatgaggaggtgtacttttaaatttcttaactaataatgcattacagtttaccaagtgccttcactaattttattgctgcagtttaatttttgagcctcacagtaaccctatatatatatattttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccgggatggtctcgatctcctgacctcatgatccacccgcctcggcctcccaaagtgctgggattacaggcgtgagccaccgtgcccggccagtaaccctatatattagggtaaatatttttatgctcatttggaggaaactgatgtttaataaagttaaatgtcttcctgaaggctacacaagttaatgagtggcagacttagaattcaaccccatttcaatcagtaaatgtttattaaacacctactatgtgcagagctttgtgttagggctaataaatgccaggataagattatagacctgaagatgaagttatttggataacttgaagtaatattatgaaggttactttgttacatttctgtccaagctattatgttcagtatcttagtgtacaaagtttaggggtgtttttttggtcgttgctgtttgtttctttgtttttttcttttcttttggttttggtcatttctgcttattttatcactatttagaacaaaattggagagaatccctttaaaggaagagtatatagaaatgacactaatagatccagatctaaaaacaatttgctggccgtgtgcagtggctcacgcctgtaatcccagcactttgggaggccaaggcaggtggatcacctgaggtcaggagtttgagaccagcctggccaacatggtgaaaccccatctctactaaaaatacaaaaattagccgggccagtggtgggtgcctgtaatcccagctacttgggaggctgaggcaggagaattgcttgaacctgggaggtgtaggttgcagtgggccaagattgtgccactgtactctagcctgggtgacagagcaagactctgtctcaaaaaaaaagaaaaccccaatttgttttgcagtttattacttgctgtcttctctgttttcccatgtgagcctcacagctatcctctgggtagagcccgtcttgattttacaaatgagtaacatgaggcacagtgagcattttgtcatggaggtcacatgcttggagacaacagttagtgatggagctcctgggtttgagccctctgattcattcatgtgccttgctcatctcactgagcagcatggacctggtggccggtcaggactgctctgtgctaagaggtaccatgcatggccctgcattttatccttatcccatggggaatgctccgtaggcagtagcctgagtttctaggcctagtgccttgttggtggctgttcctcaggggccagttgtgtagggcccacactgtggttttgattacctccctttacagcatgtccttgatggtgaattactttgctatgtggaacataagcttctctattaatacagacacagatcaaatgcagtagtccagcaggagaaaatatacttggatttagaggaaatataaaaaacaaaaaacacaacctaactactcgctttagagaaactgttaagtggcatacttgatatcattactgtgactgtgttagtcgtagtacagagagatgtttatagatggcttaaaaattctcacaatgattataaaagtgtatatagtttgccagttgatttggcacagacctaaaatgaaaggaaaaccatttttatttatttattctgtgaggtaaataaataaagctggaaaacaggtcaatttcatgcatgcgaggttttatagtaggaaaaaaaagcattgcacctgttctgaccctttacatttgaggttatttgttttcaaacttgaccccaagcaccagttttagacatctctataattaacttgttagataaagcataaggatattttatttgtctttatttctaggataatggcaaagtagtaactgaaattactagcctattgtacatagcagttaattaaagaaaagcattaactataggagaacaccaccactgctgttgtcttgtatcagtacaaaaaggcagtaatttttttgacagccactgattggaaagttgcttgcagccttccagaagcaagggggtacatgctgtggatcaataaccggcaaatttcccattaaaaagaatacctgagcaatgttccaaatagccactggcatcttaattttccatggaaacctcaaatacttgtgtgccgaggacaagtcattttcggacaatttttccagactacttgttaacagttattgctgtcccaaaaggttgacagcctacatgattgatatttcatttacttgtcatcactgtttgagtaatggcgagtgctgtatttctgtggttttaaggaacagaatctcctgaaagacatttgccttagtatgtattccagagagtgtttcacatgtttatgccgtatgtatataagtttttatgtctgtagaaggagagaatcactttctttacagtttgaaaccctttggagagctgggtacacttttatcagtgtgtagctatccaacatccaccttcactttatttgttattagtgcgaacagccttagatgtattaacttgtgattcccaaaatgatgtggcattttatagctcccctttattttcaagaggaaaaaaaaaacccttgctcttgtaataattttaatgtacataaaagcaataggaagatatatgtgatatcttctaaaaaaaaacttttaaagaatgtcagcaaacaatagtaatcaaggagggatttcctaaacatatcgtatttaaataatatgcacatgtttttaatatagaaacagtgaggatgaaaaggatgttctgctctttgacagcccctcaaaacataaaatcagcagttttcattgtggatatttttccactaggagcatcactttgttatttgtcgagcattataagatgtgagagcacagaagccatctccaagttaggtggacatatgcttacaaattagcggagtggtaatcaaaccacagtaccacctactgaataatttgtgtttactaaggagtgtgaaagctttttcacttagaactttattttttgtgtgcagaattttacagtgcaatttgatccgtactaaagtgtttataaggctaaagcataaaaggtatgtttgtttgaaactaggctacctttttatcatgttaatcctgtcatctttggatgggtcatattttgtttgctatttccacagtctctgtgatttcgatttccattatctgtgcattttatacacaaattgaataatgtttgattaactggcatgtaggtccaagcccaatgtgaagcttcttcattttgctttgcaaaatccagggaaaaagagcaagaggcaatttgggaaattccactaaaatgctttatgtgtcgtctaaatatatatcattttcaaatatttcttaaatactaatataaagtcttaatcaacacttttactcttaaagataaatgccagggtgaaggctaacacactggactttcaatcctaaatattcactatagtcattttgatgtgccagtaggggaaaagtattctcaaggctgatatgtatataccagcaatttacaaaagtactgtgaattaaacaacccataagtgtctgttccagtattcatacattactgagtgatctctttctataatctctttgcagtattattccacagtaatggaacagcaagtaaatggacagttaatagagcctctgcagatatttccaagaggtaatgttgagcaaattctaatcaacaatgattatttcagtaaactgtttcatcaacagttatgtttccaaaggtttaaatgcacataacatgatgtttagctcttaattcgaaaaacaaaagaagtattcattatcgtggggattgcaggctatattatagttatggcagataaaatatctaatttactagagtaaattaaactaactagattgttttttgtttttgaagtacatacttacattagcttaaagaactcttttgggggtccacatggtttctaaagcaaggcaaatgaatgactttaattctggatatttataaattgtggctcatgatggtggccaaagctgctattgaggagaaagctttcagttagcacagaagcgaagatttactgaggtgttaggagagaaattttggtggaatgtttggtatctggttttttgaggaggtattttctaaataattgaaattcttcataaatggaaatttgattatctccaaaaatatgagctgatgagagtaagtttcagtgaatcacttggtcagataattttctttttcccttttaggtttggcagtactatccttgtatcagatatgattgttcaaccgtgtataaatgttccctcaaaatttgaataatggtgaacaagaacagtttaattatataaaccattaagtctttcacccgttatacattgccccacttggaatccatgttttctaactaatggaacagataaggaaattctctaagtaacccttctagaaataacttaattgaaataattaaaagttaaacttaccttcgttaactgatactgtacaaataatcatggtatgagttttccaattaaacattctagactttcattacctgtaactctctgaagtttgaatggctcaattaaccagtaggctcctatttgcactgataaagtctccaaaggcagctgtcttggccaacccacaagaagatctgggttcaagaataatactgctcttccagcatatgtgtgggcagcagaatcaggagtgcttagtatattactagtaacttattgaagtgctaagtaagtacagttgggctatttaaggccagtgatagtccaaaacaaggattgtgattaatccacttctgttgtacttgaagattaagcaccaaaacagaaaaaaagaaatgttgctatttctgtttattagtccaatgattaggatgtagatgatttcttttttttttttttttttttcgagacagagtctcgctctgccaccaggctggagtgcagtggtgcaatctcagctcaccgcaacctctgactccctggttcaagtgattctcctgcctcagcctcctgagtagctgggattacaggctcgtgtcaccacacccagctaatttttgtatttttagcagagacagggttttaccatgttggccaggatggtcttgatctcctgacctcatgatccactcccctcggcctcccaaagtgctgggattacaggcgtgagccaccgcgcccagccaggaggcagattatttcttaatgtttgcagtgactggagaatttgggcaagtttcaaaattctttcttcacaaggagtagtattttacaaactgaaaatttccattaatttctctattgacattatagctctgccatagaaaaccctaattgcagtatcctggagaaatatacttccaggcagggcacagtggttcatgcctgtaatctcagcactttgggaagctgaggcaggtggattgcttgagctcaagagtttgagaccagcttgggcaacatgtcaaaaccctgtctctaccaaaaaaatacaaaaattagccgggcgtggtgcacactcctgttgtcccagctacttggtgggctgaggtgggaggatggcttgagcccaagaggttgaggctacagtgagccatgtttgtgccactgtactccagcctgagtgacagagcaatacattgtctcaaaacacacacacacacacacacacacacacacttccaatgttgtgggtcttcatttgtctctaaaaaattttttttagttatcttcatccaaattctttcaagttttgtttgttttctttccttttgtgagcagtcctgtcattctcactgttcatcgcattatgcttcttcccatgataatcacaaccatttttagatgtctgctctgttaaggcattaatattgctttacgcatcatcatctgtaatcctcctgatagttctgcctattaggtattactgtttccaatttatagatgagaatattgagattcagagaggttaagtaacttcagagtcacacagcttataagtgcttactatgccctttgagtaagaatttcatttaaattataatatgattaaaatggaaaggcatatatattaaaatataattagagtgtgcatgggagtagtttggagggcttgttttggagtggagaggagtatgttatggggagaggatacttaaaggaggaaattatatgagatgtcattgtcatatgtagtcttagcataaaacccactaggctgcaataaattgttaaacatagtctttctaagccaaatttaaatatttcagaatatgagactgtctttttatttctgtgtttttttaatatgctatggtgtaattgtttctagtttttggtagtcttttgctttttgctacctgtctacatcgaatgtacattttatcatatgtagataagtgaaattatgcaaatttacataatcgacatgtagacatactgggtatatttcctgtgtctacctagttggttagaggccctcagatcttaaattttatggttaggccccatgttaaaaagaatctttagactgaacaagtaggaaggataggagaaaatgattgtttccttatttatttatttatttatttatttattttggagacagagtctcactctatcacccaggctggagtgcagtgtgtgctcactgcagcctttatgtccccaggctggagcagttctctcgcctcagctcctgagtagctggggctacaggcatgtgccaccacgctgggcatttttttttaattttttaatagcgacaaggtatcacagtgttgcccaggctggtgtcaaactcctgagctcaagcaatcctcccaccaccacttctccaagtgctgggatgaaaggcatgagccaccatgcctggccataattctgatgtaataacatgttctcctcattccaagtagcacagttgccttggatagtaactcccaggtcatggctaagtcctctacattgttaaaagatatgttaaatattaataagtgtgaacattgactagctttatagtaattcctgacccgataactttaggaaatatgaggttactgggttttttgactgctgtttacatctccagttataaaagtttgagaagtcaattgaggagtgaggcagatgttaaggttagagataagagttgatgtttgtctctgattccttggctagccactttgtttaaatgaaatttatgaatgcactgcttacttcagtggaaatattttgaagtgttgtcttaggaagtattgatggtccctcaaggaccagacgtcaaatgcatgtgactgtagttcaaaaggttaatttccattttaaggaaagaagattttgagtcttaattttaatgcattttagaaaggcaagtaaaaacattttgttatggtttagatatattttctaggaaaaataacataataaatttgagtatatttggaatatacaaaatgaaagcaactgcagtgttttgtaattattacccatatcttctccttttttttttttttttttttttttgacacagagtctcgctctgtcgcccaggctggagtgcagtggcgtgatctcagctcactgcaagctctgcctcctgggttcacaacattctcctgcctcacgacattctcctgcctcagcctcccgagtagctgggactacaggcgcccgccaccatgcccagctaattttttgtattttaggtagagacagcgtttcaccatattggccaggttggtcttgatctcttgacctcatgatcagcccacctcagcctcccaaagtgctgggattacaggcttgagccactgcacccagtcattacccacatcttattattaaacagctctatttcttgttgtcagaaacaggaaaacgacatgtacatctgagagaggagcaaaaaaaaaaaaaaaaaaaatcaaattaattcgtccccaaacaatcaatcaaaattgatggccccttaacatacaatttgtagggcactatagttttcaaatagaagcagtctataacatgggcaggaggcttttgtatttttaacatttgttgaagaagcatttgctgaattggaaaagtactaacctgtaactcaagatggtgtcaggaaattaatattcttttttcctggcactgccttatctctaggactaaatcttagcatatgtcaagatttgcaagaaatgtaataaaattagttatatatctgtattttaatacatttgactgcttatggctgtgcaaagtagtattcaaactagaatgttccatcgtagaatccctagcaatctttttggcattaaaacatccttttctcaccccgcttgctcacaaaaaaatcccttagctcttttcaaagtagtttaagtgatagcagatatacaatgtaatagaatgaggacagattgcagaaatttgaattatgaaaggaatctaatcattttagctcagttaacttgatttttatatgttttaagcagaaattggaatttatatgaggtggtgtcagaaagctctttgcatttataaatgctcactcctgcaagttaaaaccctggttcataattcccactttgggtcttgggagccacttttcaatcatttctctctgctaattttggtgtcaccctcatttctttttaaacgattcattttgagcaaatttgtaaatggccctgatgtgttctacaatttagtcaattactgtttcagcctgcaagcctcctggggaacggaacatacatggcctgaaggtacgaatttcaataattgtttcagtaaagttagatggatttgtaatgctgtgttccacttattgaaatgtcaaataaaactgcactttctcaagctctgacaagcgatccttttattttttttaaatgggaggtggagggggattcatctgtagtatttgctcagtatgtgtatatatttgcatactgggggtttggtactgtattttcaattatttggaattgttttgttggtcagtgtcttcaggataatcctaggtgctggtatctacaaagattttagtaagaatatagacttcatttcagtgattaattaagcacataagcatattgcacatggaataccctctcttgacatatttatgctagaaacatatatctagttaatgtcttttcattctgtgtattttgaattctggatttctgtttagggcttcacatctgaaagaaaagctggcttttgtattaggctcaaatatttcataattaattatttggacctcattttttagtgaataagaaacattctacatacagtgttctgcttggttgcagagctggaaggatataacttgaggttcactactaacccctgggtatattcttaatgtactttttgaacatactgtttttatatgtattctagacagtgagttggattttcacactgtttatgtctcctttttcatcactgtttaagtatttaatggaataatgacaggaatagaatattatgtaatgtatgggttatacggttttgtaacctatatactgaatagactccaactgtgggtttgtctagcaacaagctaattaaccttcatagtgaaatgagaaatttgtggcaaattataggttaattagaactgtgtcctcagaacacaagactgatcaagattctttctttacttataggtgaatactcgggccggaccctctcaacacagcagcccagcagtctcagattcacttccaagcaataggtgcgagcgagcaagtaaagtgtgcccttgatgtgatttatctacagagttggggtggggtggggaagaagctagaaagaaatttgaccagttagataacctagctacgtattgaccaaagagaaaggacctcatatggaaagatgaatgtttagatttagactgggtgctgagaaggctctctggggagagtgacgtttctgttttgacctgaagaagcagagaagggcgtttcagacggagggaagagggtaggtgaaggccctgaggtggagaaggagctcagcatgtttgtgagtaggccagtttggcacagggaggggtgctgggttggggaagggatttggagagaggagatgagagagcaataggagtgataggagctaaggaggtagacaggacttatcatgcggggcctcgtaggccctgtaatgtttgaattttccttttggtgcactggctagcagttagagggcttttagtaggagagggacatggccagccctgtgtttttaaaagatcctctgcctgtggtgtggcgaatgagcagaagctcccatctaatcctgccctcctttgatgtttgacttcctactccttgccaaatggtcatcaaatctcttactgaacatccctgtcggaggaatgcactttatcagccaacgcagctccttcccttttttacttggctacatctcagaaggctcttttttgtgagctgagatttgtctttctatagcgcccactcataacgttttagttaagccctcagaacgtggttgttccctcttccaggtcaacagctcttccagttgtcttccctccaaacacagttctagattttctgtctcagtaaattctcccacatccagtccattgctaactccagataacttgtcagtcctccttcactgcttcctaggcctccctcagtgccacaccctgtcagtccccacacttgtgggttctaccttctgagtagctctgcgtctttctactcgccagcatccctgctgctgtgtgggtggttccagctctccagatcactgccacagcctcctgagagtctactccctccgttcttggcccattcagcccctcctccaccctgcagctggagccatcttgccagtgtacagtcctgagctgcagtcattccctgctttaaaaccttcactgctcttcatgctttcaagatgaagtgtaacctccatagcaggtgagcagtgaagagcccttcacatatgggtgctctgtgtactccagcttgctggcccacctctgtaccccatcccacctgacattccagctttgctgatgaacacatagtgccctgaatggatcactttcttctctctactgggcctgcacattttcccgttttcctgtttcttttcatccccaccttgaccttcagtctggctaaccttggttatctttgaggactaaattatcttctgagaactgtccctgattactacccatccccagtgcacaccagggacctctctaggaattcctatgatactcccttcttccttgtattgtagtagtgagcacattgtattataatcacccctgtcctccagtagattctatactatttgagggcagtgactgtagcatattcattgacaaagttccaattcccagcatgatgcttgccacatagattatagtcaatcatgtttgaatgaatgaatgcatgaatgtatgtatgaattacttgtatttcttttacatcttacctctggactaaattctcccagctctttcatcttttctgatatgacattatttctagtcccctcatccttttctcttctttggatatctcagtgtctctcttcaggtgttgtactcaagttacagttgtaacacatttaaattttaaaatgtttttattttattacttttttagagatgggatctccctctgttgtccaagttagagtgcagtggcacaatcacagctcgctgcagccttgacctcctgggctcaagtggtccttccacctcagcctcccaagtagctgggactacaggcttgcaccacaatccctgattaagtgttttttttttatttttttaaatttttttaatttttagtttgtagagacggggtctcactgtgctgcctaggctagtctcaaactcctggctcaagcaattttctcactttggcctcccaaagggttgtgattacagtcatgaaccaccacagctggcctttaaatgtttttaaaagtgatttttggatagcttaggtcaccgtgaacatgcagatgaatgaaatattgagtaaagtgagtcacagagaaattgccaggatacaattttttcttttttttttctttttaaccagacaaagttgatagccagatactagcataatgaatgaaacagtattttcctctattactctcaaagcatgggttgttttttcttttgccttaggtgaataactgtttattaaactgggtttactaatgcacatggtgttcctaggccataattactgaattcaagtcccattgccaaggcaaggcctttcctaaactacttagctttctccttctgtaaattaggatgattaaactttccatctatctactgctggtgttagaaagattgatgaagctgtattaggaatcacgttttatttcttggatgaaaggcattctataaatgcaatgaatcaaaatgttattaattcaagtttataacataatggaatatctatgtagaaaccttgcctgggctttgtttggttatttgcgtctttacaataattggaactatcaactgggagtcatttgtgggaaaactaggatctgaatgtttcccagaaaaaaatgtgtgtgtgtgtatatgtgtgtgtgtgtgtgtgtgtgtgtgtataagagatagatggacttcgagcaagatctgtaccttagaggtctgtattttagtatcctttataaattagggataataactatacctaaagtatagttattataaggattaaattaggataataagcatttagcacaatgcctagcacatggtcatcacttgataaatagcagctgctattattatgttaactggactgattttaggcagctgtgtattttttccatatatgtttcagctttcatcctattctacaaaattgttaattgccactttagtgcatcgattcttagatgtggtgggacattaaagtcaagaacccttggatgaagacatgctttataaaatctaggaaaatagggactcagtctccatagtttacatttgaccatagcaaaagtttaagatgtatttagaaagaagagtaattataacttgaagtggtaaaatgtgatcaaacttgaagtctgagattctctcaaatgtaacctattaaaggtaccaaatggaatatgtgtatttcatattaggtcttgagtcctttctctttttttccttttcatttcttcctttcttgctccttccttcctccctctctccctccctccctctctctccctccctctctctctctctctctctctctctctctctctctctctctctctcactctctctttgtttctttttgagacagggtctcattgctgtcacccccccattctggagtgcacaattacgggtcaccacagcttcgacctcctggcctcaagtgacccgagtagctaggattacaggcacatgccgccatgcctggctaagtttttaattttttttagagatggggccctactatgttgcccaggcttgttcttgaactcctgggctcaagcgatcctccttccttggcatcccaaagtgctgggattacaggcttgagacgctgtgcttggccccttttgttttctgatgtatttatgatcttaatgtcttactgcattactactactgccaccacagtataataataaccagagcagcgaccaccatttatggaacccttagcatatgccaagtcattgggctatatttaagggtgagaagagagtggagtatatagaatacgtaagatgtgtctgtgttctcagggagctcccagactctcccctgttgggggagggtatggtaggaagaaagacatctatactgacaactagcatgggtaggtaggtaaagggctaaagtggataggttaagaatagagttggctgggtgtggtggctcatgcctgtaatcccagcattttgggaggccaaggtgggcagatcacgaggtcaggagtttgagaccagcctggccaacatggtgaaaccctgttttcgctaaaaatacaaaaattagccaggcgtgatggcatgcacctgtagtcccagctacttgggagactgaggcagaagaatcgcttgaacccaggaggcggaggttgcagtgagctgagctcacaccannnnnnnnnnnnnnnnnnnntttattattattataaaaaaaaaactggagtctcgctctacatgataggctggtgtgcagtggtgcgatcttggctcactgcaagctctgcctcctgggttcacaccattctcctgccccagcctccagctgggactacaggcgccggccaccacacccggctaattttttgtatttttagtagagacagggtttcaccgtgttagccaggatggtctcaatctcctgacctcgtgatccacctgcaccagcctcccaaagtgctgggattacaggcatgagcaccgcgccggccccttaacaggctttaaatctcaaatagaacattgctgggggaaggtgctattttaaatgctactctactagtcaggtagatattcacgggtataactcattataaagctagacgacttaagagctccccttgactaccatttttcttcaataaggactttcacgccaggggtggtggctcccgcctgtaatcccagcactttgggaggccgaggcgggcagatcacctgaggtcgggagtttgagaccagcctgaccaacatggagaaacccccagcttactaaaaatacaaaattagccaggcatggtggcacatgcctataatcccaggtactctggagactgaggcaggagaatcgcttgaacctgggaggtggaggttgtggtgagccgagatcgcaccattgtactttgcactccagtctgggcaacaagagtgaaactacgtctcaaaaaaaaaaaaaaaaaaaaaaggactttcactaaattcatccatatgagtgttaacatagtcatatatgttcagaaaacactttaatacttcctaaataactctgggagctgagtctcatacccataggaaaggaaaaccagctaaaatttattaattttatttgtaaaaacacacctgctatggacaagacacagtgctagattttttgtaatatttaatttttctggttaccctataaaattggtattttccccattttacagaaagaggaaattgaggttcagagaggataagtaacttgtcccagatcacacagctagtgaataccaggatttatttgtactacatatttgcttcccaggaagctgaattataacttttaactgtgtaagagaccaggacttaaattatctattttgtcttttgaagttctataatctttatttgctgtgaatattagtgcttagcagatgacattgtccacatgaaattgcctctgaaaggctatctaaaggcagtagaactaatgaccataaaaatgtcactgaagtagttcataagatattgtagcttcatcttgactgtaggcttctttattgctttcgattactaacagggttttagtctctttatttgataccttttgcatttggccagttacttttgaaaaaaatttacattgggagaaggatgtgaagaatatgctcaatccctatatgtaaaagcaaaggtgtatttcagtctggaattttcagtggtgttcagaggtgttgatgatcttgccactaaaaattatctttccttttcagcttaaagaagtcttctgctgaactgaaaaaaatactagccaatggccaggtaggtattattatatattaagattttcacataataataacatattaccgtccagtttttgtatccataagcttattaaacagataaagagtctgtgagtttcctgtcataaatgaataacatggcttaatttgattggcagaacaatttgcagcccgtttttcaaactgtgctaatgggtttcactcccagcagattgaagtaccatgcacacaccctgctgccatctcagtttttaaaaagttaatcagttctgaacaagtgtgtcaactcgtgggctgttgaaatggccctgcattctgaggtgactgtttctttcattatctttggggagaaaaggaaaaaccattactttctcaccttagctccttcttttgtcctgaaactaacactggctttttagggaggcagagtgacagcagacctttggcatataaaattcctggccttcaggagaccttagtttgcctagtagactggccatctaaagctgaatgacctaacccagccagtgagggacaaacgagccttcaggccagttatttcttactaattttgattcaagtaaatggacacatctgaaatagtagagtgcttttaaacatacactggtaaattaagctacctacagggtcctcgattcttcagtagcaacataaatgcgttttaatgtttgttatagtggaagccctttgatagccttggaggcaggcgcctgtccattgcgatcaagcctgcctattaggctgtattgactgagacatctgtgtcactgcaaataaaagactcttattgattttcttaactgctgttcacttcccgtccatgtttcgaaggctgaaatcttaattatctcagatgcttattcagtgccttcacacactgacctctccaagcctcactggcatttcatgaatcaagtacttgtagtggagcatgtcaagaagacaaagccaggtcctcatgcctgtcctttaatatcacctgtaacattgtggcctaatagatgtgcatgccttaaaacagtgctgtatggtaatgcttctggaggccttgcttatttagcacacaattccttgaatacagttagaagaaatgaagttgatctgcttctgacatctgattgccatccagagtatgtgaattctagtccttaaatatcctatatacagctaaggagaatctagtgtggtgtatgtataatctttgtagtctcaacattttagatagtatttatcgaatacctttaactttcagcagccaaaggtttgtttagattgaggtccacatctgtatcacctcagtgccttatattttgttagaaccagcatatataaacaaaatctgactaaaagcaaaaatattgagcctaggatatttatgtatcttcaacatgcttgcattctagttactaattgtaatttatgtatgagtcactgtgttcttcagctggaaaatatatttcaaaattgacataaattaagaagctttaactacatttgtccagcccagacaatggaaaataacctgtcatagactcttctttcaaaaatgaaaaacagttttttccactgcaaaaaataagcattttcataatgttttgacaaaaataagcagtctcataatgttttgacagtaagcctagtaccatagatatcttagtggcttcagttatgaggttctctatatggtgggaggttgtcctggcaaggatttttgacacttaaatgtttattgctttcccttgggaatgtgataacctcatattaaataatatggctttttttttctttataaggattagcctttcttacatttacttgcactcaaaaaattccctcaaaaaccaaaaaaacccacctttggaagctttcaaaatgtctccttctaattccttaattcctcagtgctataggataactaaacagtgagtgaaattgcattgcagtgaggtactgtgcacagttgtaggcatcaataaatttctgggctgaacactgacaccacttgatagggaagataaaagtcacatttaatgatactttaacacttgagcatagttttttattttagtggtttatgctctcaagcattaataatgatttgcctttccactagcctccacttagatttaataaggaattcatattaatcattaaaagaaagggacatgattcttcaagataatcaaatattgacaagttagaaatagctttctgcctgggttcattgatataggttatgtgatataaatatttatttcttttctgtcactcagagtaaatgccaccaattgattcagcattgatatagtgtcaacagttcataagaaacatttgactggcctgtgttttccgattagtctctgctctataaagtgggatttactaaatctctccaattgtctgctcatagagtgtgactgctttctgaaaccattattgcttcgatttgtgaagcaaaggtctagtgatgggactagtttctgtcagacctttacatataaaataaggattaattgagcatttttattttaatgatttataagcgataggtactgattcttcttaacacagacaataaacaaagaatattttctgtgttgatccataattgaattccatttcattttttccattaatttcattaatatattaaatcaagcactttaaaaaaagtttaacacttagtctttggaatggagacattgttttcctgttatcactttatgttggagtaattccatttttccagcttaaaaaaataaatcagaagatatttttggcaagttttattgagagctataaatcagtctcactgatgtgttttctggatttgtttttcctacttcagttatagtgtggcatcatctgtttaacattggcccttgatttgaaactcattagaaatagcccaaagtgtcaatttgaagaatttaaaaagtgcacagttactccaaagatatgtgagtttggcctttgcatctctaaagttattttttcttttttttttttgttttttagattttataggagagggtggcagtattttcctattcctgataaatcaagtataaatctactcagatcagatctagaactaattctggtccagctgcatcttttggctgttattttgataacttcaaaaagcctctagaaaaactttttgtatttggctgggcgtggtggctcatgcctgtaatcccagcactttaggaggcccacttgaggccaggagtttgagaccagcctggccaacatggtgaaacctcttctctactaaaaatacaaaaaatttgctgggtgtggcggcccatgcccagctacttaggtggctgaggcataagaatagcttgaacccaggaggcagaggttgcggtgagccaagactgcaccactgcactccagcctgggcaacagagcaagactctgtctcaaaaaaaacccaacaacaacaggaaaacctttttgtatatagaaaaaaaagggagggggaatatatatctactgtaaaatttaaaaagtttaaaaactgtatcattactagtatatgtaactcttagattcttacagttcatcttggattgcatatgaagagtgaaacataaatgaggctgtgtatgtaagtccaaactacacaacagccctcctttacccacacaaacccaacctgactctgcccatgggttgttgctgtctctgtttcttttatggcccctgcctctctttcagcaggagcagagctcagtgccagtcatttctctaaggtcatttgctatcttggcagttgacatgtaattgtaactcctgtggctttttcttcctcctccttcacatctattattctgccttttatttacttttttagtcaaaacaaggaacctggactgtatttaaaaactacttggaattggccgggcatggtggctcacgcctgtaatcccagcactttgggaggccgagtcgggcggatcacgaggtcaggagatcaagaccatcctggctaacatggtgaaaccccatctctattaaaaaaatacaattagctgggcatggtggtgggcgcctgtagtcccagctactcaggaggctaaggcaggagaatggcgtgaacccgggaggcggagcttgcagtgagccgagatcacgtcactgcactccagcctgggccacagtgtgagatctgtctcaaaaaaagaaaaaaaaaagaaaaaaaaaaactacttggtattgttgttgaataaaaagctctccttcacctcttttcaatttaaagagctgtgtgattttaaaaacatttttcttcttaaaaactaacatcgtagctaatgaaatttcttttaacttgtgtctttcagttgattgtttaccatcctgtgggccagtggccattgataggaatgtccctccatacttaataccggagacaaactgctgagctatgatgttgaactggagtatactgaaagactgagtttttgactagctatgtaacttaagtaaagtggactaaatggtcttagaatgctgtaaatttctgtgattttttaaatgatacttgatcccaactataatatttaaatacaatattccataagcttctaaatagcactttcttatataatgaacactcttcctatgcttcattttgaaaagtcaaattaatatccttatctaaatgaaaaaagcagaaatactactggttgattgtagatccctttaatgattttttcatagttaagatcaattaaattagcccatttgataagagatatgaagttctaaaaatattttttgtaatcaattcttgggctctgctttgtttttcccatcccccccaaatttttttacatgaggagtatttgtacagcatataaaaattagaaaatacaaataagcaaaaagaaaaagaatctgatattttttaatattaaaacacagtcaggccgggcgtggtcgctcatgcttgtaatcctagcacttttgggaggctgaggcaggctgatcacctgaggtcaggagttcgagaccagcccggataacatggtgaaaccccatctctactaaaagtacaaaaattagccgggcatggtggcgtgtgcctgtaatcccagctgctcgggaggctgaggcaggagaatcatttgaacttgagatgtggagtttgcagtgagccaagttcacaccactatacttcagcctgggtgacagagtgagacttcatctccaaaaaaaaaaaactaaaactaaaactaaaaaactgtcaatcagttcacaggccaaaggtttgcataactttaaaacattgtagaaagacattataggaacacgttgctcactttttatagatactaagtgacatggttccagaacttgctcttcaaaaccatttttatctttatgagactcttgcaatcctcctggttatctgaaggattccatatttgtcttgattttttccattcttgaatttgtttagacagtgttaattaatgcacatgcacatacacttgaaataaacattctccctctcccctcctcctccctgcactccttccccgcctgtgccctgacagtgttggatgcttactactccttgttaggttggagtgctgggaatgtggattgggtagcttcttcccttctcttttccctgtagtggatgtaagtggtaaaaagactatgatgtcagaattataccatttgaacatgctcagagacatgccatacctacccctttgcctatgaagtggtggaggggatatgactgcagactgtggcccctccagagtgtagactctatctactacatagcaacttcctgcttactcttaaaccttagtgccacaaatgcagaatttgtgtacttgagtgagtgaaatgtctctcgtagaaatttatgtcaagccatgatgagagtgtagcttgttagttaatagtacaaatcaggttgttacggacatgtttagattacttagagaaatgttctaagggaattagccccagtggcctatttgtgcccaccaatggatactgctatttacgtttccttcattgatcaaagtaaaccaaacagcaactctgctagtttagcatctcgtcactttatgtgctacttttcttcatgctgctttaaaatttatcattcggtccagaataatgagattttattttgtttatgccacaccttttatacagcttaaaatattttttttctgtattagtagtataaaggtagtgatgaacagaattcccctcaaataggaaaatagttgccaattgttctggcatgtctttcattacttcactgaccctaaatataataattagctgattgtaaagggcatcagtctggttgtactacaattaaattgggtgctggattggcctttacacattaatctgtcaatattcttttaaggattggtaaaatggcttggaaaagaagctgtttctgttacctgcattgtactcctaattatcacagctctctgaagcttcaacttcagaaatgtgtagaaggaaaatatttcccttggtaaatgaacccttgctttattcaattggtggaagtttagagtagagcaaaatatttaaagctttgctatactggtctgagagcaaactattttttttccaagtgatattgaattaaaaactccatccattttctgcccatgcaaggcagtgcaattccctggaaattgattttttttttttttttcagggcttgcagtggctttccccaagctttagctatatggaaaagaacacctttattaaatccacttagtgaataaagttggcagttaatttttaagcatctggaccagtgtgtagaaaattactgaatgcatcaaataaagtctgactagtcttaaagtcatttgataaataattgtatagggagctctctaaactctaaaacattattttatgggcacctactattcataatacaaatgagagtagttatttgtggtataataggttttatagaaccttgaaaaacatgcaaacttatatataaagttacgaaaatgactttaataaaaattacatgcctatgtatttttcctttatgtattataatattcgactatatgtgcatcttaagtgcattgatttcgtgcttttccatcttcataatatgatttctgcctaattattgctgtatactagtttgttatttgcaaagaaaagctatatctactctaggaaaatcataaacattatttagtttgttaaatgttaattatgggggtcatctgaggagttttctagggctgatttatttacagatcatgcattagattactgagtgtgtgtgtgtattgtcttcctaagtttgactttggttatgtgcagtgctctttggcattggttatatgcagtactggagactgttttcttatcagtatctctgacctgacccttttgagctatgttgtatcattccattttgacaccttttatcaaactttaatgaaatgacccaggcaaacaaattgtcattaaactttccatcacttcgtcccttggtatcgtcttttataaattggacagcaaacgttgtattgatcttctcgtttttgcagctgaacttgaaatgacccagactgcttgttgtttatggcccagagttgcttttccttgacatttccatccacagcatgacaccctttttgtttttctttctttcttgtggagatgaatgaacaagacatacgatatcgggacactcttggtcatggcaacggaggcacagtctacaagtgagtagtcaattttgtttaaactttctatccgcttttccaaatactgagtatccaagttctctgtggcaaagatttttaaatgaccactaacacttagattttatttccatatttgactccaaaattctgcaagacatctattttctcaagaattgcctggaaagtgcatttatattgcctttttaatatttccgagtctgcaactctcctgggtgtgtagttaatagtccaccattagtaagtgtacctttaactggcctgaagtttaatgcatttttttcctttgctttttaacactattattattattttttaacttgctagtaccctacgctagtcccctgcctgtttacagttatgcccagtggaagccagaccttataaataccattgctttgccctgtgtcaacactataagttattaaaaagccttcttcctgttgtattttcttctctcctcaccctactcccctgagataatttctacacattgatgaatatgttaagttataaagttctcccaaattccagttgcagtgatcttaccccaaaggaatgttcattttcatcttaaaaaatgctagccataaaaaatagttctccgacagggaggtcttctcatgcagtagtgcaaagtttaaactacataatgtaatatctggtacttaatagtctgcaatggtgtatgaaaaatattccactaggaattaaaaaatccatactctgtaagaaagccctgagggaataataaaactttcctccagagagctggttttccatgtatacactaatcctgcatcacattatggttgtgatattagatcacaaccacagatactttaacattgatattaatatgtatttccagagttgtaaaataattaacttattttctaattggttacccatgttcttagaattttaagttctgactaaccacatgaatacacataaaaattgccctattctatgaccatgaaggttcacatcctaaaaatcccagaacatcccctactcattgatgcagccttggtatagaatttgatttctcaggcttagaagctcttttgaagtaatctgatccagtcacccattcagggcttcagtgccctttgcagatacagccaagatgtgagtcctttctcctgaatatagtcctttaagaacttatgttcacatgtttggattgttttttcctgcagatgactgagtattgtgaacagttggtctgaaaatgaagttcttccactatgataattcagagaaataaataataacatgtttcttacatgttccttgggccttgggcctggcccttaaaattgaggtccaatgtgtctaatgatttttgcggctactattctctttccctggatcatactagcgttccttcccacgcaacctccactataaacggtatcttttcatcttagtcttctcttccttacgatctgacttagatttttcctgtgttctgaaggtacttaagttcaggtacccatagaaaggaaagaggaagaaggaacatgtatactctgatttgcttctattgagttccctggagggagcacttttcaaagcttgaacctttcttcttaatgcctttatgctgatagccaaatataataaaacaggaaagatttctggcaactctttgtattccttttatttgcttcaaatggaattaaaaaatgtttatttagactcctaacctacttatctgtgttatttcaccaaacctttagttttatattaattgaaggtctattgtgaatttattttcctagcttatttctagaagggaagaagcataagaccatgaaaccccagcagaatttttacgagacataatattctagatgttgacattttaatcctttattttaaaacataggtttgtttgtttgttggttggtttgtttattttgagatggagtctcgctctgttgcccaggctggagtgcagtggcacgatctcagctcagtgcaacctctgcctcccaggattctcctgcctcagcctcccaagcagttgggattacaggcgtacgccaccatgcccagctaatttttgtatttttagtagagatggggtttcactatattggccagactggtctcgagctcctgacctcgtgattcacctgccttggcctcccaaagtgctgggattacaggagtgagccaccagacctggccaggtttattttttaaaagagggagtatacagagaagtggaaaaaacatgcccatcccccaagggaaaattacaacatgaaattatgttaatgttgtttttaaaattgttattttaaattgtggtgaaatacacataactcaagttaacattttaaccatatttaagtgtatagttagtggcattaagtacattcacattgttggcaactgttaacaccattcatccacagaactcttcgtcttgtgtaatcgaaactctgcacccattaaacagtaactcctccatcactctgttaatgttgtttttagctaagaagcatggctagaacttctcctttaattagggctactatgtcaaagggaccattcttctatatgtccttgccacaagttttttaatttgctagaatgctgtgtgtaacgttaggaatttatcctaagagctcatttagctaccgttgctaatgctcactgtgagtgttgtaagatgtaatgtttttgacaggattgcttatagatggtgaatgacagtatcctgataattttcattcttatatagtagatttcttataaaaagaaatttcatttaccttattgcctgtgtgattcttgagaggggcggtgaagataccaaattgcataaccgcttgtcattgatcattgggcatcatttttgctcaggcttcagcttgtattattgttcttatatccctggcttttagtacagtgcaaagaaatgatataatcattgataaatgaggatccactttactaaagtctctataaaactaagtgtttgatgtgttatgattgagtttcttctacactaagttcaccttaatggtgttgatgataaaaaatatggtttttcaaacagcatgattacattataggctatgctacataaactagatgaagaaaatattggaaaatccactcattggtaacaaaactgcctaataggcttattccatttttttctttaaagtgtaataaagctaataagtgcaaagcaaaagtttaataatgcagtcttattcacttcacttgatggaatgttgggaatttcaagggatattataatcgtgtaattacaatgtatatgatttaacagttgatacattttcctcctttaagtgtagatatccttcacagttgtacaatatgaaattctggccccagacatttaaaccaaatggtaatgtgaattctgtgtgctgtctcctgacgagctgtgctctatattatgagagtgacttaggcaggtaattttaagttggtatttcttggattactaatttgggctacatggaacataaaggaaataccttaaagtatggcccaagcctaggaagaagaaaagtttaggaaaagataatgaatgtattttccttgttgcctcatttcctaaagtgctgcaagttgctccaaaaaaataaattcaggaaagacacatgttctatttccctctgagagattcataatgaatttcaaaaactttgagaaagtagagaatagtatgtgttgtggttaagtgtgagggctctaagtttgaatcctgcctctgtcactaattagctacgtaacctttggcaagttatataatgtcttatgcctcagttttcccatctgcaagatggggataataatagtatctaggttgggcggggtgcggtggctcacgtctgtaatcccagcactttgggaggccgaggcaggtggatcacgaggtcaagagattgagaccatcctggccaacatagtgaaaccccgactctactaaaaatataaaaattagctgggcatggtggtgggcgcctgtagtacccagctactcgggaggctggggcaggagaatagcttgaacccgggaggtggaggttgcagtgagccgagattgtggcactgtactctagcctggcaacagaacaagaaaaaaaaattaatagtatctaggttgttgtgaggttaaatgagaagatccgtaaaaggcttagcactatgactgacacttattaaatgttaactactggtaatggtagtactaataatagaaaaattattcacattttgtacttcctaccttgacttggccatgggactcttttcttttttttttttgagacagagtctcgctctgtcgccaggctggagtgcagtggaaagatctcgtctcactgcaacctctgcctcccgggttcaagtgattctcctgcctcagcctccctagagtagctgggattacaggcatgtaccaccatgcccagctaattttctgtattttagtagggatggggtttcaccgtgttggccaggatggtctggatctcctgacgtcttgatccacctgccttggcctcccaaagtgctgggattataggcgtgaatcaccacccccagccagccatgggactctttttgataaacatctcacagaattatagttgtgttgaactaactttgagaaattctgcctttatattatacacattatacttctgtattttcttctattctgtagttgcttaatgaatcatgatatcttatgtattatcttaaatacaatgattttttaaagtttcaaagtatttttaatcctaatttattttcagattgctataggacagctgggttaagcccattttaccactgaaaaaactggggcttatcatgtggccattcagcagcaaagccagatttctatacagcatttcttttctttttgcttggtgttcttcccccaggcagtgttgtctcaaggtcaagcagagtccattttgttttcttgtgttttctcatgtacccagcacagttttaaggataaaatagacccttggtacatcttggctaaaatgagaatgaggcaagtggaggttttagtggggctctttcattggatcttcctcatatctagctactttgcgaggctgtacaattgttgtagaacattcacctagaagaaaaagaatatccacactgaggagattgatattcgaatgattaactttctttaaaatgttaaaaccttcagtgcttagtatctgttgactcactagttactgtctctttttcttgggtagtatgtcatatggaaataaaagtaattaacaggcatagttactttggaaacattgtttgattccaaagccagtctctcagactctgcttccttggcatatcatttgatggagtcactcaaactttggatctagaaatgaagtaatatttaacttttaggattaaatcatagtaagtcagttagccagcaatcactgaaagattatcttttatattattttttccttaatgccagttattcaagccaagactcatattttcagctttggggccagataatctagtctcaagatgtttgaaaactgaattttctatctccagctccttcccacaggatagagtaagagtctgatctggacttgaggtagaattttctcagtgatacaatgggtagtatatatactgccttcaaggtgttttgaaggttgaatgtataccattacttaggaattaatttgaacctatctagagacaataagaggagggaaggaattgtcattctcaaagatgctggtctctcctcctttctgttgccttatctaaaaagaggtatttgctgggcagtgggctggggatggtccttggaggtggtaactgagatcctgtggcctattaggttgtgttttgcacttgtgatttgactgtagaggccaactaaaacattaaattactgtttgggagctggaatcatattagctcattatagtaatatgatttatttaatgaaaattagaaggactgatggtcatttgtataaaatgagaaaatacataaattgtctagttaaatgctatttagtaaacagaatatttcaaaacatggaattccttaggggaaacagaatgaaaagagtccttggtggtgaaaatattgggaaccacatagtacccagaaaaccttgacttcctctttcaccaaccaacctgaaggtgtgaaacttaaagagggagcaagaggtctggacccagcttcgcttgtggctgtgttagtggccctactcctttatatatttttgcatgatgtgtatcttgtaaattaagagtagtttttaaatggttttaaaattgacctgagagctagaatgatggtttgatttattttgactttaaatttctaatcacttaaggagtcttttccttgcagccaagatcatattttaaagaagcaaacaagacatcatcctaatgcaaaattaaatatttgtatatgactggattgcattatagtatcgtgacaagcaaggatattaatgttttcagaaaatcaatgaatatttgtcaaataaaattaattatgtatgtttccttctctccttctctcagcattcattgttacaggtttgtttcatacgataatgtatattttattgattcgaatctaaggaatgaacctgagctcatggttctctgtacctttcccacctttgcttttccccacctctccatgttcctgtaacttcatacatgctcatatccattatggcaatgatgtattattggcatccagccaacatgacaggatgtcacaggtcgctgagcagagattttcagactcagtttccacccgaattaactattattgaaatagtttattgagattgaagtattgatcattttctgctaaccttggcttaagggaaggaagaagaggcagtagtgtttttgaaagacactaaatttcatttttaaaaatctcatttatttagcctttttttctttctgttttatagcctttattgttttattgcttggaaaagggtatcttggttttattttttatgatagtataattatacttcagaaatgcacttgattactatgggtaacaaaattgttctagtatattggtttggccaatattgctatacaaacaacttttcagtcaattgagtctggtaaaaatcaatacgttatggtaatatttcaagtaagaatttgctgaatctaagtgtttcaacttcatctcctctcagagaaaaaaatagttttgaagtggcaagacttctttctaatattttagtaacaattttttatttataaagacgtttaaagtccccagcaaaagtggttgtgatcaggtaaacattacattagcgcacttccgtgttgtagggtgtaagagatctaatttccatttgaatctattccctgccacaccaagaaggcataacatcagggactgacatagtgtctgtcacttttggattctggattcctgtatgtagttctgggtgctgagtttacagacatatggacagttcagagagcacccagaggagcaatggagagaataatgagggattggggaattgtgtctgttcagtcctccttcattcatctgtccagcagccaagttctgagcatgtgctgtgtggagggcgtgtcagatgttggggacagcctagcctcataaaacttgtgtctggatagatgaggaagttctgttctcaggtatgcacaggaccccacagtctggggccacctgtctgtgtgtatggtgcacagatctggggggctgaggaagaactgatggcttttagctttttcctcaggaaggatcaggaaaggcctcatggaggaactggcatttgagctgagaagtgtttgaaaggaattggctaacttttctctgagaaagagaagattaaagggctccatgacagctgacttaaagtctgaagggcatttctgtagatgaggagcaggtttgctttgtgttcttctgaatactagacacaaagggcctgtcttgaatgtctctgtgacagtcggcctttggttagagtgattaatgtactctttctactcttgttcccactgggttgtgttccctggaggagagtcatgtctaggttaccttggtgggagtcctcacagggccagcacggtgccttacctactgtaggcacttagtgagtgtttcaggaatttacctgcagaggcagattcttcacagcctaaggatggacacaatgtgttgttcattgctgggtgactctgggaagtggtgaactcctctaccttaagcagaatgatgtggctgttgttcagaactgctgagaaaagaattcccactttgacctggacatgagatgactgcacaggtgtctcccaagcctaaagtcccagaactaaattcagcattcagttaccataaaaaccttatatcaggtgttgcttggttttgtttagtctatattcatttttcactgaacatcctgtcactgtgccaaggactattccaagcatgtacagtccagttgtgaacaagataggcaaggtccctatccagaactcacactagtggggcaaacaataatcaagacaataaacactgaagtaagattatagaatctataggtctatagattctatagacctattctatagacctattctataggtctatagattctgtagacctattctataggtctatagattctgtagacctattctataggtctatagattctgtagacctattctataggtctgtagattctgtagacctattctataggtctgtagattctgtagacctattctataggtctgtagattctgtagacctattctataggtctgtagattctgtagacctattctataggtctgtagattctgtagacctattctataggtctgtagattctgtagacctattctataggtctatagaatagactttgcatattctataaaaaatgtagaagaggtgctcaggaagacctatctgaggaggtgctgtttgagctgagacctaaagacaggatggaatcagtatgggaaaatctgggagaagaaccttataggcagaagtaaccactcaggcggaagccctaagattaagataggcatgaacttgtgtaattggagtagaataagctctggggaaggtgtagagatggacagggcttgatcatgctgggtcttttagtccttagtaaatccttgctaagaaggtatgttaccctctttttacttatgagaaagataacgtttggaagggctaagtggcatgcccaagatcaagtcaagaataaaacttaggtcttctgacacctgcttcccaagccaaggtttttctgtttgccattcactctctgaatttcctaactattaacccaagttatttttggatgtaagatataaaattagtgtataaatttgaaagtcaatgatgtatcatctctaggtgttaattttagaggctttttagtagatgttaaaacgtccacttcttggctgacagttatgacaacataacttgttatttggtctaccctttgggtgtccttatttaccaaaaacttataatttaataattgaatccctggattaaatgtatggttgtgctagcaggggtggtctatttcttgatttataagacacgttacttttttatagctattttacagtatttgatgtgttcgaaaatcgtagtctcttggttggcatattgcacaagcaaatatttgtgtaccatagcatctagggtatttacttaaattgcttttttggaaaataattcactggaaagtccaaaaggcatttaccgcgtataactttctgccacagtttttttttctttgctctgtcattggttactttgatgtaggggaccatgtttctgttaaattgctgtcttactagagtgaaatatgtttaggttctgatttgtacactaacgttgaattggaggagcagtttgcaaaatttgagggggaatagcagtagagatttaggttgtgggtattaagcattaaatttttttaaaaaaacattaatttgctttttaaatgtgactttatatcatgttgtcttcttgaccctaaaatttccttacttttccttgtcagtatggcaaaaagaaagagagagtacagtggtattgctgaaagcagttaatggtttttgtcttgtgaatttaaataataaaatgaaaaatgttcacacaaaattagaacttgctttagggcacaatcaatatagcattttaacaagcttaatgtatttggaagatatgtattgtgtgaggttctcaaacatactgattctattacgacggttaactgtagcagcaaaatgtatcaatatacttagccaataaacataaaacttattaaatcataattaaattttcagaaaagttatctaaaaattatgaataaaatatattttacatggcctcagcaacaaaatatatagccaatgaaactttataagtggtggggtaaaatacatgggataaaattatagaatgaatttttaccatagacacatgtaccgagttaagtttgtgtacaccatttgtttctcctctcttttaacttcttttggaggtaattcttagtgagtatttgcagagcacaacagctggggtaactgaccgaaggggcaaatgagaagtttccctgctcctttggagtctcaagtgaaatgtttcaaagccctacctgcccttatacgtggaagatgccaagaggtactcagagtcactgtggttgcatttacatttctacagtgggcgccaatcacaagcttcatgttatggccccagctgtgtgggaatgtagctgagcacactaggtatcgtcatcctcatttgatttatgaagaaatggaaacacagataaatgaatggatttccctgaggattcagaccaagtcaaggataagatcaccactgaaacccaggcttttttaattcttagtcctttcccaatgccattcctggtaaataattacattttggctctaagaggagctagaataaacagaatatatgcaaacctaagaatttctgccagcaatctctagcagatatacttcagctgtactttgaatttttattttgtgcaccaggcacatgtatcttatagatgaccaatatgaacaaacagctgtctcccttcctccctccttccttggaacgtgtaatctctgaataactgattagctcaatgtcagaaatgtttgtgctgatctctgaacctcagtcagttcaacacatgacttcctggaaattttatctttggttttcttttttttttttttttttcactgccatgattttgtgagttagtttatgagtgtatttaaatcatttctggaatctaaatattttggacttgctggtctttataaggaagttagtttccctcctctcacatagacctctttctgctttctcctatctatcatattttaagagtatatgtgacaccgttaagttttaatcttctaaatggattggagaataacaccttcccttgactaacctcaaaggatttttaaaaacagaatgttgcctaatttttgagggagaatgttctaacacagtttatatatttttgtaactcaacaaaggtatctcataaagaacattggtggaattgggttttaaagtccaaatactttccttctgttgtccagaacatagctcctcaacctagaggcatagtgtcatgtgcagtgaagtcactcaaattccttcttattattggtttgaagatgactgtccctggatggtataagatatgatggtagtttgtgtcgttcagtttttacgttaaaggaaaaagtctctcctggtttcttttgaccctagtcatgatatgcccatttcatgaagtcttttatgcacaaaagtgcacaaaatgaagataaagtgcctctctccagcctgacaaaagccatttctttgcagaatggtagctgcagcgaaagtaaataaatgaatggacagcaatcacagcctagttgatgaaactgttcaattaaagcacaggcatttacatggtgtaatttccctaaattgccaatgagcccctttagacacaaccagtgttcaaattgatttcagcattgattttggctgaagctgataaatttctgcttgttagttaaagtaattttgcagaagactttgtactgcagtattgaagtgttcatttagctgatagttaggagttatttacagaggcctctactgttgttctgagatgggacaattccccaatcatcttttacttttaatttttcaggcttcagtataccaatcaataggtgattgaaactgattaaaacttatccaaccagctgcctatggcagtttaattagaagctggatgattcttaaattaaagttgtcttattttcattgcaaagccatcttccagaagagtaaggcaagaacagtgcagaaaacttaaaagactggctttgctaaggtatcttgcaaatgttaaatcactcaatagctattcctaagacaattcaaaaatgtatcagagagtttgcttttatggagattagaagtaataacatgcttacttgccagccaaggaatgtttgtttcattcggtcagagagattacctattgtataatgatacatgtgaaagaccagctgtttgggatatatctattatctcataagcaagatgaatgcttgagcttagttttaaacactgtaatgcaggatgaaactagccatgatgatatcctctgcatctgccccctggaaaccatcagctttgaatttatatttttattctgttttgaggtcttgattaaaataaatctccattgaatgaaaaacaaatatttttatataagttcatgttgacttgtcaacagtattgtgggcaggattatagaagagagatttttgctcctcttcagctccctagggaagcttctccatactcattttatctagtgtggacaatttcttgagtttttaatggaaacgggttaatatttttgtcataggggacatattacatctgatattacggggaagaagggaagaaatggctcacttttcagaggtgcatttactctttgacccactagggtactatttagtgttctagaagaggtaatttagtaaattgtaccccagtggcctgaaaaagttaatgcaactctgaaaagtgagccattcaatcgattttccctattgcttttaaaaaatcaacactgaccatatccagagaatgttgaagacaactgaaattagaggatctagaagcaaccagtttattttcacacaaagcttgttgggacatgcactggatttggcttcagaggacccagatctacttcccactccagtacttacagataggaatcgtgaagcattcagtaacctcaccaagccttggtttccttgtctataaagtggtgataataataatatttacctcacaaatttttgtggaaatcaaatagctttactatatgtaaaatgttttataaactataaagcacaatagaatattaattattagaataaggaggttttctgaagtagccatttatgtatctgattttggaaagtaatttattgttagttttcccagaaactgtgagcaaagattagatggttatcacgttgtttcaagagagagtttcctagctagtcaatcctcagggtatttctattttcccccacatatattgcctaacaattccagttctttcattccttctcatcattaggctttatatctcttgcttctctgtttgcccactacattatttcagaatccttgatcaagagatcagaatgactgtagtttccttgatctcagaggtatttagaccatatattaaaagacattactctagttgatgtggagagtgttaaaagcttgaatcaggccacatcaacttgtggaagaaatatggaggtagtgatgaccacattaactctgaggcaggtatgggagtaaaaaggggtatatagccggagtaaacagaaagaagaaatggcaaatgtagagttacagtagctttctcttattgaaaatctttctaatctagccaagttccctatatcattcattaggttgatttatgagccctatgtacaatcagttatcttgaaattaatatctgtgacctcataacatatttgacttgagacctaaacagtatgaggggctctgtttttttttctttctttctttctgagacagagttttgctcttgttgcccaggctggagtgcaatggtgtgatcttggctcactgtaacctctgcctgcctggttcaagtgattctcctgcctcagcctcctgagtacctgggattacaggcacgtgccaccacgccctgctaatttttgtatttttagtagaaacagggtttcaccatgttggccaggctaatctcgaactcctgacctcaggtaatctgcccgcatcggcctcccaaagtgctggaattataggtgtgagccactgtgcccggcctgtttcttaaccacaaattattttgtaatcagtagtcaagcatctgtaataggtttttaggcagaaagaaggttggcaaagactgctatttgaactagtatagtttacataaaagcttctttttacaactgctgtttactttggatttcctgttttaacagctagagcctggctaatgtgtttatctattatggaaggcaacaactgtcagtgttgatttccctgaaactatttgaagtatttctgtggatggctactttagtatgtgacagaatactaaaatttcgaagcttggccattagtcctaaacgtgttaataaaatctaccttcaaataaacctaaaaagaccaagcaattagaggattaaattttaatttaaaaatttaaatttatttaatttaaaatttaaaaattatatttttcattagctgaaccacagctggtttacatttagttactgaaaccatatcattgcattaaaaggtgacatctagagggttttaaaattaatctcgcaaggtactaaaagatttttgtttgtgtcagtatttgtgtactcatgagctttatacagcagagaagcgttctgcatgttttgtattggcttcagagttgttcagccttataatcttttgggaaaatgtaatacaatcaactctcagattccttgttttaagtaggagacttatagtctcatgtgggtatctcctaatagtttaaccccctcgatttctaccatcttctttctttttgttttagttttcctttgtgccaatgctataaagtctttgaaatggaaacttctaagttgaggaaagacttgtatcttgttattctaaatttacataaaagcaggggcttttttggttaataaataaaatgtcacacaaagagcaaagaagcatcatctgtaagaatagaagcatcatctgtaagtatagaaactgatgatcctacagtatattagctttaaccaatgccatgttttaataaggaagtagatttaataattgaacctgagtgagaccaactcttaactttctgtgccaatgaggagaattaagaattgcgttttagacaatgatttatttgtcttgtctcgatcaaactttttcataatgaatcagatctcagagagctttcttttcctttgtctttttacctctgccatgtctctgatggacgtcctataaatccctagggcattcagagaatagagaatcagggaatacaggatatctcacaagctgtgaaatctttgcatggaaaacaaagaactgatgttattatttgagagagtgaactatctctgcaatgagctaataacaaatacatttgtaacttttatttattttaaaatagcctttgttcaccgtttttcttgtcttctacctgttctctgagagacatagggagcaaaataaccatcactttctttcttgcttacctagaataagaccatctctttttaattactggttatttcttgagccaaatcctaaccattgctttcactattttagtgactggattattttcttaggtttcctatccatttggagaacctttcaacaattgataacactctataaataattcacagagtaattgtgtccctcttttcactaaccttctttgaagtacgttatgtgagaagtagaatttaagtcagtagcatttagttcatgtggttaatgaaggaagtgccctgtgtccttcatagaacagtggcaatactatcatttcagtgtccctgtgttgccattatgaataaaagtcattatacatgcaattacgctccaggtcttttctccaagaggcaaaaaaggggtatttccgtgctcattttgataactattttgctaataaattgacatttatgacataggatattgtcagttatgctgaaatctgaaatatttatagtaagattataggccagcctcccccattctttctttaattatatcctacctcacaatcactaggaaagcacatatgctccctattataaattctttctgctcataatttaaaataatttgattggaatatgtttagaacttaatatgcagaatagtaccatagaaaatagatgcctactttaattgtatgagattgtaccagctttatcagaaaatgtatgatcagctctaggttatttattttgtgaacaagagtcagctgggatgattcatattttttggttctcctagaatttgaaattctaagcataaataattttagtaaacatggtaaaatccagatgcagttgatcttatgcatggcataaatttgtgtgggagtccagatgttggaatgtgaacacaggttgtttctcccttctgtcttgtgtggactttttaacatgttattttcacatatttattttccttacttttatttattttttgatacagggcctcactctgtcacctaggctggagtgcagtgatacgatcatggcttactgtagcatcaacctcccaggctcaagtgatcctctcacctcacgtcccaagtagctgggaccacaggcatgtgccaccatgcccagctaatttttttaaattttttgttgagatgaggtatcatctatgttgcccaggctggtcttgaactcttggactcaagcaatcctcccacctcagcctcccaaagtgttgggattacaggtgtgagccactgtgccctgcctattttccttacctttaaagattattctagaaattcagtttattctttgtaacgatgtatcttttaataaattcgcattaacagtttagatgaaggtgagcacacctctaaccttttatgtattgtactagactcatctttaacatttcaaggagtaaataatataatcagttggatttatccctaagtattgcttttgaaatcagtcacatgttttctgaacactttgtgcaaagtacttcgcttggcagtgggggagatataacatcaactttcatggcctcagggaccccattctttggggtctgttgttagcttactgtttgtaccttctcgtctcctttactgttttcttcgcatctttctgacctctgaatttagagagcctcagttccagtccttacacctcttctctgtttaattcacttcctaagtgagcgtgtgtagttccatggctttacatatcatctgtatgctgaggaagtccagatgtatgtctgtagccctggcctgtgtcctgaacttcagactcatatctgattaccagttggatgtcctctaggcatttcaaaattatctaaaactgagctctttatttctttggaaacctgcttcatttacagcttctcccatctccgtaattggaaactctattctataggatgctaaggacaaaaactttgcagtctttcttcctccttctttttctctcagattatgtatacctttacccacaaatcttgtgggttcttcctcaaaaatatttcaagaagctgaccacctttcatcactgttttcttgctaccctattcaaaaccactattactgcttgctaggattttactgcaaaagcctcccaactagcctcccagtttctatccttgctttcctgtaatgtgttctcttcactcagcagccaaagtgatctttctgaaatattaggtctccccctctgctcatgacctcttatatcacttggaataaaagtcagagtcctcaccatggcctaaatggtgctacacagtctgttttccttacctctctgacctcatctcccccagctagccctcttgcttattctacttctgcatacatgtcaagcacacatttccaccttgggcttttgaacttgctgtttcctctacctggaatccccttcccctagatgtccgaatggtgtgcccccatactgctcacatgtaacctgaaaagagaggcatttcctgacttcctccccaaccctaatatcaaatagcatgtccctaatgttgatcagtctctatatccttacctttatttttttcaatgcacttacccccacctcacatattgtatatttatttgattattgtcagtcagcccctattagaaggtaaacttcacaagggcagggacttggtctcatttgttctctgctgtatccacactgcctagcttattgcctggcaatcagagacatgcattaagtattaaatataaaaagaggatctaggaggagaatatatcatatactgtggaagaggtcaagcatatagtaatgaacaaaatggaccctgaccttccccttgaaacttacaataaagtagaacataacatagaccctatattaagaatttacagcatagttaggtaattagagtctacaatatagttaaataaagtgaacaccatttctgtaatcccagcactttgggaggccaaggcaggaggatcacttgaggccaggagttcaagaccagcctgggcaacatagtgagaaccttgttctaaaaaaataaaaataaaaattagccagccatggcggtactctcctgtagtctcaactactcaggaggctgaggcaggaggatcatttgaggccaggagttcaagaccagcctgggcaacatagtgagacctccgttctgcaaaaaataaaagtaaaatttagctaggcatggtggttcactcctgtagactcaactactcaggaagctgaagcaggaggatcacttgagcccaagagttcaagtctgcattgagctatgattgtcacactgtactccagcctgagtgatagagtaagaccctgttgcttaaaaaaaatatactagtaggccatgtgcagcggctcacgcctgtaatcccgcactttgggaggttgaggcgggtagatcacctgaggtcaggagttcgagaccagcttgaccaacatggtcaaatgccatctctactaaaaatacaaaaattagccaggtgtgatggtgggcacctgtagacccagctattcgggaggctgaggcaggagaatcgcttgaacctgggaggcagaggtttcattgagccgagactgcaccactgcactctagcctgggtgacagagcgagactctgtctcagaacagaaacaaaaacaaaaaaccactactgataaagtatatacctgtgaatttaaataactgttgaagagaaatagtaatttataacacgaacatataaggcaatagagtagttgatgccaatagataaatgaaaccacagggtaggaaatctagtaggtagggaagtaagtagaaataaaagaatggaatccaattgaattcaggaaggaataacatgaaagaagaaatggtgaccatttaagtaaatctgactgtataagacaacgatagtaataattcaaaatgaagttaaaaagactggagaaaataatatgttaagatgagaagggcttgattgaagttaaaacattctaagatttttatattgtttaggagaaggatatagataacaattaactttatgttttgttaagtcaggtatgattgttaaaaattatacgggtaactaaaacagtgaatagaatgtgtaacttcaaaacaaatagatggaataaagggagaataattcagtataatagaggaagagaagtcgataggtgtaaagtaaatgaattaggtggtagaaataaatccaaatatatcaataattacaaaaaatataagtagagtaatattagcagctaataggttaggttgcattttttaaaatacagttatgtgctattttagactgtattgggagaaatttctaaaataccaagacacagcaaaattgaaaggaaaagggtaggggaagatacctggcaaaaactaatcaaaagaatgctgctactgtggttatattaacataagacaaaatagactttaaggcaaaaagtattactagagaaatgttatgaaaatacaaatatttacaactgaaccacaaataccatgtattaatatgaaaactcctgagatgcaccaaagtaattcttaaaggataggtttatatacacaccttagtaaagaataactgggtatgatatgcttagaatctaactcaagaaaatcaagaaggtgggacagggaataaacccaaagaaagtggaaggaaagaaatactaatgaacaaaagtttgaaaaaaaaaaaaaaaagaacaaaagttaattaagtgaaaattcaagaaacaattcaacaaaaccaaaagctggttctttggaaaaacttaataaaatatagcagtgagaagcagaaataacaaaattaggaataaaaagggaacataattctatacataacagtgattttaaaaataataggatccagtgaataactttatgacaataaatttgaaaacacaaaatggccagtttcttagaaaaacttaatgaaattgtcttaaaaataaaaaccaaaatagacctagagcaatcaaatgattatttgtaaaatgtgcctgatgtagttttaggcactggaaataatagcagtgaacaaaaaaaacgaaagtgtgtgttttcatggagcttcctttgttgtggagggagacataataaattaataaattttatcaggtgttgctaactctgtgaagaataaagaaagtggccgggtgcggtggcttacgcctgtaatcccagcattttgggaggccaaggtgggtggatcacctgagatcaggagttcgagatcagcctggacaacatggtgaaacaccgcctctactaaaaatacaaaaattagccgggcatggtggcacacacctgtaatccctgctacccagaggtggcagtgagccgagatcacgccactgcactccagcctgggcaacagagtgaggctccatctcaaaaaaaaaaaaaaaaaaaagaagatgaagggagaatgtgctgaagggagaatgtgctgttttatgtaggaaagtcaaagaaacaatataggacctgaaggaagcaatggagcaaaccaggtatatattggagaaagtggcccagccctcaggagtaggtgcaaaggccccgaggcaggagcacgtttgatggaacagagttgagtattgtgcataagggagactggaagaagcagagatcagtgaggtaactaaccagggcccagatgatgaaatccttataaagacttttgattcagcagttagaaatctacccatgaaatggagatgagtataataacttctactcataagattatgaagttaatgaattaaatgcatgtggatttttttttttgtaaaacactatccaggtgattatttttttcatccagaagtagtaatttgtcaaacatttatgaagtgaggagcacctaccatgggccaggacatgtgctaagcataaagaatagaaagatgattaaaacatggcagcgctcactgcccagtactggggacagacacataaatacttttctgtagtgtgccaagggcaataatagagcatgtaacatttgaagagtaggagaagcatcaaagtttaactttatagcgtttataagaaagtgtatgggctgggcgtggtggcttacgcctgtaatcccagcactttgggaggtcgaggcaggtggatcatgaggtcaggagattgagaccatcctggctaacacagtgaaagcccatctctactaaaaatacaaaaacaaaattagccgggcatggtggtgggcgcctgtagtcccagctactcgggaggctgaggcgggagtatggcgtgaacccgggatttggagcttgcagtgagccaagatcatgccactgcactccagcctgggcgacagagcgagactccgtctcaaaaaaaaagaaagcatattaaagggaggtatataggtatttttagggtagcttatgcctcatattttcctgttaacccaaggagaatgaaaacttggccttctcatgattgtttagtgacgtttctgctgagattaacacctgaatggcgtacttaccacacctatctgtagtgtgaataaacttatagtagtgggcaagagataaacatggtaagaaatctagaagttggaacatggtatatccataccagatggctcttttaattgtctccaaagttggttcaacatgaagtaatactacgtgtttaagtttttcttaacaataaatgatatattgcaaacttttgccagttctttgttgttaaagctttattagagggtcatttgtagagcatatagtctaactagcacgtagagacactactgctctttaagtctgttttggcagctttcattctgaaatcactcagccagtttgaaaacttactatcttcctttttttttttttttagacggagttttgctcttgttgtccaggaggctagagtgcaatggtgtgatctcggctcatcgtaacctccacctcctgggttcaaatgattctcctgtctcagcctcctgagtagctgggattacaggcacccaccaccacgctgggctaattttgtatttttaatagagacggggtttctccatgttggtcaggctggtctcgaactcccaacctcaggtgatacgcccacctgggcctcccaaagtgctgggattacaggtgtgagccaccgcccccggctacttcctaccttcctaacatttaattcattagtcttatctcattggatcctcacaactctataagggagagactgctttccctattccagactagagataactgagacttggtggggcttactgacagtcaggttcacatgtttaagacgtgggagagctaggccaggcgcagtggctcacacctgtaatcccagcactttgggaggccaaggagggctgatcacaaggtcaggagatcgagannnnnnnnnnnnnnnnnnnnttgcctggagcaatttggatataatggtctttggcctgattgaaataggtcagtacctttgtaagttttgaattatatgtttccctgccctagaatacaggtaaaaaaattaaacatcaccgatctctttgtgtgtgtgtgtgtgtgtgtgtgtgtgtgtgtgtgtgagtgtgtttgacggagtttcgctcttgtttcccaggctggagtgcagtggtgcaatctcagctcattgcaccgtctgcctcctgggttcaagcaattctcctgcctcagcctcccgagtagctgggattacaggcatccgccaccaggcctggttaatttttgtatttttagtagagatggggtttcactatgttggccaggctggtcttgaactcctgacctcagggtgatccacctggcttggcctcccaaagtgctgggattacaggcacgagccactgtgcccagccaaacatcaccatctatttcctttaggtcctaaaatatgcatattctgtcgcggctcatcttggctttgccactgactgtgtgagcttggataagttatttaacctggcttttgggtgcttctgctgtgaaagaaggggattaggttaaataattttctctgttttctactagctcaataaattatctgattctgtaccaagattacaagttaagaccaacttctttgtctggtcatctataacctattgttacaaatgaaataagaaagtatggatagaaagtattcgcttgcactgggctctttgttattttaaatatttgaaaaacttacaccaggcgactaacttttgccatggtaaagtgtatgtgtgtgtgctcaattttaagggctgagactgttcccagaaggcctgtgctggtcacaaacaaaatggaacactcaaggaccaagcactaaaaatatctcataaaaatgcttcctccatgcagtcattgaatcaggtaattactgtggcaacaacaaactaatttgaagtgttagctgttaattaaaacattgcagaggtgtatagttgtcttttggtgtaagcagagcctccattcaaacttcattaatcactttacaattaatgtgttgaggaaggtcaagacaattgagatgtagtatctgttgaaagtaaacaaattccttttctctaagtaaataccatttggaaagttaagggacacactcgactcatgcctggcattgcctttgtcatccagttctccttgatgattaaatgttaaattggtactgtcattgcactgtaaaccaaaccacatagcatctttattcctcgaaatcgaacccaaacttccacggatgaattagcgtgcatcataattaaattatcaagcctctccttttaattcacttggaaataggacacctttcttttagaaaagagatcagctttcttgacaagctaattaagttgccaaactgtccagtatggtatgtatattagactatctgctaatcattttcttatcgctgctgctggtctcaaacgtccaggtgttgcttattcgaagtaacaacactgatctttttacaacttttgaatcctgtgtatatatttaattatttgtctttatatttcagttcttgattagtgattcgaatatataatatttttaaaagttggaattggaagaatctgtgatgtggagggggaaaaataatatatcacaaagtcttacgtattatgttacttggatttacgtggaataaacttactaatttcctttaaatcacatttcaggccaagtgcggtggctcacacctgtagtagtctcagcagtttgggaggccgaggctggtagatcacttgaggtcagaagtttgagaccagcctggccaacatggtgaaaccttgtctctatgaaaaatacaaaaaaaaattagccaggtgtggtggtgggctcctgtaatcccagctccttgggaggctgaggcaggagaattgcttgaacctgggtttcggaggatgcagtgagccgagattgtgccactgcactctagtctgggcgacagagcaaggctccatcttaaacaagcaaacaaacaaaaaacataatgtaggggatagggttccacttataaaatgtgtatcactttgtacaaagtataaaaaattattttgctggcacagtggctcatacctgtaatcccagtgctttgggaggtcaaggtgggaggatcgcttgaggcttggagtttgagaccaacttgggcaacatggcaagacttcatctcttaaaaacttaaaaaaaattagccaggcatggtggtatactcctgtagtaccagcggtttgggaggctgaggtgggaggatcgcttgagcccgggagttcaaggtcacaatgaactaataagatcacagcagtgcactccagcctgggagacagaatgagacctgtctctgaagaaaataataattgattaagttttattattattttctatatctttcagacagagtctcgctctgtcacccgggctgtagtggagtggtgagatcatagctcactgcagcctgacctggactcaagcgaccctcttgcctcagcctccctgtagtccctacagggggactatagaggactacaggcacgcaccacgatgccaggtaattattttattttttttaaaagacagtgtctccctatgttgcccaggctggtcttgatctcctgggttcaagtgatcctcctgcgttggcttcccaaagtgctgagattacaggaatgagccactgtgcccaacctgattaaagttttataagtagtatttagaaataaccaatgaggttgttatttgagaatatctttagacactttcaaaggttaaataattctttggtaaagtaaacagttgtcacccggtttttgtaatcttgctttttctttaaatgaaatatacttgaatttctgtataattaattgatataataaaagttaagtttaccttccatgactggcttgacctttgtccactcaagttggaaaagcaaaatgagtaagttcttataacactcatatatttggataagtatatacatatgctttatatatgtagtttcctagtcttgcctgaatttgtaacattttacttgtaaacgatattacaaatacctatatgctcttaataactaaatcatttctataagtcagtcaccttcaaaaaactcttgtcagtgattgttcaactctgtaaatttactaaaaagtagaatgtacccttaaaacaagtgaatgttatcatatgtaaattatatctcaataaagctgttaaaaaattttgtcagtcctttctgctcgtggacgccacagaggaaacatcattaaagtctctgttctccctgctgtcatgtctaagtcagagtctcctaaagagcctgaacagctgaggaagctcttcattggagggctgaactttgaaacaaccgatgagagcctgaggagccattttaagcaatggggaacactcacagactgtggtaatgagagatccaagcaccaagtgctcctggggctttgggtttgtcacatatgcccctgtggaggcagtggatgcagccatgaatgcaaggccacgcaaggtggacggaagagctgtgggaacaaagagagctgtctcaagaggggattctcaaagacccggtgcccacttaactgtgaaaaagatatttgttggtggcattaaagaagacactgaaggctgggtgcagtggcccatgcctgtaatcccaacactttgggaggctgaggtgggcagatcacgaggtcagggatttgagaccagcctggccaacatggtgaaaccccgtctctactaaaaatacaaaaattagctggtcgtggtggcaggcacctgtaatcccagctactcgggaggctgaggcaggagcattgcttgaacccaggaggcagtggctgtggtgagccaagatcgtgccactgctctccagcctgggcgacagagcgagactccatctaaaaaaaaataaaaataaaaaataaaaaaaagacactgaggaatatcacctaagagattattttgaataatatggaaaaattgaagtgattgaaatcatgactgaccaaggcagtggcaagaaaaggggctttgcctttataacctttgacgaccatgactctgtggataagactgtcattcagaaataaccatactgtgaatggccacaacggtgaagttaggaaagccctgttaaagcaagagatggctaatgcttcagccagccaaagaggtcgaagtggctctggaaactttggtggtggttgtggaggtgtttttagtgggaatgacaattttggtcatggacgaaacttcagtggtcatggtggctttgatggcagccgtggtgatggtggatatggcggcagtggggatggatggctataatggatttagtaataatggaagcaattttggaggtggtggaagctacaatgattttggcaatttcaacaatcagtcttcaaatttcagacccgtgaagggaggaaactttggaggcagaagctctggcccctatggtggtggaggccaatactttgccaaaccatgaaaccaaggtggccatggcggttccagtagcagcagtagctacggcagtggcagaagattttaattattgccaggaaacaaagcgtagcaaaagaggagagctagagaagtgacggggaagctacaggttacaacagatttgtgaactcagccaagcacggtggtggcagggcctagctgctacaaagaagacatgttttagacaaatactcatgtgaatgggcaaaaacttgaggactgtatttgtctaattgtataacaggttattttagttcctgttccatggaaagtttaaagcattccaacaaagtgatctaatgtagattttttttttttgcaccatgctgttgattgctaaatgcaatagtctgatcatgatgctgaataaatgtcttttttaaaaaaatatttgtcagagcaaccaaattttctgctaaacagcagaaaatgatgtttccatgttggcagtagtggattatgtaaattttggttttatttttgttttaagaaaggggaagtttaggggctcattaaatatgttttacaactgggcaggtgaagatgaggaattcctgaggcactgacttctgttccccattttccctatgccattcctatcctaacaccagatgagaggaagagccgtctgatcttagctagtgtataaaatcctctatagggcaagatttttagttcttcgaaacttacttacttccttatattaatatttttatgggcttgcaataacaatgcttgtttatgttatgtggtttattttgaaatttttattgtataaaaatgtgttgcagattgcttctaaataatgttcagaatatctagtccccacagtatatgtgtaaaggccacatttcatttaaacataaaaggtacggtggctcactcctgtaatcctagcactttcgtagactgaggtaggagcatcacttgaggccagcagttccaggccagcctgagcaacatccagagaccctgtctctacaaaaaaaagtaaaaagtagcatggtggcatgtgcctatagtcctagctactcaggaggctgaagtgagaggatcgcttgagctgaggagtttgaggctgcagtgatctgtgattatgccactgtgttccagcctaggtgtcagagagagcccctgtctgaatcagtcagtcactcaatcagataaacacaaaaggtcttgatggatagtaatggtatttcatttctgtaaaccctattctcattctttttcataaatggatacatttatatttattgatttaagttgtagttatttcactatatctgttactttgagcttgttttgatgaactgttatgatatagtttatctgcatgtgtaattaaaaaaataagcaaaaaaaatgggaaaaaaaaagcaaaatggctctgtacactgcttaacatagagctatagagaacccacatgcacagtgacagtcataagggatctggagccaaaagacctaggtttgaggtctcattctgctgctagttactttgtgccattgggcaaactgtttaacttctctgtgcttcagaattctcatctataaaaggaggataataatgtatcagtattacctcagatagttattttaaggtaatgtatagtaaatcactttgtaaaccattaagctccatataaatgtaaattactaatgttgttagtgttctttgaaagtaccatgtatcccactgctgcagaaatgtttggatttacatttatgtccttaaccattttgtaggttgtttagtgatcccaaatgattttgtttttttttcttcccatagagcatatcatgtcccgagtgggaaaatattagctgtaaaggtaagtactggatacattttatgaaattcttgatgttcacctctttcctttcctctgttagcttgagtcacagatattgtcaaagaggagatgaaatggcttaaggtttagatggtaggtaggggaagctgtggctctctggtgacattcagacacctgaagatcttttaagtatgccttaaaatagtcagttgtaagctccgtgtattgtgattcttcttgccaagaagagaaaatttctttctgtgtcccctgctaagtggcatcaccatcttccttgtcatgcagctcaaaaccttactggtaatgtattccttttccttctttaaatatgccacatcctgtgaattgctgtatcccgttagaatttttccctgaaatatatccatttgctactttctttctattcccatccccattgccatggtcttggatcgggctcacattacctcctacctggacttttgaaataacttcctcactgtactttcggtcttttcttttcctatgcaccttttactctgccacagatttgagaagtcaaatcacagatctgaccgtgtcttgctgactgccttcctcaatcatgtacaacgtaaagcctaagatgtctgctttgcttctgactccctcggcatactgaaatacccaagcacaacacctgccaatagagtcaggctacacacaactcagggatgttccaggcagttacctaggatgctcctcacttgttcccatgcaattcataattcatacttcatctctgccaaactccagcatcccagtcctgccatgccactttggatttaatctctgccactgctggcgcttgatcttcccatcatcttaaatctcagatttccttaatggactctgtcttgaattgcgcttctgactgaaccctttgctaattaagtcctaaccccacagaaccccatttccaattttgggctcttagctaacaaactggtcaggcttgccttgcccccaaccttccccacaaattgttcagaccctctacatattggcccccacctacctttataaacatgcactctgctttaccaatctgttacttcccgtcatgccctttatctccagtctcctggcctttagtaatgaaagttcttattttttgagtgactactatatgccaagtattatgctagatttttttttttttttttgattgagacagggtcttgctctgtcatccaggctggagtgcagtggcgtgatctaggctcactacagcctccacctcacaggtccaagagatcctcctacttcagccccttgagtggttggaccagaggtgtgcatcaccatgccttgctaattttctttattttttgtagagacagggtttcactatgtttcccaagctggtcatgaactcctgggcttaagcgatcctcctgtctcagccacccgaagtcctgggattataggcatgagccaccacgcccagctatgctagatgttttataactattatatttaatccttaaaattacatagtaagcctgtctactttagattaggagactgaaactcagaaagctgaattgtcaaagatcacagagttggaaggggtaaggccaggatgtgaaatgttcatctgcctccaaagctcatctcctctgttacaccatgcagcttttatacaacttactaacattgctcatccctctgatcttcatctatcttttcatggttcatctccaatatgcctttttagctatccacagtgagaaattgatctctttctctaacagttgcatagtatatatttctgcatcttttttctcatctagaaaactaagaatcagagcaattacattagaattgcttataccttttagtaagttgaaaccaaaactaaggctcagatcctctgactgctaatgaaatccagagttcttcttccatatcacatctagtacagcacctagaatgtgttacgtggcattatcaagtttagttttaataagttaaatagcttgtgagggggtacaacagagcttcctttgagatattttctttgacagttcagccatttagggtccatagaattgtagaactggaagagaccttggagatcacctgttacagcccccacattttacagaggcactgagctcactgaatgcagctgtgtcataccaccttggtgctcaccgagcgcggcccagtcgtaccaccttggttctcactgagtgtggctctgttgtacaccttggcattggtttaacctttctgtacctcctgagctcccttttcactaagagaaaacttccactaaaacttgagcactattttcccatccattgagttacttttttgttccttttatgtcagaagtcttagattgttgctgatgatatatttaaagatagccaactctaggttatttactccaggagaggggaacactgttataaatcgtctagaaatctatgattatttggccttgcaaagtacattatacatttttcgtaatttcatacattttgaattatgtttatatagactaatattaaaagtattgtgcattagttgggtgtggcaaggggccaacagctttttctggaaaagagtaaaagcaattttaaagaaaggacatatttacagaatagctgttaggaaagtagagactgtcagtaaatgaaaatagttgggatttacaaatatactgttcactagacctgatcattaaactgggctttacaacaagaactgtactgtattcactttgtatctctagattctataaaatatagtagatactcacactgaattgaatgaatggatgatttaagagcagatatgattattgtgattaaacatttgtgtagccctgagcttgttggtagtttaggcaaaaaccatgtaacttgtataatagtcataatctaagaaaaatttaccatttcttcaaaacaggcagaatttttaattcttagaagtgtgttatttagtttccaaatatttggagattttccatctttctattactgatttctgatttaattccattgtggttccagaacacccttcctataacttaaattgttttaaatttgttgagacttatattatggctcagaatatgacctattttggtaaacagtccttgtacacatgaaaagaatgtatagcctgcttgtgcctgtaatcccagcactttgggaggctgaggtaggtggatgacttgagctcaggagtacgagaccagcctgggaaacgtggcaaaaccctgtctctacaaaaaataaaaaataaaaaataaattagctgggcatggtggtgtgtgcctgtagtcccagctacttgggaggctaaggtgggaggatcgctgagctgaggaagttgagacttcagtgagccatgattgcaccactgcattctagtctgggtgacagagtaagacctcatctcaaaaaaaaaaaaaaaaaaaaaaaaaaaaaaaaaaaaaaaaagaatgtataatccactgtatagggtattgtataatgtcaattagatcaagttggctgatagtgttattcagatatttgttattagatatttgatttttatctagtactatcaattactgaaagaggggtgttgaaatactcaacaataattgtggcctacagttctgttattttttacttaatgttttttgaagatatattcttaggtgcatttatgtttgttatgtcctcttgataaatcggcctcattgacattatgaagtaaccttctttgtctgtgatcatattctttgctctgaaatttatagtctgatattaaattctaggcttcattttgacaagtgttagcatgatatttttttttttacttttaacctattgtgtcattatttttgaaatgtatttcatgtaggcagcatacagttgggtcttattttttaatccagttggatgatctctgctttttaagtgagagtattgagactatttacatttcatatgattattgatatgtttggattcaaatctgtcattttgctctttgttttctatttgttctgcctgtatgcccccttttttaagtgattgctttagaattcataacttaacatagtcttcctatgtaaatagtattgtaccactttatagtctacaaatcttacagtggtgtattttcatttccctcatcccagcctttgttttattatcatccattttacatcatcatatgcgataaaccccaaaatgcattgtcactacttttgctttagatatttatctttttttttttttttgagacagagtctcgctctgtcgcctaggctggagtgcagtggtgcgatctcggctccgcctcctgggttcacaccattcttctgcctcagcctcccgagtagctgggactacaggcgcctgccaccacgcccggctaatttttttctacttttggtagagatggggtttcaccatgttaggcaggatggtctcgaactcctgaccttgtgatctgcccacctcggcctcccaaagtgcagggattacaggtgtgagtcaccgtgcccggcctggaaatatttatcttttaaagacatttaaaaagtaagaaaaatagtattctatttttattcctgtatttaccaatgccagtgctcttcattcctttgtgtggttcagatttccatctagtagtattttccttctgtctgaatgacttcttcctttacatttcatatagtgtgggtcttttggtattctttcagcttttgtatgtctaaaaatgtatatttcactttcatttttgggaggcattttaatttttgctaaatgtagaattctaggttggctgctgttttctttcagttttttaaagattttgtttcactgttttctttctttccagtgagaagtttactgtcattttaaatctttgttcctctgtatattagaattggcttcattctggctgctttcaagactttttctttatcactggtattgagctggtgtttacatctttaatgtctctacttaacatgtttaaaacttcctctgctttctttttttttgtttttataaataaagatggggttttgccacattgtccaggcttgtcttgaattcatgggctcaagcaatccacccgcctccacctatcaaagtgctgggattacaggtgtgagccagggcacctggcctcctctgctttcttgaaagtatgaaatgaccgggcgccgtggctcatgcctgtaatcccagcactttgaaaggctgaggtgggcggatcatgaggtcaggagatcgagaccatcctaacacggtgaaaccccatttctactaaaaatacaaaaaattagctggccgtggtgtcgggcgcttgtagtcccagctactcaggaggctgaagcaggagaatggcgtgaacctgggaagtggagcttgcagtgagccaagattgcgccactgcactccagcctgggcaacagaataagactccgtctcaaaaaaaaaaaaaaagtatgaaatatagttataataactgaattagtggccttatctatttattccatcatatgtgtcatatctggatcagttttgactgattcctcttctcctcactttgggttgtatttttcacttttttttcatatcttataattttttttaagtgaaaagcaagtttattaagaaagtaaaggaataagagaatagctactctgcttgagcagagcagctatgccttataattttttattggataccagacatgtggcatgggtgctatttttgctctgctataaatattgttgaactttattctgagattgtgggtgggaatattgagtgttaactcgattgggttgaaggatgcaaagtattgtttccgggagtgtctgtgaaggtgttaatattcagagagattaacatttgagttaatgttaacgtaagagattaacatttgagtcagtgggctgggagaggcagacccacctgcaatctgggtgggcaccatctaatcagctgccagtgtggctaggataaaagcaggcagaagttggaaggacttgacttgctgagtcttcccgccttcatctttcttccatgctggatgcttcctgaccttgaacatcagactccaagttcttcagcttttggactcttggacctacaccagtgatttgccgggggctttcaggccttcagctacagactgaaggctgcactgttggcttccctacttttgaggttttcagacttggactggcttccttgctcctcagcttgcagatggcctattgtgggacttcaccttgtcatcctgtgagtcaatactccttaataaattccgcttcatatatacatctatcctattagttctgttcctctagagaaccctgactaatacagagatggtatttagttacttttgaataatttgattctttcaaggcttgcttttaagttttattagacagtaccagcccagtggttagtctagaactaattttccccgtgcagcagaggtagtactcttctgagtactctacctggtgccttgcaaattgcaaggtttttccacactgactggtgggaatacaaacttttcttgcccagtattaatctggagatcgtttcttctgagcctttctagtggttctctccctggcctcaggtgatctcctgacatctatgtacagatcattcattactcagctgaagactccaggaccccctcggcagacctctggagctctctccctcaggtcctctgccagctctctgccctctgcttctctagcttccttggcctcctcagactctcagttttgtcttctcatcttagggagatggcttatctctgcctggtttcccctccctgcactgaggcctgggaactctctggtcagcaagctgggcaatcatagggctcatctcatttgttttccatctttcagggatcactgccccattctggctaatgtccaatgtctggaagcctgttgatgtgtgtgtgtgtgtgtgtgtgtgtatgtgtgttttagtacctcttcctttcttttttttaatttaacttttaacttttttaacttttaatttaactttttttaacttttttttacttttaattttttaaaaattaaaaaagttaatttttttaacttttaatttaacttttttaatttaacttttaaggggtacatgtgcaggtttgttatataagtatacttgtgccatgggggtttgttgtacagattattttgtcacccaggtattaagcctagtacctattagttatttttcctgatcatctccccacttcaccctccaccttctgataggccacagtgtgtggtgtttccctctatgtgtccatgtgttctcataagttagctcccacttataagtgagaacatgtggtattcggtttcctgttcttgtgttagtttgctaaagatgatgacctccagctccatccatgttcctgcagaggacatgatctcattgttttttatgactgcatagtattccatggtgtgtatgtaccacattttctttatccagtctaccagtgatgggcatttaggttgattccatgtctttgctattgcgaatagtgctgcaatgaccatttgcatgcgtgtgtctttataatagaatgctttatattcatttgggtatatacccagtaatgggattgctgggtcaaatggtatttctgtttttaggactttgaggaatcactgcactgtcttccacaatggttgaactaatttacactccttccaacagtatataagcattcctttttctccacaaccttgccagcatctgttattttttgactttttagtaatagccattctgactgatgtgagatggtatctcattgtggttttgatttacgtttctcaaatgatcagtgatgttgagcgtttttccataggattgttggcctcgtgtatatcttcttttgagaagtgtctgttcgtgtcctttgcccactttttaatggggttgtctttttcttacaaatttgtatagaccccttccttatacccctttactgcaaaaattaactcaaaattaaagacttaaatgtaaaacccaaagtacaaaaaccctggaaggcaacctaggaaataccattctggacataggagtgggataaagatttcatgatgaagacaccaaaagcgattgcaacaaaggcaaaaattgacaaatgggatctaattaaactaaagagctgcacagcaaaggaaattatcaacagggtgaacagacagcctacagaatgggagaaaaattttgcgaactatgcatctgacagagttctaatatccctttcttttccttacaccactctaatccagatgcttggcttctttcttgtcagacatgtataccagcttttgaattgttctcagtaaatagaagctaccatttattgatgatttatacaatgctaagcattttgcatgcattttttaaattaatgctcacaacattttgtaactcttactgattcctgttttacaaaagctgaggcacagagaagttaaataacttgcccaaggtcccacaactgataagtagtggagccaggatttaaacataggtagtcttgttctaagtgccggtgacccccctgccggcgctgctcactgctctcagatttggcttgccaagggtcatcctggtcacatttatttccctctcaaaagtcttcagaggcttcacgtcacttcccagataaactaaagactttagaggatggaattcaagatcctccacgacatgtcgtcagtctgcttttatagcattatcttacatgtttgaatcctgtgtgtcttttaagttgaactcgttgccttatctgaactcaggcactttctcacttcaacactttgattcacgtattcctctctaattagaatgctttcacccgttatctctacctatcaaaatctttaacacctttcaaggatcagctgaaaagcctgctccttcattgaacttttctggataagccctgtcacatatggtctatctctcactcactcattttcttctttgaacctctctagaattccctgtatatgtcttttaagggtgttatcaccaactgccttgtattttgctgttagtatacctgtacatttcccatattatattgaaaactctgtaagtggggaacagatcttatttatcttcttgccttactccgtgattcctgcagatccttgcatatagggtatagtacaaagcattacacataacgagtaagtgttcaatacataatttgttgagtgactgagtgaataaatttttgttcttctgtttgttctttagttcattcatcttttaaagtaacatcttgaaagcaggttcagctcacatacaaaatatctcatagcgttctttatatggaccattgctctcacccagaatatttcttagctttttttatattaaagggtgaaatggaaggttaagagttagaagcgtatttgatcttttcctgaccctctcctgacttttgtgtgacttcaagcatgtcacttgaacctcccagtgacctcagctgtgaaacggggctgcctgatgtcacagaggattgtgaagagcagcaaatcacagtccttgtccaaactgaatcacctgcagggtctgacgcctgcatggaatgatgagggaaatttaattttccaagcaaagtggtcagttggacccacactttgaatgtctatgggcacaattagatgagtccttgaaaatctgttgcttttcctactcaaaatgtttctcatgttatgcttctaaatgttcttattttttagacaaaaaagcatattgtaaatgtttccctttttagacttctgaggtaggaatatattacaagatatttttaaaagaagttgaattttggaaagaataatgtaccatgaatttctattttatactattgaatttagaaaatgttctgcctcaaagagaacattttgaaaatgatgctaatcacattttaaagataactatttcataatgaccatgtgtaattcatgaaacgtgtttctacctttttgtctgtttgtttggtgcaggtagtcaagacaattgcagataagtagagcagaaaacaaataaaaatactgttagccatcttgtaaacagaacctttttataccattaatgtattctataaaatctttcaagtagtaatgcttggaggatttaatagatttcccactattgtttgttttctaagtgggaaaaatccatctaacaggaaatttcttagcattgtatattgcatgtgccaattatcattctttgactgctttgggtttctgctgcttttaaactagcatttaaatggaccatttgattaatcatttgtatactgactataatcctcccaaatttcctttctgagttgtacatactgtaaaagacaattatgtcgccatagattaaataagtgaattaaaacagaatagcagcttaatttgacctgtgattttgctctctttccctttagtgaagtgtgtgccactccagcaaataaacgaagtcatccatgacagcttgtgatgaattgccgtatttatactgtatattttaatagcctcacactaatttaaattgagcacagagtaaattataattcagtcacttgactgcttatatttaacttgacaactcatccttatttgtcctggaggtgtagtggagagcagtggaaatgcaccaaggtatttcagtttctcacttaaccctttctccatggaatgcttcatattcaaattctttccagtttgaaacatttagcacttcctaaggagaaaaaaataatgaagaatcagggagtccgtactttccttggactccaaaaagaaaattagtctttgccatgctttttgccgttgccttcaaataaggaattggatttgtttatttttagcagttttaaagctcactcacaagaatacacaggggaaggagaattaaccttccacccagagtgccaagtctcccagaaaatagagagcatttgagtagagttattttaaggtgggttctactttccctctcaagttctcagaaattactttatttgttttttccatcattttggaatctcctctattctagactaaagcaaataccaacaatgatcaaaacgaattagagtacagcggattagctccacaaatacagtattccttactacattttaggtcagtgtggcatttttatttgtttggtggtgtacatttttagttttaaattcagtttaaaatcaagcaatctatttcttctgtctagaaacagtttcttataaagaggattatagttgtaaagacttgagttaaatcctacatcacttactaggcactactgtgagttagaccctgtgtggagtgctgggggggatagaaaaatgtacaagactcagcccttgcccttgagaggcgcatagccactctaatcttgaggcttctgtttttaggagatgagggatgcatgctcaaggcagaatgtacatattgagggccagagctagagatgaattttgatggaggactttgaggtgagcttcatggagacaatggtggcattcaagctgggtctaaaagatagaacaggttttttcaatcagtgcctggagaagagagaggaagcacaccccaagtacaggaaacagcaggagcaaaggctgtaagtagggaaagcacaggatatgtgtgtacaccaggaaatgtcatctgatttcacatgaagggtgggtttgtggtgggagtagtgggaagaggagttagaataagttgtctatattgtggaagaattccttgaatgtcatgctagagttttaactttattgtaggcgatgggaacacattaaggttcttgatcaagggaatgatatattcacagccagtagtttggggttaattccaggagggtggctagcaatgtggaatcatgtcatttctgggttgttggtggcctggagatgcaatatatcttaatagtcatatatcttagcactgaataaatggcttttgaaaccttaaataagtgattctcaaccttactttgggttaggaattacctggggagctttacaaaataacaaagatgtgggcccaacccaagggattctcattccattgttttggggtaaagcctgcaccttgggatttttttcaagtgccctaggtattacgatatgaggccagggttgagaaccattgatttaaggttaataataacttcattccttttatcagacttttttagagtgagagattcctggtatttgtcatcatagtaggaatagctgtagtattttatgctataggattgaactgatgctagatgaattaattttgttggtaagttttacacaaaaacaaaaatgtaagtgaatattgttggcaagtgactattgatcaggagaagtgtttaaatgtttcttggcagttttgtattacacttacagtctagtttactgagatcttataaataaccccaaagcaaactcttttattttttttgagacagagtctcgctctgttgcccagactggtgtgcagtggcgtgatctcagctcactggaagctccgcctcctgggttcacgccattcttctgccttagcctcccaagtagctgggactacaggtgcccgccaccacacctggctaattttttgtatttttagtagagatggggtttcaccgtgttagccaggatggtctcgatctcctgacctcgtgatctgcccgcctcagcctcctcccaaagtgctgggattacaggcatgagccaccgcgcccagctgcaaactcttgatagaaaccacctatgccttttttttccccaccttccgcttccccaaatcaacgcctggccaatgtcaggactataaaatgtactttagaattgtccttttctttccttgctctattagcagtttataatgcataacttatgcttttttcttcagtatgattgtatatatattcttcagttgtaatacaaaatgtaattcaaagttgaatgctacataactacactatcatagtaattctgaatgttaagtttttatctagaaatgtctagagccagaaactctgccacaaatcataaaaattgttttccacctattctattctcatcactgccttttaaaagtaaaaaacaagctgggcacggtggctcacgcctgtaatcccagcactttgggaggctgaggcaggtggatcacctgaggtcaggaattcgagaccagcctggccaacatggtgaaaccctgtctgcgctaaaaatagaaaaatcaaccgggtgtggtggcaggtgcctgtaatcccagctacttgggaggctgaggcaggagaatggcttgaacccgggaggcggaggttgcagtgagccaagatcgcgccactacactccagcctgggtgacagggcaggactccatctctaaataaataaataaataaataaaacaattactcttgaattagtttcactgacatgcttagtagaatttgaacagtatggtcttctttcttaaaaaaatatgtgtttgaaataaactagaatttattctagataagtttataaatattttatatttatgggttataaatcactgtgggtaatatcactcagtgattgatattttaaataaaccataaagtactgaaaagcccatgagactgagtccagaggagggggtcctaccattcccaggctctgtggctcccaggagggaaacgtggtttcctcctcactcaaaagaagggagttaatgaaataagatttcttcaagctttaactttctgtaacaggattagcaaagaacattacctgactggaaaaaaaaaagatgatatatttttaaaattccttatttctctcataactaaaaaccccacttaaaatgttatttttggctgggcatggtggcttacgcttgtaatcccagaactttgggaggctgaggtgagcggatcattgaggtcaggagttcaagaccagcctggccaacatggtgaaaccccatctctactaaaaatacaaaaattagccaggtgtggtggcagacacctgtaatcccagctactcaggaggctgagacacgagaatcgcttgagcccatgagacagaggttgcttgaacccaggagacagaggttgcagtaagccgagatcatgccactgcactccagcctgggtaacagagcaagactctgtctcaagaaaagaaaaaagttattttttggccagttgtgatggctcatgcctgtaatcccagtgctttgggaggctgaggtgggcagattgcttgagctcaggagttcgagaccagcctgagcaacatagtgaaacccccatctctaccaaaaatgcaaaaaattagctgggtatggtggcacacctgtggtcccagctacttgggtggctgaggtgggaggtttgtttaagtctgggaggcagagatttcagtgaaccaagatcgccccactgcactccagcctgggtgacagcatgagactgtgtactctaaataaataaataaaatgtcatttttattcatcatcctctctgcttattgcctagtgtctgatcacaaaccacaagatagttcttttttttaagagacaggatttctctctttcacccaggtgggagtgcagaggtgcagtcatggctcacttcagcctcaaattcctgagctcaagtgatcctcccacctcagcctcccaagtagattgggaccacccgatcatactacacacaggtaatttttttttttttttgtagagatgggttctcgctatggtgcttagactggccatatacccctggccttcaggtacccttccacctcagcctcccttccagagtgctgggattacaggtgtgtgccactgcacgtagccaacataattcttttatattggtttgagggtcattcctatgctcctcttttgaaaatagccaatgtggctaaaatagagtgcataaattaagagtgttataacttaactgacttttaaagccattactattgacctttgagacctggcttttttctttggtcccatcaatcacttctgtaccacctcccccagtatagaaggacaaaaggttagacagatgcagatacagcttgtattactgggaattatagtggtaagaagaaggaggtggggaagaataaaggaactaccatgtttttagttcttatatttcatagtgattataactaatataattagaagattaaaaaatattaatacctttctatatttaggtcatactactagatattacactggaacttcagaagcaaattatgtctgaattggaaattctttataaggtaattttttcataatttttatttgtaaagcatgcctatggtattgacttgcaggtttataactacttttgtcttatttttgttacagtgcgattcatcatatatcattggattttatggagcattttttgtagaaaacaggatttcaatatgtacagaattcatggatggtgagttttcccttttataatacttttaaaatgatttttagagtatatagtgctttaaaacctggttttgatatagatatcaaatagaattaaagataataaaatatgctaataattacctcatttatactctaagattatttcagtgttaggggttcctggggttaaatatttatagccgaactgtaattttaagaattgaacttcacttttattgaaaatttaaatagaacagattaaatgctagtctaattggtggtttgatatttgattcttttgcacaatctgtctttacttgcaaaacagatgttctgttcttttaatgtttcaatagccaaaacagattttcttttaaagaaatctattaacccaatgtcctgtgtctttcagaaagaaatcggttcttaattgcaagataagaaattgtttttcaacacagctgtttagccaagatgtgtttaattttctttggactttagccctttccttccctctctatttttttattcatttctattttggtagttctttcttgacctgaatattacggcaaaatacagatttctagggacatatcagtgaaatgatgtcatcattattattatttaccaattttaaatctaagcagtctttaaattttacatattcagttttccatagtctagtccattaaaacacaacttaagaaaatattgttagttccttgtggagattctcagtacattactaaagcaattagtttgtgccctgcaaaactttaatgagccaacattggtaccttgatactgtcataaggtgtacaacatgctctaaattagttatagtagaatgtcaaaaattaaaaatcttacagccatataggtaagtatggtaactgtggagactgaccagaaaaagtggattcattgagccagtacatgttactgtgttgtaacttttatcattctttctttgaagtcttcaatttttcagttctactcaaacatttttgttgaaacagggcacggtggttcacgcatgtaatcccagcactttgggagactaaggtgggaagattgcttgagcccaggagtttgagaccagcataagcaatatagtgagatctcatctttacaaaaaaatttttaaaaatatggccgggcacggtggcttactcctgtaatcctagcactttgggaggccgaggcaagcggagtttgagaccagcctaaccaacatggcgaaaacccgtctctatagaaaatacaaaaattagccaggtgtggtagcgcatacctgtagtctcagctacttgggaggctgagactgagaattgcttgaacctgggaggtggaggttgcagtgaaccaagatcgcgccactgcactccaccctgggtgacaaagtgagactctgtcttaaaaaaaataaaaaaaggaaaattagctaagcatggtggtacgggcctgtagtctcagttactctgggggctgaggtgggaggattgcttgagcccaggagattaagcctgtagtgagctgtgatcgtgccactgcactccagtctaggcaacagagtgagaccctgtatcaaaaaacaaataaattaaaattttttattgaaatataactcagataccataaaattcaccctttaaaagtgtacaattccatggtttttgatatactcacaaggttgtgtagtcatcaccactgtataattccaaaacactttttaccacccccagaaagagacttcctacctattagtactcactctctactttctctttcctcaagtccttggcaaccactgatttatcttctgtctctatggatttacctattctggacattccatataaatggaatctgataatatatggcctttgtgtctggcttcctttacttagtataatgttttcagtgttcatccatactattgcatatatgagaacttcattcctttttattgctgaataacatttcgttgtatggctatactacattttgtttattctttcattagttgatggacatttgggatagttctactttatgcataattatgaataatgctactctatatatttgtgtacaagtttttgtgtggacatacgttttcagttcttttttttttttgaaacagagtctcgctctgtcgcctaggctggagtgcagtggggtgatctcggctcactgcaacctccacctcctgggttcaagcgattctcctgcctcagcctcccgagtagctgggactacaggcgcgtgccaccatgcccagctaagttttgtattttcagtagagacagagtttcactgtgttaggatggtctcgatctcctgacctcgtgatctccccgccttggcctcccaaggtgctgggattacaggtgtgagccactgcacccggtcagtgttttcagttcttttgggtatatacctaggagtaaagttgctaggtcatatggtagctttatgtttaactttttaataaactaccaaacttttccaatctgttttacaccactttgcattcataccagcactgtataaggttccattttcttcatatttttgccaatacttgtcattttgtgtctttttaaaattgtgggcttgtagtgtgacatggtatcccattttggttttgatttaggtttctctaatgactaatgatgttgagcatcttttcatgtgcttattggccatttgtataccttcttttgagaaatatgttttcaaatcctttgtctattttttaaatgagttattgggcttttattgttgagttgtgagaattctttatgtattctaatacttggctcttatcagatatgggatttccaaatattttcacttattgtttatcttttcactttcttttttcttttcttttcctttttttgagctgcggtctcattatgttgcccaggctagttttgaactcctgggctcaagtgatcctcccacctcagcctcaagttttattgttttagcttttatatttaagcctttgatttatttttgagttaatttttatatatggtatgagataggggtccaaatttattcgtttgcatgtagatatacatttgttccagtaccgtttgttaaagactgtttttcccattgaattttcttgttatacttgttgaaaattgaccataacatatatttctgtactttcagatcaatgcgtatacatctcgcattgatctagttgtctatctttgtaccagtaccacaccatatttgattacttgtacttgaaaactctggattattatagtttttaagtttcaaatcgagaagtgtaagtgctccaactttgttcttttcaagattgttttggccattttgaatacctagcattttcatttgaattttagaatcagcttggcaatttctccaaaaaaatccagctgggattttgataagaattgaattgaatttttagatcaacttggggaatattgctgtcttaacattatttaatcttccactccgtgaacacagatgtctttcaacttacttaggtcttctttaattgtttttcaatgatttaaaaataatttttagggtataagtggtaactatttgttaaatttgcttctaagtttttttaatgctgtttttcttaatttcatttttggattgttcattgccagtgtatagaactgtaattgatttttgtatattgatcttgtattctgcaaccttgctgaacttgtttactaatgttaatagctttttgtggattccttagggttctctatatacaagataatgccatctgcaaatagaggtagttttagtgctttcttttcaattctgaatgtcttttatttccttttcttgcttaattaccctggctagaaccttcagtacaatgttgaatagactgatgagagcagacatccttctcttgttcctgaccttagagggagagctttcagtctttcaccattaaatatgatgttagccatgggtttggaatagttgtcctttgtcaggttgaggaaattcctttctatttctagtttgttgagttttttttttttttttaattatgaaagggtattaaattttgtcaaatgcctgttttatatctattgaaataatcgtgcatatttggtcctttattctattaatatatggtatactatattaattgatttttgcaaaatgaaccagtcttgcagtgttggaattattccacttagtcatgatgtgtaattctttttatatgttcctgggttcagtttgctagtattttcttgatgatttttgtattcatatttatgagggacattggtctagttttctttttttgtgatgtcagtgtctgattttggtatcaggataattctggccttatagaatgagtttggaagtgttgccacctcttccattttttgaaagagtttatgaaggattcatgttaattctttttttaaaacattttaggggctggacagggtggctcacgcctgtaatcccagcattttggaaggccaaggcaggtggatcactggaggtcaggagttcaagaccagcctggccaacatggtgaaaccccatctctactaaaagtaccaaaaaaattagctgggcatggtggcacatgcctgtaatcccagctacttgagaggctgaggcaggagaatcacttgaacctggaagctggaggttgcagtgagccaagatcatgccactgcactccagcctgggtgacagagactctgtctcaaaataaataaatcaatcaaaatttttatggatccataatattgtacatatttatggagtacatgcataataatattttgacacaagcatacaatgtgtagtaatcaactcaaagtaatggagatatgtatgaccacaaacatttatcatttctttgtgttaggagcattgcaattccacttgtgtagttattttgaaatatacaataaattattaattgtgatcactctgttgtggtgccaaacactggatcttattctttctatctgactgtacttttttacccattaaccaacccctctttgtccttcctttctcactacccttctcagtctctggtaatcatcattctactatgtctccataatcatttgtttttggctcccacatgtgagtgagaacatatatgtctttctgtgtccagattatttcatttaaaataatatccacccatattcttgcaaataataggatttcattctttttatggctgaataatatttcattgtgtttatgtaccacattttctttatctttattttttcttcgatggacactcagattgatttcatatcttggctattgtgaatagtgctgcagtaaacattagagtgcacatatctcttcaatttactgatttcctttcttttggatatatacccaatggtgaaattactggatcataataaggtagttctatttttagtttttttgaggaatttccatactgttttccatggtagctgtactagtttacattcccatcaatagtgtatgaaggttcccctttctccacatccttgccagcatctattattccctgtctttttgataaaagccatttcagctggagtgagaggatatctcactgtggttttgatttgcatttccctggtgattagtgatgtcaaacattttttcaaatgccttacgttgattcttctttaaacatttgatagaattcaccagtgaaatcatctggttctgaggttttcggggtgtgtcattagtgcgtgttttttttaaattatgatataatactcatacaaaaattttaaccttattagccatgatattagtccatcttgtgttgctataaaggaatacctgagactgggtaatttataaagaaaagtggtttatttggcttattattttgcaggctgtataagaaacatggtgcccagcacctgtttctggtctgggtctcaggaagcttccattcgtggagcaagagagagaggaggaaggtcccagacactttttaacaaccaaatcttgcaggaacttagagtgagagttcacttaattttgtgagaatgacaccaagtctttcatgagggatccactcctttgacccaaacacctctcacgaggccccatcttcaacattgggagtgagatttcaacatgagttttgaaggggacaaatattcaaactgtatcagccattttaagtatataattcagcagcatgaagtacattaacatggttgtgcaactgtcaccaccatccatctgcagaactctttttgtcttgcaaaactgaaactctatacctattaaataagaactcctcattcacccccgctcccagcccctggcaaacagcattatactctgtctctatgtgactactctaggtacctcatataattggaatcacacagtatttgtcttattgtgtctggcttatttcattttgcattatgtccttaagagtcatccatgttgtagcatgtgtcagaattttcttccttttaaaagctgaataatatttgtgattagtttttttattaccaactcaatctctttatatactggtttagtcagattttttattttttcttgagtcagttttggtagtttgtgtttttctcagaattaatctgtttcatctaggttatctaatttattgatacacagttctgaaaaatctcttataatcctttttatttctgcaaagttggtagtaatgttccctcttccattccagattttagttacttgagtctcctcacttattttcttggtcagtgtagctaaaagtttgtcagtttctctgtttaaaatattttttttttttttgagacggagttctgctcttgttgcccaggctagagtacaatggcacaatgtcagctcacagcaacctctgcctcctgggttcaagccgttctcctgcctcagcctccagagtagctgggattacaggcacccagctactctgtgccaccatgccctgctaattttgtatttttagtagagacagggtttctccatgttggtcaggctggtctcgaactcctgacctcaggtgatccacccaccttggcctcccaaagtgctgggattacaggtgtgagccaccacacccagctaaaaaaaattttttcatttaaaatgaaaccgacttttggtttctttgattttctctatttttttttctattctctgttttgtttatttctgcttaaattttattattttctttttttctgctttctttgagtttagttttagcttgatgttctccttctgtttaaggtagcaagttaggatattgatttgagatctttcttcttatttaatgtaggttataaattttcctctaagcacggctttagttgcatcctagaagttttggtatgttgtgtttttattttcattaatctcaaagtattttccatttttctatgatagaaatctcttgtgatttctttttgacccatttttatttaggtatgtgctgtttaatttccacatatgcgtacttgagaagaatatattctactgtggttaagtgaagtatcctttacatgtcagttaattctgattggtttataatactgttcagtattttcttattaatcttctgtatagttttgtccatttttgaaagtgagatattgaagtctcaaaaactaatatttttgagttgtctatttctcctttcagttctttcagtttatgtttcatatattttggcactccgttgttaggtccatgcatgtttataattgttatatcttcttggttgattgatccttttatcattagaaaatgtctttgtctctagtaacaatatttaacaatagttatctaaaagtctattttttccactagtatagtcactgcagctcccttttgattactatttgaatagtatatcttttttcaccatttttcaacctgttggtgtctttaaatataaaatacctttgttgtagacagcatatagttggatcatttttttaaaaatcaattctgccaatctcttatttaattagagtgcttaaaccttttacattaattactaacaaggtgagatgtatctatcccattctatttgttttctataagtcatgtctttcatgttctgttattgctttcttttatatcaagtagatattttcaaaggtaccatttaaattccccatggttgcttttactctgtgtttttgagttatattcttaatgttgctctagggattacaattaacttcttaacttataacaatttagttcagattaacactgactttattttaatagtatacaaaaggccaggcatggtggctcacacctgtaatcccagcactttgggaggccgaggtgcgcggatcacctgaggtcaggagttcaagattagcctggccgagttggtgaaacctcgtctctcctaaaaaaaaatacaaaaattagctggactcagtggtgcatgcctgtaatcccagctactcgggaggctgaggctggagaatagcttgaatccaggaggcagaggttgcagtgagccgagattgtgccactgcactccagactgggtgacagagtgagactccatctcaaaaaaaaaaaaaaatagtatacaaaaactttgcttctgtatagctcaatttcttctcatcttttttatgctattattgtcatataagttacattcctatacattgtgtgtccaacacaaatttaaaattatgccattgtctcttaagtcatagaacaaaagagatacaaacaaaacatacatttatcctgtcttttatatttgcctatgcagttacctttaccagtgttccttatttcttcatgtggatctgagttactgtcttttaacttcaatctaaagttctttcagtctgaaagactgtattttatttcttgtagggtaggttaactaatgattaattctcagtattctgagataaatttcccagtttatttgagagtatcttaatttctccttcagtttcgtagaatagtttttgctggatatagaatttttggtttataatctttttctttcatgttcaaatatgtcattcccctgcctctgacctctggtttctgatgagtaatcagctcttgttcttttgaggattatttgtaattgaaatgtcacttctcttgctgctttcaagattttctttttgtctttggctatggatagtttgataataatgtgtatagatgtagatctctttgagtttatcctatatgaagtatactgaacttcttggatgtgtagattcactttttaaaatcaaatttaggaagtttgggttcattgttttctgaaatattctttccactccttaccttttctcctctctttctgatctcccattaagcatatgtccgtatgctggatggtattttacaggtctccgagaatgtgttcatttttcttcattttcttttcttttcatcattacactggataatttccattgacctatctttacctcccttgattctttcttctgctgtctcaaatatgctgttgatcctctccaaaaattttcatttcagttattatacttttcaacttcagaatttctatttggttacatatgacttcagggaacaaagaaaagtgacagatcacagagaacaaaccagtaactttggaatcacgagcaaaaagttcaaacctaccgagccacagatgaatgagtttctaaatgccttggataccaccatctcagctaaaattaaattctgtcaatttgcatcatagtagtatcacattgcatgagactttttaaactgcaaaaagttcacatgtgattctcaagccatatatgtcacgtcatggggaaaccttttaatttttttttttttttttgagacagggtcttactctgtcacccaggatgtagtgcagtggcgcagtctctgctcactgcaaccttcacctcccgggttcaagcaattctcctgcctcagcctcctgagtagccgggactacagagtagtgtacaccactttgcccatctaatttttatatttttggtagagatggggttttgccgtgtctcctaggctggtctcaaactcctgacctcaagtgatcctccctccttggcctcccaaagtgctgggattacaggtgtgagccatcgtgcctggccaccttttaaatctttaacttctgaaacttcaaaggttcaggtcctctctgagctctgccatcagctgactcatggctttagctagaacattcacatcactgggactgtttttcccacctgtcaagtaaagttgctggactgatctttaatgtcctttcctgccctaatgtttgataggtctaacagttgccatttttgatagatctgtagaatagaaatgataataaaagagaaaaattaaaccaaccccttctgccatttttaacctgataagaattactgaattgcagaaaaagaactcatcaaacttaacaggaactcttaatcctgagtggatctgctacatcattttttcacctatgacgtttatctctaacggacatgaaaaggacaaaatgaatcagtgatggcacagagccagctgtgtaaagatttagccatatggatagttaaggaaagcgggtctaactgaggttaaaaaccagtgaaccacctcaaaattagattcctttttggcttcttctactgataatggtggtaaggtaatctttgttttttaggtttagcttgttgaaaccattgtccatttagttaattaggccctgatttatatccttggtaaaagtaaatctcctcttagaagttgttactggtacatgtggatgggttttcacctcctagttttgagtcattcaggtcattcacttcataagggattggtccagtaagctgcatttgtcagtcttccaaataccagcatgtaaagcttgatcttttttattctgtttatccttggtactgccaatttatctgaaagatcaatgagaacataaaacgtttttctgctgtattctcacttttattacatctataataaaaatgtaattttggtaaataagggtggttcagttcatatcagaagtgtctttttttcattatcttcccagtagcaccgagagccaaagtgtaatgtttagttacacagtggtttcccagtttcttgttccaatctgcaaactacaagcaaagtttaactaagagtgatcatttttctctatctgctttaaatgggataaatataaagccagtagccatatatatatatatatgcatgtgtctatatgcatatatatgtatacttgcatacatatgtttgtatatgaatacacgatttttttacagataaaaatattttctctgatgtttagctttatgaaaatttgacatatgaaaatattcacatttgcatttcggaagaatgacatacttcatgtttagtaccttatgaggcatacttatgaatcatccagtaataaagcattaaataagaatttttagcctctgataggaaaaaatatttgtcaaatactctggaatacaatttttttatagaactgaaagactatatacctcaatttgactcttaaagaaaggttattacatattgttaaaatagatctcataatcatatcattaatgagcaacgtagtggttctctgcatatattccagcttttgttggattaatgtgaaaattctaagatattaccctggtttacatttgagaaaagctgttacaaaagacaggcaactaaatgtttaatagtcatattgatctttataattttgtgtatgtatttaagtttacataaagtatagtttcttagcttgcccttgactagtttctttcagtttttcatgtatgtgactatacacttcagaataaaatggaaatatctagttatacttcatcaggaagtatgattatgttttagataacattggactaaaaagttttatactacacatccaatgcatgctgtaggaagtgtaaaaatgtattctcacagtgaacacacaggagaagcccagtgcattgttctggtaatttcatttgtagtaacatggcatgtttatctctacagggggatctttggatgtatataggaaaatgccagaacatgtccttggaagaattgcagtagcagtaagtatatggcttcagtgttaggaaatttgagtgatttaatccttctaatcaagctcattcttcttatattctcaatgttttttcttgttcttcaatcccagttggctcctaagaccttcttgattttctcctgttttgttcttcttttcatagaccagcccacccaacatcacaacatagtcacacgcttatgttctccaacctgttctagtttcatgtgtttgcagggaccttggtattcttgttgactcgtaaaatttccaacttcttctgaaaaaaaatgctgttttttgttttgtttttacattttgtagttatgattagcatatgattagcaaatacttaaaaagtctgagttgttaaagcagtctatgagaaaatattaatttattaagaacaaagtagtattagtaaagattttttgcagtctttttatgttcttggtttttaattttttcatcaactacatctagaaatttattccctttgtgatttaaagcagttttcccatattcttgtattttctatatgcactaatatactgatgaaatatataaactaaactaacattactataatgttctcataagttccatatttcacatttataataatgtaggttaaacagtgtctaagagaagtcatggggtgttgtaatagtaaacaattgctaaactaaaggcacgatgataacttcagtggtttaatgcagaacaaagtgattgtaccatgtaccatttaattaaatggctgattttcacattcattatacatcaaactgacaactcaaattctttaatcgaacatggacacttatttagtcttagttcattgtaattcacagctttccttttttctttctaattattagtgtgaagtgccctgggtgatgagaactttcttttctgatgctattgctcctaagtagcttctcatctacatgtgcaggtagattagtatgaaatttgagtacttaaatcactattttagatgaaaataaaaatgtttcatttcctgttctaatcccaggagagaatgaatgctttgtggcttttggcagttcttggctgtaaagtttaataacatgtataataaagggcaaaaaaaggcaaggataccaattgaaaaagaaaaaagtatacaacttctatatattcagttatctatggaacttggcaaaaatagaaatctgccatcttcagtagagaagcatgttcttcctgaacttcataaatcttacttccctcttgtttagggcatccacacaaggccacctatcttttcagttctactggagtaggaagactgttgaagtgaatagagtcagcagaaaaaataattcagcatcaaatacagggcttgcctattaagtgaatgaaaatgtgacacaaattattttagtgaaaggcattaaagtaagagctactctgaagggttgtttatatttgcccttacattttttttaattaggggttttcccccctaaatatgtgtccaatttctccagcttttatggctcatcaggtcatagtaatgaaaactacttacagctggagtagaagaaatgtttttaataattttgctctttgtctgccacggaaatgatcacctccatgctaaattctgcaggagcctgggtttgtataatgcctccaaaatgtagttttttttttgtatgtttcctgagtaggctacaaatttggattatcatttgttgcagctgacaaacaccagattggcccatggctaatacctggcaccaggagggttgtactagtcaaaataagactagcaaattgatgggctgtgggctgtggtgtgtaaactaaatattcccatagtctgattgtgttcccagtatccttggtcatttctctgaaagtgtactgaagatggcatcaacatctttcccttgagttccctcatggaggccaagaaaacacaagggtgccattgccaagtcaaaagcaacagaatcagaaacagagagtagggaaataggtgtatattgaatacttcctgtgccaatcactgttgcatgctttctatacaaatattatgtcatttagcctttacagccaccttgtaaagtgtggattattgaacatactctgtgcacatgcaagatgaggtttggaaaagttaaccagcttgcccagagttatcatctaattagtcagtaaaaatttgaacacagggctgtctgacaccagacctcttgctttctcagtgtgttttcctaacagaatgagaaaaaaaaaaaaatagaggcaggagtggaagaaagagctaggctaaaaaataaaaagagagacttatgaatgagagaatagtggagcaacacaattgcttcagattcttttcatgtctttaggtatctctcttttcccaaattaactttattttccagggtctaataatctggcatgcaaggcaggttcataggtccaaggttcattacagcatggacctctgttgacctctgtgatatgttattcaaattttctcttgtaaaatgtatggcaagagagttttttttttcccccaaaggaatttatatatacctgatttcagccttccagcttactcagtggctcagtggtttttctctactatccatttgaatctggtcttctataaagaggaatgcctttctgcctttccctgccacctaacacattctatttttcttctcatttctgaagcagtgacattgtgtactgtattttgagtgctaatgttgattgaagttgtccctgaaaggaggtgcacttgacatgtcaaggagcgagtgattgacaacagatataagtacttttagtgtcaaggctttgtcaagtcatcgttgtgaaacccagcctactgaataccaataatatcctttagattttcagttcacagatttctagctcctttttcaccagaatttacatgtttctaaaggaaaatgtagtgtattttgacaaagaataagaatattttctttttaaatctctaacaaaatgaataattttagcaaatattataaaatcagtatttgttttacttttttctacctaactatcagaatatattggattgccttcccctacatgttttctgaaaattcattttgtatggaaccaatttttagtggtgagctatctttaatggatagtttttataacatgcagctaagcttctaagttgaaaattttaacccttcttcctcagaatggagatgatcacctccatgctaaataagatgacctcctcctattactcaaagagaaaattgttatcgttatggatgttaatttttataaacatttaaagaaatatttttgttatatttccttctgtgataaaattatcattattaatattttgatattttctttctgtattgtcttcctgtccagaatacatgtgttttattgtaatgccagttatttccaaactgtggaacaagtcatttgctataaaaatgtatgctgttctcttagaatagacaaacatatactagaattgatgaatctatgttagcaaatctttcaggagcacattgcaccctttgagaacaattaaaatatgttaacttctgctcagtattaattgatatagattttgtcttctagatctttagtatttgggaattggctttctcccattgcatttcttatttcacagttgctcttaggcttccttgatcaactagaattcttgcatatttagcccctaaccttttcttaccattttcaagatatgtaaacgactcatttacttctcatgggtaatggtaggttttcttgttcttatagtcctgacttacccagaattctctatagtgatgaatacttgtaaatcttacagtaaattttgaccaatagtgatttgttcagtgtatctggtgtctaattatgaatagtcaaccttgaaattggtaagttcacgctcatgtgcatataggatcagtggttatgaataaaacatgtacatttccttttatagcaatttatacataaagattttttaagtttttaatggtgaccactgattaaattttccacatagaaggtagtacttgtaacccatatacttagggtcatggaaacatctttttttcagtatctcattcaactaattattcttaactcaggctatgagagtgaaaaatgcaaatctaattcagatgtttgtattttctcattttatttccttgacctgcccttttaataccttgccttgtcaacatatatgctttgcaccagccagactggcttatgaggaccatcttgatatacttcattctttcctgccccaatatactttataaatttggggggagctttttattttgagattattttaaacttacagaaaagttgtgagactaatgcaaaaaattcccacagatgcttcacccatattccccagttgttaaaagtttaccatattgggttaaaaatctataaacatgttttttcctgaaacatttgagaataagttacagatatcacagcctttatccccaaatatgttaggtatctatttcctaagaacaaacacattatcttacataatcactgattaaaatcaggaaactagtatcgatacaatactgttatctactcaacagcccttattcaaatttcaccaattgtccaataataccctgtatagacaaaagaaaaaaaattctggtcctactccagtctaggattattcattgcatttggttgtcatgtctctctaatgcctcagtgtttgtctttccttactttgatattttggaagagtacattgcccagtactttgattatatatttttaccttgacctaaacacttccttttctttttttcattcaagttaaatccgttactcaagatgtaacaccttagtaagcctttctgactcctgatgggaaaagcagtttctattctacccactgccttatttcattagttaactttttaaaaatgtctctccaggccaggcatggtgactcccacctgtagtcccagggatttgggaggccgaggcaggaggatcccttgaggtcaggagttcaagaccagccttgacaacaaaacaagatcacatctctacaaaaaatattttaaaattagcagggtatggtggtgtgcacctgtagtcccacctactcaggaggctgaggtgggaggattgtttgatcccaggaatttgaggttacagtgtgctatgattgcaccactgcactccagcctgggcaacagagtgagatcctgtctcagaagaaaagtttctccttggtcataagtgtcatgacttcaaaaaaagttttacacacagaagtatagaaaattaagaaagccattttccctttttcctgtgtctctccttccctggcttagcatcattatgaattcagcataggtacttccagattattttatatacacatgcacttatttctttcatttggagtaccttatcttcagaagattataagctcattaaaggtaggaacctgtggcttttgcatttggttttcccacaaagcctcacacagaaatgggaggtgttcagtaaatgcttattgattgacagagttttaagggaagagttaggccaggtgtggtggcttacgcctgtaatcctagcactttgggaggctgaggcaggaggatcacttaagcccaggacttcaagaccagcttaggcaacattagtgagatccctgtttctaccaaaaaaaaaaaaaaaaaaaaaaagctaggcatgatggtgcacacctgtggtcccagctactcaggcagctgaggtggaaggattgcttgagcccaggaggtcaaggctacagtgagcagtgattgtaccccacagcacttcagcctaggtgacagggtgacaccctgtctcaaaaaaaaaaaaatgttgaatgtatttaaatatggaaagttccttttaaaaaccataattgataattgtactgttttctttttcctaaatttaggttgttaaaggccttacttatttgtggagtttaaagattttacatagaggtatgtgctgggcttataagcttggatttaatttggggtggggttgggtctctccagataccttgatttttaaagtaagtgttctgacatttaagccagctgatacatctggtactcaaaaagatggctgctctataaatgttatttttcttgttttctccatcaacttctctcatttagattataaacttggtagtgtgtttttgtgaatcacctttgtcaaacttgtaaaaagatatttcatagtatttgaaaataacaggatcttgtttgtcttacttaactattgttaatgcaaaacctttgctttctgtacaattacatccttccttctattaacatttcagatagcatcacacactgttccttaagagattgcttcacatactgcaaagaaaaactttatttttaatttttttaaagatggggtcttgctctgttggccaggttgttgttaaacccctagcctcaagcagtcctcctaccttggcctcccagagtgctaggattcaggcgggagccaccgcgcctggccaaaagtaaaactttaaataagttattggtgaaagcatcaggaatagtccccttgtctagtaacagaacacatgagagaataatcagatgagtgttgaatattgcaaaaggaatctccttttgtttttttaatgttcccaaaatatctgaattcatttggagcaaattattaagtgagaaagagactataacaaagcaacttcaaggcctagtgttactaacagtgctgtttaattttacacatctgctcatcttagctgtatgtacatttggggaatggaacaacatacacattagatgtgactaaaggaaagttttttcttttaaggatataaactgtgagatggagaaaacaactgatattttcaactgtgatgtcatatctgtcactaagggttgttttcttttgtggtggttttaatatcctagtgattccacatttcttctgaaatcctcctttttaatgagggtatctagattttgacaaatcaaatagtcaggtttttgaaggtatttaactgactaaatggaatcataaactagatttatttttaaagccagtccactccatttctagagtatagttggtgcgaaaggtaggtgtagggagagtgagttttgttagtgttactttctctgagtataaataagtgtgtaaacaaatttggtggatgaaaaaaaattgaacatttttgactaccaagagtaagagataacagtattcaacatgatataacttatattgtttctattccctgtactcctacctccgcacacccagctaccggtaaagtggtgatagccattttaataagaattaacccaatggtcagttctcaaaattttattgattctttaaaaaatggacatctatccatttgacaaaataactaaaggaaaaacatccattcttaatagtaaagctttctttaaaagggcagtgccatggaaattcgagtgttgttagaaagtgagtgttaggatcatcctgtctctgggcatacaggttaattctggcttgtaatgaaatccctctctagctataactttgtgcaaggaatcttagtagcacaaagaactatagtggatagggaaatatgttttagttattctgccattatcttgatttttcttctttaaaattagaaatcatgctgataagttgatgtacctttcgtattcctgtatctaaatttttttattttaatttttactctgggtttgggagaaataactaaatttttcatttgaaatgggatcttgatagacatgtttcagatggatttgtctggatctaaaaataatgtctagggtcagattctcactataaaccacttcatgatcactgtggccaagcttggttgaccagagactctcagaagccagtaggtccttcttttcatccctggttgcaacttgggctaagaaagggctttttcgttagtgacggacaagggctgcagtggtttgactgatggagagcatagaggtttcaagagggaatcctgggcctgtacttactttttcagttggtgctggccagcccaattcctacggagagtagcctgctataaaatgccacctgttgtgagaagaagatatctgttggggacacagtaggaacagtggtagagggctgacaagtcctttcaaggaatttcagtgaatgagtgtgcacctacatctgtctcaatggaaagactaacgaattgcagtgcagatgaacagttatgtcccagtagttatggccactcaactacagaaataaatatcctgtggtaatacacctcattaaatatattcatatttagcttttgagtttcccagctattcatggaaacttttaccttctggacttaaaagcatgtgtttttactgaagcgtcaaagaagccaggtgtccctgaagacttttgtaaagcattgtaatgagaaatttaccttagattgagtagttgttaacttaatattttagaggttttgtccatatttaataacttggattccataaaaataagattaaagatgcctttttatttaccaaaaagctatttaattttcttcttgattaaaaaattgtagctttttagatcagttcaatcaggcaattaaagatcagagcttttaagttcagctaaggcaattaaataggtaatatacttgtttatgcacttttgctatataagctcattgctgttccttcttaaaagcacatgtactcatttttgctttctctaaatgaatgatgatgggaattctagctgaacatgtgtcacattgtcaaatcaaaaacaggggtccttctgcaggggctgggggagcctggtttaggcattgtgagaggacagtgaaaagaagatggtgaaagagaaatactaatgagtgatctatacctcttcctcctttgtcttggtctaagtacctgtgttgtcctctgatcatcattttctaatgccgttcttaaaaaccagagtaaaaaaaaaaagaaattgctttgtacttatgggcacaaatttcaaaagattaagaaatggagatgtgttcagtatctaatgagaaaagagaacaaactatttctcgcatttatatggcttccttggaatacggtggtccagattttagctatagaaagtgtataaataagtagtatattacagaatttattaaacgtagttaatggcttccaaacaaactcttgaaaacctggagtctctcccgtagtttatatccagtgaggactgtagagtagaatgaaatctgagcaataagcagcggcaaaccactcatcccatgaggcttgttagtctggtagaagttagtttatttgatagtatattatgttaactggaaattgttttggaaattgaagcacagcagttgctattcataatggatcatcaaatgttatattcagtcaggtgttactattgtttattttgctctttttaagatttggttgagatatatgtgcagggactttataaactattgaatgctaagaatgtggcatgtttttattataaccatgaattaatcactttattcagttaataagaatacaccactccaaaaccaagccagggagagagtttattatactttatattactgagtcaaaaattatgaaaatcttttctctaaaataaaccaaacgtgtgataattccacatgaggacataatcattaaaaatgtttgaaatgcccaccaaattaactactgtggaaaagttgtctttattaaaaggcatatgtgagagcactataagcatagcatgtgctgactatgggtaaaaacaaagaaaatgaacagtgagaaaatctgttaggccagatccgacattacaggaaacatcgcagcttcacttcaaaacatacatcgccactaatgaggtgagagccctgcatattaataaacctacagctccagtcatagccatcattacccacatcaaacataaatacaagattaacacctatgccatttcttgggaagatgtgagaatgccctggtagtaactgctgtctctttccctgaggataaaaaatagaaatgcaagggtaatgagaatagaatttagattaagaaaataaaattggcaatcattctggggccatcttacacagatgcagaagtttatagaagaaaaaaaaaacctatatagttggtgtgccaggagtttttttgtatatatgaacctggttagtttcatttactttctccaataggagaactttttaaaaatacgtttttgcagaaattctgtaggaaaatgctggccagatagatttgtgtttaaagaaactaagccttgtagtttcagtatacatgttacaaattttattttctacccttggcttttctcttttataaatctggcctcacacagactttccaattagtgctaccttagataccaaagccagtgttagtttgatcattgagcaactatttattttatacctactacgttctaggcgctttcacagtacttgaaacacatcaatatgtgaaacaaaagatttctatgatcatagaactcatattctagcagtgatagagtgggttaggaaacatttcttaaacaataacatacataataagtaagtaaaatacggagtgtgttagagggttgttaataatagaaaagaaaaagtagattgaggttaggggaagcaaagggtaggttgcgtattaatcaaagaaacctcatagggaagatgagtttgggaggaaggcttgaaaggggagagttactagtcaagtagatatatgagaaacagttagagtagacaccacaggatgtgcccggagtgttagtggaacagcaaagaggccagtgtgtctgtatctgagtgtgggagacaagagtagaatcagctgttaggaaaatgttttggtaattcaggtaagtttcaggggcccagatcagggagatagttataaagatggggagaagtggtgattctggatatattttaaatgtatagttgatagaatttgctgatggattgcttgtgacttttaagagaaaggcgtcaaggttgcttaaattgttaacagtttagtatgctaaaaatacttcttgctactttctttccctgaaaagagataacaacaaaaaaacctgataatatgaagtgctgactagaatacagagcaattagaattctcatacattgctggtagaaatataaaatggtacagctgctttgaaaaatagtttgacaatttcttgcaacatgattcagcaatccccttcctagatatttacctaagagaaaggaaaacatatgtccacacaaaaactttaggcaactctttatagtggctttattcataatagctccaaactggaaacaacccaagtgtctttcagctggtaaatggaaaaacagactgtaatacatccacagagtggaatattactcagcaataaaacaagctactgttacatgtaacaacatgggtgaatatcagatacttcatgttaaatgaaggaggtgactcaaagggttaccagctgtgtgattccacttatatgacattctggaaaaggcagaatacatacatggaaaaagcaaaatacaattttccatcctatgggatggaacatcagcatcactggttgacaaacagtggaggaggagttgactgtaaaggcatgaaggaacattttggtatgttggaaatgttctgtagcttgatttttgtggtagttacatggttatatgtgttttttagcaaacaaagacctgtgcacctgaaaagggtgagtgaattttactgtgtataaattatgcctcagtaaaccaaattttaaaattaaaaagtaaaccagatttacagagaaaagctcttcttacatcttagcagtgcagtagacactctagaaagaagttttccctgccaaaaggacaaaccattctttcaaagggtcttggtgattctgttattgtttctgtatcttcatggttcctgacaaatcctacctaggtttgatctagtaactcagtagcttaaaaaacagccagccaacccccccaccccaagaaaaaaaaccaacccttgtgatttaaaggatatctacaatgccagaaagagagagacagggtcagggaaggaaggatagtgggaagagaaacagaaacttagaagttgctgttatcattggcacaatttgaaacatctggaaattggacagttctttctgtagttaagccgatttttttccccagagatattaccaagaactgcgtatctgcagagctgacttaacctgttggacaattttaaaagctcagtttctaagaaggaataaggctttatctgacattcccaattcagtcctactgactgactgcctcactgggtgaccccagaaaggcagatcactcctgttctctttgcctctgttccctcatgtatactatgaaagagtagctggatgatcactcagatttcttcaagagctaaggttctgggttctgtgatttcctgactgaaggaagtgtgacctgttgataaggtggggaacaaagaaaatcagagagacataaaagaaaagaaagagaaaagggaggggagaatttccaagagtagattttgtgatgaaaataataacaataatgactattaagcatgtactctgtaccaggcactgttctaggtgcttaatgtatataaattatttaaggtattccttcaaagtgggaaattctaggaaatatgaaatgttttaaaactgaagataagagactaaagtataaaacaaataattgaaaattaaagctgtgtgccttagctaagaaaatgttgctttctaaaccagactcatgttatcaaatcaaaaggcatctttaagggaaactgtttttaaagtatcagggacactgaaaatgaagtattataattaataaggaattataataaggacatgtaaagtcacaacttggatggaaagcaagaacacgtttttttttcttttatttttattatcattatactttaagttttagggtacatgtgcacaatgtgcaggttagttgcatatgtatacatgtgccatgctggtgtgctgcacccattaactcgtcatttagcattaggtatatctcctaatgctatccctccccccctccccccaccccacaacagtccccagagtgtgatgttccccttcctgtgtccatgtgttctcattgttcagttcccacctatgagtgaaaacatgtggtgtttggttttttgtcctcatgatagtttactgagaatgatgatttccaatttcatccatgtccctacaaaggacatgaactcatcattttgtatggctgcatagtattccatggtatatatgtgccacattttcttaatccagtctgtcattgttggacatttgggttggttccaagtctttgctattgtgaatagtgctgcaataaacatatgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctctacatcctctccagcacctgttgtttcctgactttttaatgatcgccattctaactggtgtgagatggtatctcattgtggttttgatttgcatttctctgatggccagtgatgatgagcattttttcatgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcacattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagttttctacatatggctagccagttttcccagcaccatttattaaatagggaatcctttccctattgcttgtttttgtcaggtttgtcaaagatcagatagttgtagatatgcggtgttatttctgagggctctgttctgttccattgatctatatctctgttttggtaccagtaccatgctgttttgtttactgtagccttgtagtatagtttgaagtcaggtagcatgattcctccagctttgttcttttggcttaggattgacttggcaatgcggtctcttttttggttccatatgaactttaaagtagttttttccaattctggaacacttttttttttaatctttttgttgtgaaacaatggtagatccaccggaagttgcaaaaaaatgcacaagacagtcccatctaagggcatcctttttaaggaaggaattttgaagaaaatgggaaggtgagagggtaacagttcaaaatagtgtaggcaggtaaatgttatatatttgatattgtcctttaagtgaaatcagtataaattttaagattaaaaatgttataagaatatttgtattatattccaaaattattttgttatatttattaaatgggaaaagagaaatggtttggtagaggtaaaacgtttgaattccttaggaaagaaattttgatgtcaaggtggtagttaaaatagtatgttagtgtgtgtaaaagttgggatttggggcaaaaataaattagggaatgattattttctggataaagtgattcttaaacaaaagaattcttggaaagtattgctatcaatagaaaactaacctgattaatttttaatgatttattaaaagataatttgcataaagctttgtaacaatctgtttttttgcagagatctacatagtttgtgattaactatatacattatagtgaatttttaaataacctatgacatatttttgctttctggaggatcagtttttgtttgtttgtttatttttttgaaacagagtctcactctgccgcccaggctggagtgcagtggcacaatctcggctcactgcaacctccacctcccaggttcaaacgattctcctgccccagccttccaagtagctgggagtacacacacgtgcctccatgcccggctaatttttgtatttttagtagagacagggtttcaccatgttagccaggctggtctcgatctcctgaccttgtgatccacccgtctcggcctcccaaagtgctgagattacaggcatgagccaccgtgcccggccccaaacacttttttaaaagaactggttagtgcttgagtaacccaagtaaatttaaaaggagtcattcccagtaggttttatgttgccatgtgtaatgatgagagagctagtatgtgcgttcttccttccctgagctctcaggctgtttaatcagatgggtctggaaggaggcatttatgttatacaagtgctagtgttgagagcacagttaacatcctatctcctgtgtaaaaatcatttccatattgtcctttaaatataataaatattaatcacatccagcgctatagtagattataacttgtgaatgtgtatgtttttgaaaagaaaaaaaaagacttagcccattaacagggtaaacaaactctgactctaggttgttggtttttctccagctctgacactatccacacaaatgaacatctcgagaaattaagcctctttccccatattggtcattcattctatttaccttgggtgatcacagggtatttctgtatttgcagtatgttgtgattttcaagagatcagaaacgctacatgtcttaaaagtattcttttaaaagaatatgtgcctagaatatataaagaactctcaaaactcaatggtagaaaaacaaacaatccaattagaaaatgggcaaagacatgaagagacattccactgaagagtatacacagatggcaaataagcacatgaaaaagatgttcaatatcattaggctttagggaaatgcaaattaaaaccaccatgagatattactatatacctatcagaatggctaaaataaaaaatagtaacaatagcaaatgaggatgcagaaaattggatcactaatacattgctggtaggaatgtaaaatgatacagccccactgctgacatttaaaaaaaagagaaagaaagctagacatgccactaccgtatgacccagcaattgcattcctgggcatttatcccagagaaatgaagacttctgttcacacaaaaacctgtacgcaagtgtttattgcagctctattcatcatagccaaaaactggaaacaactcagatgtccttcaacaggtgaatggttaagcaagctgtgggcattcataccatggattactgctcagcaatagaaaggagcgaactgttgatgcccacaacctagatgaatctccagatcattatactgagtgaaaaagccagtcacaaaggttacatagtgtatgattccatttgtataatattcttgagatgacaaaattatagaaatggagagagcacattagtggttaccaggggctgagaggatgggagacagagggaatgtttacaatggagcaagatgaggaatcctcatggtgatggaaatgttctccatcttgactatcagtgtcaataccctggttgtgatactatactacagttttataagatgttaccattaggggaaactgggtggagggtacacaggatgtctctgtattatttcttaccattgtaaatgtaaactttgagataactgtgtaaatctatagttatctcaaaattaaaagcttaatgtaaacaacaaaaaaagaatatatcatctttctgtagttacctgtattcagaaggtcagcttaatcagagaaggttgtcctggacttagtttttctctctcccatgcttctgtggtaggatttgatcataggcagagtcatcccttttaggaaatcagtaagagggaaattaccctcttccattctgaaaatgagtatcaatggaagccttagaggagaaataaggaaagacgtcgtgtgtcattcaaggaacaaatgcaaatggaagaggatagttatttccccagtccccacctctaaaagccttctgacttgcaggggattgggatttgaagcagactgtgtgatcgttgtgtgttttggctcaccagtctctatagtatccattagggtaagcttctatccaaccacccagcaagatgcccccagtgtgtggatgagtgtttgattcaccaagccccgcagttagctctgatcattgctttgtctctgacacaaacctgaagtttaggagcttatcagagggagagagagagcacctgtatgatgaatgacagggtcatttctgttggtagaggagtttatggcattgattgtatgccagtggatatttgttggatgaatacattgaatcataattttctgagggcagtgtttttctcctggaactttttataatgtggctaaattggaagtcatcttttgttcccctttctcgtattaaagtaagagatttatccttgggacattttgccaagcagaatggacagacagctttagcagttggaagagctctccatgtctcttcctttctctaaaggcatggttgaaggtgatcagcaccatggaaatcaaatctactcttttgctggtggaagattaagttccttctggattgggtacaatcataatgataacaatattaatcattttcctaatatcatttattgagtaccttgtatgtgctacagtgttagctctcttgtatgtataattttatttaattgttataataaccttgtgaggaggtatcattgtatctccattcttaggtgaagcaatcaaggctcaagcagcctaaaaaacttgcttagttataggaaaagtcataggaaaaagtcataggaaagtggttggtggcctaatggaaaagctctagtatgagggtcagacccaggtttaagttcttgttcttcctcttaattcatcttagctatgtgaccttgggtcagcttcttaacttctttgaggtcatagcattgtacctggcatataacagctattattatgtcaaataattatttctcaagaaaagaagcaagaggttaaatgagagggaatagttagaacgttcctcacactttcctgttaacatctccttttcttagaaaattagcctgtgagtataaagaacttaaaacatctgggctattttctttgtgaacttcccaagatcacccaactattcactgccaaagctgggataatccatcctattagttccaataagatttagctcataaatataatgcagtttgttaaggcttaagagctttactagtcgaagcctctagttttgtgtccttgggcaagtaatttcattaatttgaacctcaatttcctcctctgtaaaatggggttaataatagtacctatctcaagggttacaatgagaattaaatgaggtaatgcatatgataataatgcacttagcccagttcctggtatatattaagtgccaagtaagtgttatctaccataattttttgttatttctttaaaacaaattaccaggattagtcttcgggacacaccgctccaagtcaagtctgctgtcttacatcttatttatgcatataatgtggtattcctttgttttctttcctttttccccaaaaatgttttatagtcaagaggagtcttaacagtcagtggtatcttagacttggggaagtaggttgtgcaggaacacattcctccagacctggcttttcctaaacactgaccagaatatgtacacatcacaggtaggaatctaagattcaccactttagaaggaaatctcttttacttactatgaaaggattaagagagggagaattgagaagctcaggcctttttgcccttgttattaatcttgtaagtgtcccaggtaccctgcctttattgaagaaggaaagggcacgtttgttgcctccattctgaaccgaatcatgagactccaggcaataactgccattgaggatggctaattatgctgtttaattttatttaaggcctttgcaagaatatttggatgacctaccctttcttatgtgatggagtcattagaataacttttatattgaaatgtggttttctcttaagtatgttcccgttgtgcacagatgaatttgtaatgcagaacgtcagcatagtctatacttaattgtacctgctgttctcattcattagaatgcagtccccaataaataactagatagatatattgttttttttcttttcataagacaattaaacataatgaaagagcattgctgaagatcccaggcacagtgctaggagaggttgctaggagtggagaccggctaatgtgccctctggctcctggtaaactgagagtggcttcctggtattcacacagtgtaattgctttataggggggaaaagttgaagagaagtttatttctgcctccattgtcatcccacaacagccacatgccacatttaaaaatgtttctgtaacaattgtaccatgcctgtttctaagagcattcagtgagacatgtaaaagttcagagcaaattaaatgtttaaatatgaaacaaagaccaaaaggaagtagaagttggagataccaacagcacctgatgtgaataggtcacaacaaaaagggaatcctcaattggtatggtttttcttttctggcaaaagaaagcatatagctgatacaaaaatcacaattttctttagaactgatcttaccagacaccgggcacagtggctcacgcctgtaatcccaacactttgggaagccgaggcggtaggatcatgaggtcagtagtttgagaccagcctggccaatatggagaaaccccatctctactaaaaatacaaaaattagcggggcatggtggtgagcacctgtagtcccagctactcaggaggctgaggcaggagaattgcttgcacctgagagtcggaggttgcagtgaggtgagatcgtgccactgcactccagcctggcaaccgagtgacactgcatctcaaaaaaaaaaaaaaaaaaagaactaatcttacaaggaaattaccgtttgggtccctatacaaagcacattaagtaactccaactgtagttttgtgaaggagcttttatttgttttgaacagccccctcggcacccagccagatcctagccaagggtaacctcccaccctgacccctgattgtgctgggggcaggggctgggcagtgggcggaggagcccttttgtgaagatgttgggaaagcacatgctcttgaggctctggcctttattagcaagcttctgcttgatgctgtttatgtggattgtttaatggctaattgatgcagaatgtgtaaagatacagtttcctgcgtgaggcagttatgggtggcaacatgggttgtctcaacacgataccaatttccacagtcaatttggccaattcagtggggggaaaaaatcagtccagcctgaaaatcagagcagctacttgcggttattgaggcaactatggttggtggaccaaatttttcatgtttgaatcagttgtttttacattttatagacatagccttactcatttcttgaaataatcttaaatacacaaaagtaacattttaaaattaatatctttctttaaatatttgtaattgcggtttatcaggcctagtgcatatcagttctaagaggaaataaccattttaccattgatatatagtatatgtaattaactgatctttcatactttgttatagggtaagagagtgaccacagtgaccacaaaagcacctgcagaaactatggattatcaatttatttattagtaattagtcatggtaatgagaaatcaagttgtgttttgaggttgattttttaaaacagctttattgatatataatttgcatgccataaaattcatctactcaattcagtgatttttagtaagtttataaagttgtgcaaccataaccataatccagttttagaacattttcatcaccccaaaaaagtgtcctcatgttcattggcaatcactccctgctcctgtcctcagccccagggaaccactgatttactttctgacttttacagatttgccttttctggacattttatataagcagaaacataccacatgaaatctttgtgcctgacttctttcacttagcatgatgtttttgagatgtgtctgtattatagcatgtgtctgtagttcattcctttttattgttcagtagtattccattgtatggatatatcacattttgtctgcttatttactagtagagggatatttggcattgtatccactttgggacgattatgaataatactacttttcatacacaagtctttatgtggttctgtattttcatttctcttgagtaaatacctaggagtggaattggtatatttctttagatatttgtaaatcatagtttatcaggccatctagcacatatcagatttgagaagaaataattattttaccattggtatatattatatgattagtataatgaaccaatgtttcatactttgttaaagagtgaccacatagtgactacaaaggtcatatgatagctttatgtttaagttttaaagacactttgaggctgatttttatttacctaaaaccacctactattatccttagcatgacagaaggctcttttagtaaactcttccattctttctgctcactgatacttttctaataatcttctaagcatttcaagttattggatggaactgcatcataaccacctattatctacttgggctgtcactgctgcaactcaaagatttattgcatcatcgttaaaaagcccagcttactgtgaaatctcactgaaggagtgagacagtattgtgacaggagacacatgttgtgattggataatgttaactcgtctgtgatcccagctgaacacacttgctaccctagaagaagcctgccttcaggtggagctggtataatgaaagttaacctcatttagcatttggatatgagccaatgtattaaatgatccacatcctgatttcctagagtggaagtcatcattactgattctacaaagcagtagctttatagtatatttggtacattcaagtttacaaaatgtttttcccattcatctgattcattcaacatttcactgacctctagctctgtgccagcagtgctaagcacacaggcccacttcattctcttaacagccttgtcaatgtaggaagatcagatatcaagatatcagatatcaggatatcatatacaggatatgatgtacaagatcagggatgatatctgatcttccaacactggcaaggttgtcagtgagaattcaggattgttatgagaattaagtgaaattgtgtgctcaacactgagcatgtgagtgttgtgagtacacacacccacacgtacatgtatgctcagagagatttaaatgattcgtccagtctcacagtcagtatgcagcggcaccttccagggcatcactctgcttcctttaagggaatctgacccacaggaatctattttgatgcctataaaagcctactgcataaaatgactaaatcttttaaaatgaaaaaaggagtattggatattaaaaatgagccactttgcattgtgcctttatcttactatttccaaaatgatagtcatctcttggccaagatagcttaaacccaaaccttaaattaggaaacacctaaacttgatatttttaatgcaaaaggagaataagttagtttgctttttcactaaaggtttatgtgttgcggtagaagaaacttatttctctttagtggtatgaaaaggacccataattccaggcttcaacacacctcatttgtattttctttgagaaaatgtctcagttaaaatcaatgccctagtattcatttgagctcccttgccttcaataaaactaattgataaaccctaataattaatgccctgattaaaccaaaatgacttacatctgccctgatgattgccatttataatcaatcactttaatgactcatcttttctgtgctttgcttacagaagaaaggctgtgatgtttttaagtgaactgaatgaaaagctgtatgccttcaattgctgtttgttttccataacttgatattgcattaaaataagcataaatataactacctccttaaaagtaatctttctgcctaatctgttgtgctgttgtctatggcttcgagtgaagctgaaaacaaacaagaaaaaaaaatcaaatcatttcagtgtttctagagctatttttttttttttaagatagagtcttgttctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctggctaatatggtgaaaccccatctctactaaaaatacaaaaaaattagccgggcatggtggcaggtgcctgtagtcccagctacttgggaggctgaggtaggagaatggtgtgaacccaggaggcagagcttgcagtgaggtgagatcccaccactgcactccagcctgggtgacagagcaagactccatctcaaaaaataaaaaaaaaagagttgtaggctgggtgcagtggctcatgcttataatcccagcactttgggaggctgaggcaggtggatcacctgaggtcaggagttcgagaccagcctggccaacacagcaaaaccccatctctactaaaaataacaaaaactagctgggcatggtggcagtctcctgtaatctcagagactcgggaggctgaggaaggagaatcgcttgaacccgggaggcggaggttgcagtgcgctgagattgggccattgcactccagcctgggcaacaagagcaaaaactctgtctcaaaaaaaaaaagttgtagaacttgcatgttttaaatgaaaccttgaagtaataagttcagtggctatatactaggattgttgatactttggatataaggtagaatattttatgcaagaaataacaaaatttaaattaggggagctgtccttaacccaagatttaaagggattctatttgcttcaaattctgccacatgaattcagatttaacctagtttaataaagtcctaagattatttatatctacattaccttaaaaaaggattcaaggtggtttatgatataaggtcaatacaatgaacaaaagacaaaagcaaacattttaaaagaaagggaggcggggtgtggtggctcatgcctgtagtcccagcactttgggaggctgaggcaggtagatcacttgaggtcaggagttcgagaccagcttggccaacatggcgaaaccccatcactactaaaagtacaaaaattaactgggcttgttggtgggcgcctgtaatcctagctactcaggaggctgaggcaggagaagcttgaacctgggcattggaggtggcagtgagccgagatcgcgccattgcactttagcctgggtgacatgagcaagactctgtctcaaaaacaaaacaaaacaaacaaacaaacagatacttctacttctgcccatggagtcactgctgtgggatttgccctccaccaaaaataattaggaaactggacaaaatagtgaaacagttatcttcaaactttagacaacaggcaatgtgagacagtgatccctgagagaacagaaacaaatgaagtaagtcctactatcacccaagctgtctgcacagaaacccaaacaaagctcaaaggtcttactgagctgaaaagacagaatttggagttcaaggagaccaaaatggctagaattcacagagcagagtcctagaaaggcaggaacatgcagagaaagagctctagaaattgcataggagttcccttgcgtctggcctaacatcagcctctgcatttatagagtgaaatcctacaaagctagacaaccaactactgtttagaaaagaaaatttctggggaactataagccaaacaattcccaaaacttatacaaagttgggaatattttaaattccaataatccagtgtagagaggcctcattaaacacattggagaattcaagaaagagattagaaggattatgctttagcagtggggctaaactagccctgtagtagtggttactctcaactctcctaaaataaaaggtctaaaatcagcctcaaaatgattcagctatcagtgttcagcagatatattacttgccagtatcaagtccaacactctggattacaataaaatccagcattcaacgacacaagattcacaatgttgacaatccaaataaaaagttgacaagcaaagaatttttcttctgattatggatgaaagactataaccgggaaaaaatcaatctgtagaaatagatgcccccctcccacacacacaccagaaataatgtactttgcagacaggactttagaatagttattataaaaactatatatgtccaaggaattcataggaaacatgagcataatgagagaaatggaagacaaacaagttgaacatttatttttcaattatgaaaaatatctgaaataaaaatttcattgatggaattaactgaattagacactacagaagaaattgtgatattgaggttaaagatctggaaattatccaaaattactcatttctactactagaaaaaatatttttttaaatgagcacaaccttaatgatctttgagacactatcaagaagtctaagatatatgtgttaagtggagtctcaaaagaagaggaaagagaaaaggaaacaaaaaataatttgaagaagtaatggctgaaaactttccaaatttggtgaagcctgtaagtccacagatctaagaactcaatgaaccctaaccaggatgaacacagagccacaccaaagcacatcaaaataaaaattttgataaccagtgagtaaaaagaaaatcttaaaaatattcacagaaaacagagcacattaagtagagaaacaaagataagattgacagccgacttcatgtcacaagctatgcaagccagaagataatggaaagacgtctttaaaatgttgaaagaaagaaattattccagaattctgtgcccagcaaatacattttccaaaaataaacagctaaataaagactttttcagatgaatatgagagaattcattgccagtagaccagcattacaaaaaaatgttaagctatttaggatgaaggaaactgatgatggatggttagatctacacaaaggaataaatagtttcacaaatcgtggataaataaaaagatgttttctcacttctaaatgtctttaaaatataattatttaaaggaaaaataaagacattatattatggagcttatagtgtacatagaagaaagatgtatgaaaataaaagatgagaagaagaaaatggaaatatattattgtaaggtttgtacattataaatgaaataccctaatattacttgaaggtagactgtaagaaattaaagcagcatattgtaaattctagaacagccataaataaataaagcttcaaacagactggcaaaattcaacccatgggcaaaaattgggccttcgcctgtttttacaaacacaatggaattggaacacagtcatggccgttcatttacatgtggcctatcattgcatttgcactacatcagcagaatttgagtagttacaacaaaaagcttatagctctcaaagcctgagatatccacttatgactctttacaggaaaagtttgccaacctctggcttagaagcaaatagtagagattagtggaatgctaagaactagcccagctaacccaaaagaaagcaggaaaagaagagaaaaaggaacaaaggacagatggggcaaatagatggtagagttgaacccagccatatcaataattacgttaagtgtgaatggtctaaacagtccaattaaaagcacaaatgtcaaactgtataaaagaacaagacacaactgtacagtgtttgcaggacacctatttcaattataatgacagatatatcatccaacaataatcagcagtttgtttaaagaaaaataattacatggccaggcgcgatggctcacacctgtaatcccagcactttgggaggccaaggcaagcagatcacgtgagttcaggagttcgagaccagcctgggcaacatggcgaaacccccgtctcactaaaaatacaaaaactagctgggggtggtggcaggcgcctgtaatcctggctactcaggaggctgaagagaatcacttgaacccaggaggcagaggttgcagtgagccaagatcacatcactgcactccagcctgggcaacagagtgagactgtgtctcaaataataataataataataataataataataataacatgttgtagggtttataatttatgagaagaagcaaaactaatgtataatgacaaaaccactcagtgatttaccaaaggctgggggtcagggtagaactgactgtaaagtttttaaacttttacacagcaaactttttggatgagtttaaaaactttgaggtgagcttaaaaactttaaagtttaaaggtttctaaacctgggggtaggagggagatggtgaaaacagaatgaacaaaggtttaatgatttttttttgagacagtggttaaaacagtccaggtggaatgcaaagattggtttgaggatgactggatgtctagtactttaaagtttttaaactttaaacacagcaaacttttgaggtgatggaaatgttctgtatcttgatcatggtgtggttgcatggatgtagacattcatcagactcatcaaactacattcaaaatggctgcagtaaaattgatttttttaatgagatttatttcaaaaagtaaagtgaaatgagaagaaatttctcttcagatattctgaactttttagaagttaaatcagagggaaatgcagtaagttatgttggtcttttaaatgctggcctgaaaaccaggctgtattggattggtttctggttcaataagtctggagtagaacacaaaaagctgtattttttaaatatgcacagccaagcttaggagctatttatttgcataactttcattgtctttattaaaagaaacatccctattgttcagaaagaaaaccccacttagaatatacataaacaacattgttatcctaaaatcgcatgaacagtatttttgttcagagaatataccaaactgcttcttggtctacatgctcctggaggccagagacagggtcttactcatgtttctctccacagcacctagtaccatatctggcacatggtaaggtgtcagtaaatatttgtgagtgagtacttttaaatgactatggattcttctcagaatgaagtgtcattttgaaatgtattcattctgaactgtagtccattaaatgggaaaagatggagctccttctcaggccaaattcatgctcttctggatcggcatgttagttcacctgtttagtagagacaccatttattcaccatttgctcaacaaatattgtttcctgtatgtaccagacaccattctagatgtggtagtgaacaaaacagaccaagtatgcattcatggagcttcccttgaagaggggagtactgagaattaacagatctatgtgtagaaatggagcgtgttgatggaggtaaatgttaagaagaacactgaagcagaagaaaagggaaaggaagtatctgagctggggggtattgctactgcatactacgtggttaggaaaggcttcccctaaaaaggtaagaatctaaagcaaaggagaaaaattcaggcaaaaatctaaagcaaaggagcaagccagggacaatttgtggaagcatagtagtattccagggacacagagccacagcgcaagagcatacctggcaggtaggccagtgagctgaagcagagtgggcatggaaaagagtggcaaggtgagagtatggggcagctcacaagggccttggggacctctgggaggactttccatttttgcactgagttggaaaggctttggaggttttaggcaaagaagtgacgtggtctgacttaggttttaaagggatcattttagctgctgtgttgaacacaaactataatagagcaagtgtaaaactagggaaaccagcttagtagcattgttgaggaaggggtgcatatagtctggcaaaaatgtttccttgtaaacatcacattggttttacagtcctacttactgagctttggaaattattttctttgagctagtattttacccaaatacagctttaattgccacagtagcaatagaaattattttctaaatataatgaaatatacaactttttctagcttggttgattaccaattgataatgataatacacttaaagaatgttggacagtttaaaaagcaattttacattcattatctcatctaatcctcacagttctctaatattgacaaggtaactgttatctccctacagagttggaaactaaaacatcacatgccaaggccaaagtcatgtgccaaatttgtgacaggatcaaaaagactaaaacccaggtcatatgtctcctagcccagattcattgactttgttaaagggggttgttaggttcaaattatgtctcaaggttgctggtaaaggggacatttatattagcaaatttaatgtatcatttaaaaagctatcaaccagtgagcaagatactgtgctcggaagggatacatttaaagatgtataaagtatactcctaccctatgaacttatttcttttggtgatgatactgataacagcaaaaacattaagtaactcttagtataaaatgtcgttaaagctgagtgcagtggcaaacatctgtagtccctttgactcgggaggctgaggcagaaggatcacttgagcccaaaagtttgaggtcagcctgggcaacatagcaagaccctgtctctgaaatacatacatgcatacatacattacatacataaatcatatgctttgtcccatatgttacatacataaatcatatgctttgtcccaaacaaatggtacagacagatgctacagaaattcaaagaagatagtgactttgatggcctgagattaaggatgggcaggattcagatagttggaaaatatggaggaaaggtttctaaacctgggggtgggaaggagataatgaaaacagaatgaacaaagccttaatgatgaggtttttttttcttttgagacagtgattaaaacagtcttgttggaatgcaaagattgatttgaggatgactggatgtctactactttcacacataaagtacttctgaaaaccagattgaggggagaatatggaaaagtcatacagtaggcttacatatatgttaaaaagatgttggaaagctggaaaaatgcagtcaggttcttatttacaccttgtcttttggaatatagtttagcagttttgttgttttattattttgtctttccattgatccacttaagtcagatgtatctgattgaaactaaagatttgctgcttttagcatacctcttaatttccaggcagcaccttcttccaggagttcaaaatatttgttcattaactgtctccatctgatatggtagcttaagaatggtttagggcaaacttgtccaacccatgctccacgggccacatgagccacaggacggctttgagtagtgcagcccagcgcaaatttgtaaactttgttaaaacattatgggatttttgtgtgtgtgccattttttttaaatctcatcagctattgttagtgtattttatatgtggtccaagacagttcttcttccaatgtggcccagggaagccaaaagattgtacacccctagtttaggacatcaatatgtaaaagaacaaattgtccaaaagaaaaatatttaaaactgagggcccatgataagaactagatttgaaaaataagaccaaactatgtagaatctaacatttgtttcagttcagcaaacatttaagtgtctactgtggctatgatgtgttgtgctaactactggggcacacttgaaagcacaaccctgttcttaaggaattcatgttctggttggtggggggcatgtcagagaatacttaacctcctccttaaggagacaagtgatgtagtgaaagtggtatatttaaggtttaatatgatgatggtataagaattatgttgaaaaattagagaaaactagacgccaagagaccagggacttgctggtaaaggggacatttgtcttagcaatttttttttttttttgagacaagtctcgctctgatacccaggctacagtgcagtggcaccatctcagctcactgcaacctctgtttcccaggttgaagcaattctcctccctcagcctcccgagtagctgagattacaggtgtccgccaccacgcccggctaatttttgtatttttagtagagatgaggttttgccatgttggccaggctggtcttgaactcctgacccccagtgatctgcctgcctcagcctcccaaagtgttgggattacatgcgtgagccactgctcccggccatgtattagtaaatttaatgtatcatataaaaagccattaatcagtgagcaagatactgtgcttgcaagggatacatttaaagatgttttaagtatgctcctaccctgtgaacttatttatttcttggggcgatgataccgataaaaagagcttacacctgcctgtgcataccaacttgaattcatagagcctcccaatagaggttatagtgtgtggtatctgaagggcttgctacagagacaggctctacagttcacccctcatcactgaaacagaatcatcaaccacaatgtgtacttgtggtttccattctttattcactcatccattcaacaaatgtttatcgagcacttgaaatatatctggcactctttcaggggctgggagtacagtagtcaagaaaagagacaaagtccttgccttcatggaatttacattcaaatgtcagttatcaggctaactgaggctgataatatttagcaggctaaatgagctaatgtataagaaaatgccaagcacattgcctgtcacataagtatgattcagtaatagttactgtgtgtgaacttgaaatttgaattaagtatctactcttggcaagatactttgttgtggtacccttttgccggatggaaggtcaggagaagattaacccatttacagtttttaaaaaaatgttacaccaaaaaattgagtctcctgttcagtgtcagtgtagttgagattatatgctgttttaaatataaccagttgtctctgctggactacacttttgccataaaagacgcattgaagcagatgctgctctataccatcaaaagtggtatgctcttgtcctccttgggtggcttttttgggctccctgaattcctgaaaaggctcattgttgtcactgacgatgcttcacagaaatcctttgtgtcattacttagcgactgactgctttggtgaaatctatgtcaattcttttgttaactataacagcagccaaaaataatgtaagggaagagaaggataaatgaaacaaagactaataagcacatgcatgtacacatatatacacatcttttagataaatttctaagtattatctgaagtagcatttgccttgtaaaacatgtgaaatagcagtactacattaatttcctcatcggtttcattcaaatatgacctgttacccgtagcatatgaatgctttttccttgttgcctccctttggcattactattacttagataggaggactagcttgataattacacatatagagcaaaactcatcctttttgtgcaaattctttgcaagaagattacattttcttatctacctacttttcctgaaaaactagggataggatgatgggtgtatttactgttgttgtaagccaaggtttgatttcactgtcacttaaaataaactctttcttctgtagaaaccagaaatcgttgaacgtggaggagttaagaccttacattttaccttcggttaaaaaaaaatgcttttcattaaatttgtgatttgaatttcggattaagcagatgatgtcatttctgcaacttggtgtggtgtgcatgtgtgcttttaaagaacaaacgctgtagatacatggaattagttacatggccttttctggtccctttttagacgtgaagccctccaatatgctagtaaacacaagaggacaggttaagctgtgtgattttggagttagcactcaggtatgtctcttttcctcccagtgtactgttttctctgcaacaacccctttatattttcattctgttctctggattgaaaaatcacctagctgccagacaaacagaaactctgcatcttttcctcatctgggagtgtgttattcatttttaatctctgagcgagtttccttcatcagaatatgattgttcattgtttaatgacagtaaaaactgctgatattgtaattactacttacgaatagcaaacttcattgatatgcagctttgatatgaaagcgttttggccagacaaaagggagggcagagtgggagctgtgcctggggagcccaactggcccacaataaaaattaatattgggagcaacaatggtggagggccattacaatgtgcagcacaaattttaattaatttccattttggacctcccctgagaaacccagtgatagtgacccatgagcatgctgtgatgttgatttgaattgcagccacctttactcccagccaaacacgaagaccaaagcgaaggtcatcgttgtattatgagttgtcaaagtctgttatccctccagcgtatttagtgttcatttcattctagtaatgcatggggcttcattcacatcttgagccatctgactaaaaattgagtgtgttcaaattctgctttaaattgactttttatatcaggcgggtttgggatactaaagcgataagcatcctgcttaagtgaattgtttaaggttatctgctataaactgtaatgctgtgcttgtttaaactggaaatcacattcaaaagaaaagagagatttaatcatttttattgcctttgtagataaatttgttcccttttacataatttttagttgatttatatgaatgatgattgtaggttaaatgaggaataattgcccattttatttccacattatctttatattgttctaacagactgttttgtctcatagctggtgaattctatagccaagacgtatgttggaacaaatgcttatatggcggtaagtaaacttatgcaaaaataacgtttaaaaccaacatctttatctttatgtacttggtaatgtataattcttgaattaattccacagctttagcctagcagatcataaattgcaaagtcaatctagtcatgatctgatttttaaatctttctaaaagacattagagtttttacaggagctatcaacttatctgactttgttgacttaactggttggttcaagtgtgaaatcgctgagtttcgaagtttaatcctacagagagatttcaccttgtagcatactggccacttttccacatttcttatttaattaaccctcaagtatccccaaatgtcagtcaataaaattgttttttttttttcttggaatatgaacatgctttgtcaccagatcaaaattaaattactgtgtagccaaattttatttatggatctctgaatgtaaaggtttagggggcagttttctatagaacttgtacctctatattttgtttagttgttattcatgcctattgtaagattatttagttgcactgaaataaacttaccaacaataacaagtagaatcataaggctgtttcaaagaccagtgcagacttggcttttgagtaagggaagttatttgttttcataaaaatactttagtttatgggttttcataatcaccttgagagtcaaagggaaaaaaaattaaacaggaaacttatctagtattaattttggagcaaagttttgtcttcctctaacaaagataattttttataatgaaagctctaaatttatttaggtagtccctttcatctctaatagcctttgttaatatgtcatgaaattaaatgatgttagtatggataaaaccgtgggtcttagtctcagtattctttctgtatatattatcttgattaaagatttagggatggaaaaaacacatgaaaaaatgctcatcatcactggccaccagagaaatacaaatcaaaaccacaatgagataccatctcacaccagttagaatggcgatcattaaaaagtcaggaaacaacaggtgctggagaggatgtagagaaataggaacacttttacactgttggtgggactgtaaactagttcaaccattgtggaagtcagtgtggcgattcctcagggatctacaactagaaataccatttgacccagccatcccattactaggtatatacccaaaggattataaatcatgctgctataaagacacatgcacacgtatgtttattgtggcattattcacaatagcaaagacttggaaccaacccaaatgtccaacaatgatagacaggattaaaaaaatgtggcacatatacaccatggaatactatgcagccatacaaaatgatgagttcatgtcctttgtagggacatgggatgaaattggaaatcatcattctcagtaaactattgcaagaacaaaaaaccaaacaccacatattctcactcataggtgggaattgaacaatgagaacacatggacacaggaatgggaacatcacactctggggactgttgtgggttggggggaggggggagggatagcattgggagatatacctaatgctagatgacgagttagtgggtgcagtgcaccagcatggcacatgtatacatatgcaactaacctgtacattgtgcacatgtaccctaaaacttaaagtataatgataataaatttaaaaaaaaaagatttagggatggaaccttattctaaacctaattctaaacctaaaccttcttctcagaacaatacaaaacattttgttttcattcagataccagaatagctcatttttgtcttgcatggtttttaaagaaagtttatactttcttgtataataataggaaaaataataaattaacctctgaagtcttcatatctgtttttataaaatgtaattaccttccttcctctaccaagttaggtgagattggtgagccacctttatagccttgctgaatgctaaggtttaagtctttgaaagaatatgaaacactgtaattttttaaaagttggggggacatgactataaatgaaacaattgctcaactacccagcatgttcttagtagctttaaattcctctgataattaaattgcattatatttgaatgtacaaatccagattacagttgtctttcccaggtgtacattaaagaaattagttttttatttttgtttatggatgaatgtgatgcatctatctgttaattgaaaatgtgaggattaaaattatgaaatgttagcttggattgacaaaactaaaattgctttgcttcttaggtgagtgaattctagtcgtcagctttgtagttcaagctataaaaagcataagatacctagaaaaggagcaatgatagcttgagagtgagtgctttgctcaggtcagtaggaggctcttattggccaagtgctcacctacatggtgtaaggttgggggtggggggaggtggaaataacctatattattatagtacaggtatgaatccctgacttttatctgctgacagtctcttgagagaaaagagctgagctttttttttttttttttaaccacaactagttctcattttagctgttatattttacaattttgagttctacatgagccctatgccaaatatccatgaactacagttctcaggccaaattcaatttactggaacaatgtactgatcactcttccaagctcttactgcctatttttgtaaataaagttttattggaacatgaccacacccatttgcttatatattatgcatggcccctttagcactacagtggcagagttgagtagttgtgacatttgcagcagaaagtatatggctcataacatgaaaaatatttactagctgaccctttaccgaaaaagtttgccagcccctgatctatgccagtgaaagttgtatctgaaactgagcaccttcaataatcaaccagcatttactgagcatcttctatgctgttaggtacagtggaaccactctataatgtagataagacttgggtgaaacagggaacacgacattatatgtagcagcattatgtgtgacataataaagacttaagttgtaccaaacatacatttagaaaataagacaggccaggcacagtggctcatgcctgtaatcccagcactttgggaggccaaggcaggcagatcacctgaggtcaggagtttgagaccaggctgaccaacatggagaaaccccatctctactaaaaatacaaaaaatcagctgggcgtggtggtgcatgcctgtaatcccagctactcaggaggctgaggcaggagaatcacttgaacccgggaggcggaggttgcggtgagctgagatcgcaccattgcactccagcctgggcaacaagagtgaaactcagtctcaaaaagaaaaaagaaaagaaaatgagacttacagtgtacaaacttgatgattcaaacagtatgtgaaaaggatgcttgcataagagaaagatcactgtgaatggatgagcaaatactcagaaatagaaggcatgggtgagggtgaagaagtggggaagaggacaaataaaaaattgcaggaatacataattagaagtcatttgataccctcattttatgtatttccctcactttatattcatgcatacttctgtatagtgataataacatcagtaataataatagcttacacttaggtagctttatgtgccaatcactcttcttacatatattaacttttaaatcctcacaacactatgacataggtaatattattattctcattttagagataaagaaactgaagcaagagaagctaagtgacttacccaagttcacaaagctcataagtgtcaatcagaactcaaaattaagtgatctgccttcagagactaaattcttaattgctgtgcctctcattatacccatattatttatgcatctcccccaatctagattatgactttcacagtggcaagatttattctgctcactctatatatccagtacctcacacagtgccagatgaatgaattagttcacgaaagctgcattccaaaagtgtcttgttctctaattataagcacagcatttaacttttcgtattaagaatcttgcttgtgtttcaaggtatagacagcccaaaattacccaaatacagccagctaagctactcaaatatgaaaaagaaaatatatcagaatgaaatagccctgtatatgtgaataatctcacttaatctgtaatcgaaagcgtaaaatatagaaaagataattaggaaaaagacagggaggtttttgtaacatcattagtcatttagaaaaaccaagtatgggcacattaagcagcaatgtgcttgtaggagacttgaaaagtcatcttgatccaacctccccattgaccagtgaggagactgagacctggaaaagtgaagtgtcatgctcaaggaaatactgttttttaggggcagataattaataggttcaatagataccttcatccaaaccatgaaagattttcaaccacattttgataggattttatccataagaattataaaaggggtctggaaacttggagcttatattaaattaaccatttttcagaaattctttattttttttttcttgagatgaagtctcaccctgtcccccaggctggagtgcagtggcgattgcagctcaccgcaacctctgtcccctgggttcaagcgattctcctgcctcagcctccagagtagctgggattacaggcgtgcaccaccacgcccggctaatttttgtatttttagtagagatggggggttgcgccatgttggccatgctggtctcgaactcctggcctcaagtgatccaccctccttggcctcccaaagtgctgggattacaggtgtgagccaccacgctcagcccagaaattctaattactaaaaattttattatgtttttaagatagaagttcctaaaactttaaccaactattcagtcttcctggcttactatcattttaaaaatcaaatataaaaattgacactattgctatgattaactgaagttttaaaatgaaaaaatcttactcaaatacttgggatcagaaagtcaatctaaataaccattcttatctctagaacatttttttctgcccaagctattccagttcttggtaattgtctttactcggaataaaacacatacacattgcatgatccaactcaattggctatgctcatgcgatggtagtaatggtagtggtggtgactggaaggaggctaacattaactgagcattcccatgtggcacgtactgaagcacattacgggattcatttaatcttcacacaaccccaggaggtatacgtattactactattatttattattactctcttcattttacagatgaggaaaccaaaggtaaaaatatctttaacccaaggtctcagagttggcacatagtaaaaggcaatttaatgaggacatcagcttctagtttctgctaatagcagactaagttatttagatcaactcttctgtttaaatatgctagctaagtttttttttttttttaaaccatctcaaatgcaccgaagagctaaaaagacagtgggctactcccaggacaatttttgaatgaaatcctaccacagagaggaaagtagaatgggagccccatcactgcttattcctgagggcatttgcctgaatcacagtcaggcaagaggggcagcagccaagcttcagggcccacctaagtcagaaggtctcagaggagattttctgttccctgctagaagcctaaatggctaacctcagtgtaagagtaaactagatctaaaactgctcctcttcccccagtcccgggaaactgaagaggaggcatctggaactaagcagagaagcagaagaaataggaaaagtggaacaaactatgaccatagcctagccctagtatagatttacaccctgggtatatgcatacgtgtcctaggttggacaaggcacatcatgctgagaagtggtttgaggtggtctccaccttaggcctcagagaacctctccaaaatttttctttcaaggggaaaaactagcaagcaaagagaaccaggcacacaagaaaacaaagccacctgaacaagatcagcaggaacagcaggcagcagaatcagatgcatacagacttaagatcacacattttttaagtgacatagtagatttttaaagtcctaaacaaaacttctagattaaaatttaaaactcactgtatttgacagcatattggacacagcagaagagagaattggtgaactggaagacagatctgaattcaagcagtctaactccagagccctgtttaaccagtgttctgtctgcctacacagggatcttgccaatgtaaaaaaaaaaaaaaaaaaatcctcatcacttgtgatacatattttgactatacactagcctgaagttttcttgcctactttgttaattttctaggtagcctgagtctgaacagaaattccttttttggaagagataagggatataccttggtatcttcctgcttttgacaaatatcgttgtaaacagacggttctggagttagttaactaaatgtggattcttgtcaaggctgagtcacagagggcatctggagggagtatagtgtgggtgccagaaggactgccctttaagatcttccataaattctacttattagatcatcactactctttactgttcttattaagaacaggtcagggttttttgtttcattttgtttgcttgtcatttaacctcactacaaagatgttttagacaagagtcatgtttttcctattatttagcttttcacactgatgacagctgtcatgtgagagagtaacctcagttttagctttttaactgctaaatatccatcatagatattctgtcaacaacatggtacctggtagttggttttgttttgttttgtttttcaggggagaggacagggcaggccaccttggcttcaagtgtgagaacagctttgaattgtgcagccttgggccatcaaatcctggctccataaattcagaatgttttgctgctcatcttgtgtctaaatcacttccaggggcctgagcacatttcccaatccctatccaccttaagagttgtttaggatagacacgtggagcttgctgttggcttttgctgaaaatttttgctcaaacactgcatcacagcagtaatcttgtttcattagcttattgcaagaataatttccccaacaagaggtcatcagaatctgacccttaaaagagttctcttatttgccatctagtatctgtgaacattatcactttttctattttttcttcttaaatttaatttaatttttctatgctttattatcagcttacagcttgcatttgttttgatagttcagtgggcaaatgtaataagtgtgtttaacctcctttttgatcctgcccaaatattttgtatgtgggttccacttttgtgtgtgtgcgtgttttttctgtattctgggtgaaatacttggtacctgttaatcagtagaatgaagaaatggagagaggaaggaaaaaaggacagggggcagggcagcatttagttatttctttaataattctagaggattttaggattttcatgtttgttagaagttcttgacagacatgaatagcaatgtatgaggaagttatataagaactctctaaggaacttatttgttcatgcagtaaacatgtattacattccttcagtcagcatgcattgactgcatacctgttatgtgtcaggtaaggtattaggtatgtttgcctagtactctctttgcctcttaggaaaaatagactagaaaacagatgattttacaacacagtgtgataaataataagatatgaacagcattttaatgaagtacagaagcaggaatttataattctgctgtaggagtagagaaaggtttcaccctcaaacaggatctgtgtgagacatggtcattaagcagagaagaggaaggcagggagatctaaaaggtcattgtctctccagggaacatggaaatatttagtgactggagctaagtgtaccaaagaatcacccagagaaattattttttaagtgaggatctctagccccacccctagagattcttattctggaggttcatttgtattaacagtgagcacctcaggcagttctgcgatggctgctccaaaaactgcacattgagaaatactgaccagctcaaggctgtgcttggctcttctgacttctagttgtggggtcagtttgactcactggaaagaactctaattttgcagtcagacataactggctttgaatcctggctccgctcctggacagtgcatttaatgctaacccatagctctagactttgaacaagtcacttactaagcctcagtttttacatttgtaaactgagggcaataatacctacttttgcaaaatcattatgaagtagaagacccaaagtacctagcccagtgtctgacactagtaagtggtcattaaatgatagctattactatccttcttttatagtggatacagcactcataatggttagtaatgtaaactactctgtgcctcattttcctcatctgttaaatggtgatgataaaatagtaccaatattacatggatgtttatgaatctgaaatgagatatgcatgaaaaacactaaaacaaggcctggtgtatagaaattctttaataaatgcacacataattgtgttgttgatgatagtaatgatggtgacaataatgttattcctgtagccggctagccagttccatatgaatacatcctggtatctattgaattggatattggggtgtaagttatgatctcagccttgccatgattagcctgtaacctttagcaatcattccacctttgtgagacctccgtttctcttattcatttgttcacgtgttcattccaaagccatctatgaagtactgtactgaatgctaaatcctagagggatagatagatcaggaagcatccactcagtatgaaattattccttttgaagttgagagtgtttatgtagcctcttttagaccgggtatttgctatacatcttgagtggaggaccaagagtcccaaatggacctttcagactgttccttggttcatatacaaagaaactctgatcaatggaatgaaatgttgaacagcagatgaatctgggtaaaggaaataggaatgtgtattgctctgatctcattttttcaaatttcctataagtttgaaattattttcaaataaaaaattaaaagaaaccctcctgttccagaccaatctatcaaaatgcaaataagtgataatatcatataatgttgtgtaatttgttactccacaacaaagaccactggatttggagggagaggatctgggttcaagtctcagctcattcactacttaggacctggcctaaattacctcactactctgagcctccattttcttcatctgtgaaatgacttccaaagtcttcctcacagggacttggtgaggattcagtaagaatatatctatatataatttctatagatcatctatatactgtatgcacaaatacatatatacacacatgtaaaattgttttgtcatccgtaaaatactatgcagatgttggtggctcctcaccttagctgagcttattttggtgtatgtgttttcctgagtagcatccgtccactcacaggctcccttctgatttcttgcagcctgaaaggatttcaggggagcagtatggaattcattctgatgtctggagcttaggaatctcttttatggaggtacgttgtttgcacatagacgcttctgtgcatatctgtactaatatattcaatcaggaaaagtgaagattttgaaagaataagctaaaataaaccttcagcatgttatatagatgtatacagagtttgaccataaagtctttgattccttgtgtggcttgtgaactgactctggaggttattttaaagcactgtttattacagatcacctgtgtaagacctgcctggagcgcttgttaaaaatacagattcttcaaccccgttcaagaccaattaaatccacacctctaagaatctgcattgttaacctgttccctgggtgattcttatacatactaaatctggagaacccgtgatgtaaaatagggactccagaaaaattctgtgccctgttggaatgcatatgtaacttccaacggtgattagtttaaaagatacagcactactcatttagatatataagttatatatgtttgttttaaaagaaaaaaaaatcacctcattccagtatagtcttatcacatgtgtatgtgggttaaggggtggtgtgatatgatggagagggaagggggaagaggatgtatgtatttagcacaattgcaatatcaactctttatagctgtatttagaatggactttatgttagtgttctagatgtagctccattagaactctatgctatgttttttttaataaaatgatgattgatctacaaaaaaatgcatgtaacttatattagaaggacatatggctcagtttgaattatggtagtatagaacctgtatactgaccagtgcttcaaaaattctcatttaaattgattcagataaagaaggacttgtattttctttattttttcttaatagagatagggtcttgccatattgcctgggctggtcttgaactcttgggctcaagcagtcctcctgcctggacttcccaaagtgctgggattgtaggcaggagccactgtgcctggccaggactttttataatagaaaagtagaaaggactctttaaataatatcatagatagagttgcaatcatgattttgtaacctttttttttagtcaaatactttttctgtgagttttgtaatgcatgaatgcaattgtatttgtaaggaaataatcttcaaactcaattcacctgcacagtagaaagaaagcaaaaataaagtgttgaacgtttattaaatcatattcttctgcttcttcttaaaagggaatctaagaggaaatacaatatgtatgcatcagctgagaggttagcgataatggtggtcagatctcagaactgagtctcccaacagaatccacaagggcttattctattagcctgtttcaggggaaactagtgtttttgatttgtgggactcagtattgctgttatacaatttccttttgcatattttaaattgttatcatttattttataaatgactggatatagtgtaagacaattgagaagttacatggtgtagagataagaatcctagattgggaatggaagacctggattacagttccaggtttgctactagttttttaggtgaccctgtggaagccactgttcttcactgggcctcagtttcttcatttgtaaaatattgatctctaagcccctttccagactaacattctatgactgtgctactgctcatggtgttgttttctttccttagctttcacacagcaactctagagttgtgtgactgagacagtgataaaatgacataaaatgcagaggcatggcactactataagagagcataactattagatttaagatttagagcacatataaatgttcactattcatcctttctacattcatttatgcattcatgtgttgaactcctgctatgcctgctgtataggcaatggggatagagtaaggaaaagacactcaagtcttggctgtcatggagttccatttggcaagggctggggcatgaggggaaggacagagaacaaagggataactaaatatgtaatttgtcaggtggggataagtcccatggaggaaaaaaaaagcagactaggctgggctcagtggctcatgcccataatcccaacactttgggaggctgaggtgggcagatcacctgaagtcgggagttcgagacaagcctgaccaacatggagaaaccctgtctcaactaaaaatacaaacaattagctgggtgtggtggtgtacacctgtaatcccagctactcgggaggctgaggcaggagaatcacttgaacccaggaggcggaggttgtggtgagccaagatcgtgccattgtgctccagcctgtgtaacaagagcgaaactccatctcaaaaaaaaaaagaaagaaagcagactagactagtcctctctggtaaagtaccacttgagcagatacttgaatgctgtgagagaaggaagccacctgataacaagctcaaaggcaccaagatagagtacactctcagcgtatttaaggaagagagagaccagtgtgacttgactggagttaacaaggggaaaagtgggaaaaaataaatttagagaggtagccaggggccagggcaaatatagccttgtaggccatgctaaggactttaggtattactcttagaagaaatgatctgacttaaattttcacagtatcactgagtgctctgtggagcatgactatagacaggcaggtgtggaaacagggagatccgtttaagtaggtaggaggacaggtgctcaataaatatatttatgttgcatattgaaatatgtgtctgtctgccagtattttgctgggtgctaggggtacaaagattaataaaaagagactctttgtagtgtaaggaaggagattgccattgatatatttgggttctgttgatgatattcatttatcctggagataaactattgaatattctgtggaggactgaagaaaacagactcattgaattttcaggatcgaagaggattaggtatagagaactctgtgaaaaagtgtcagcattgagtgtgggacacctgaatgctgtaaggactgtgttggctcgtgtggtagagagcagataaccagatggtcaggagtgagggccaggaagagctaggccttttgatgctccttgtattttaaaatggatggtaaggagccgggtgttacagcaggaggaagagatgttgttagaggttgtaaagaggaatcagattatgatcatcagagagggttgttgagcacctctgtacatgatgcttaactaaatgccttcagaaggaactataggattgtagcccctgacctctaggggcttattacccccacacaacatgttaccaacacaagtaatagaccagtaagtcattagagaatagtgtaaggcccctggcatgttttatatacctaatctatttggggtccagggtaaagaaaaatatgtgatagggaagagaagtaggaggttatgagtccatacatgagaaattgtggggattcagtagtgaaggttacaagagaaacccaaggttcttgtgttttctttttgagacggagtcttgctctgtcgcccaggctgcagtgcagtggcacaatctcggctcactgcaacctccgcctcccaggttcaagtgattctcctgcctcagcctcccgagtagctgggactacaagcgcgtgccaccatgcccggataattttttgtatttttagtagagacagggtttcaccatgttagccaggatggcctcgatctcctgaccttgtgatctgcccgtcttggcctcccaaagtgctgggattacaggcgtgagccaccatgaccagctggttcttgttttttcttaagggtcaatataatgagaacattacctgaagggattaggaagttagtccaaaagaagtacttgaagaccaagattcttatttgtttttaccgtagtatgttaggaatagatgtagcaaatccaatttaaaatcactatagacagaagtgtgaatctcaatagcattttagaatctgaggaacaaagtgcattctgtaacatagtcaacactttctaagaattactcctcttctgtttattctcacttgtaaaaacaaaattctctttctagtagaaactttcctttcttcaataattcttacttaagcacttgccctgtgccaggccctggagagtggggcacacagagctgaggagagcccacctctggtagaaaagaaagatacccaaagcccagaatggtgtgatgagtcttcagtagagatgtttacaaaggactctgagccacaaggggaagggggtggggtttcacacaaaggaattgacatttaagggagattggtcttgaacagactttgccactaggagaaagagggaaaagatagaggatctcttccccatttcccagcacactctaaggtatggatccctgtaaacacttaaggagagatcaaatgtcaaagtatgcaaggtctcccctggtgtagtttcactacttttttgtgtgcatgccttcttcaaagtattttaagttaaccagtttattctcctagggtacctgtggtaaagaaaaaaaaactgataaaaatgtaggaaaccgagcaaaggaatttccctgaaattacacaggaatcaaatacaggctaggcctggcggctcattcctgtaataccagcactttgagaggctgaggcaggaggattgcttgaggccaggagttcaacactagtctgggcaacatagcaagactccatctctaaaaaaacaattttttttttcatttagccaggaatggtggtgtgtgcctatagtccttgctatgtggcaggctgaggcaggaaaattgctagagcctaggagtttgaggctgcagtgagctatgattgcaccaccacactccagcctagtcaacagagcaagatgctgtcttaaaaaaaaaaaaaatcagatagagacaaaatgggcatgagagttttctgtctcctttacatctccctagcaccctttcctccagttccataaactgtcatctctgaggtttggtgatgccagaagcagaaagttcaatttacagctgtcagacttgaagcctgccccctgcctcccactttttttttctagagacgtggtcttgatatgttgcccagtgttgcctcgaattcctggggtcaagtgatcctcctgcctcagcctcttgagtagctaggactacaggtgtaccactgcacctggctgaacgccttcattgttttaaacccctgaagtgacagggttcctccttgcctgccttcttcctcctgcccattgccttgttaatatgctgtcacagcccccatggggagtcataaaaaggcctcttgccacactctttcataaaagatgatgctacatgctgctaaaatgtgccattaaaaaaaaaaactcactgacaggtacatttatgccttaagcaaagaaactttaatatcagactatcttttatccagggacagaatcgcttctctctcctttcagtacagtatccctctgttggtggggtaaaggacatctcttccaggtttttgtcaactgaatgtagtatttggagttggcagatgtaacaaaaagatggaagttatccttaggaagggaaaaaaagattattcaccttgactgatgtatggcagtttgacttgatgggaagaatttggcctgtttctccattgtttgtttgtggtttttaactcacatctttaaatgtgttgtagttcccctcctgtggattagttatggaatcattaaaggtcattgccacatatgggatttgtgtgggctcactctgtattggggaagagaacccgtgtggaactgtagttctttctccttgaaactttgttagcaagaatcaatgtggaaatgcaaaaagaaaataaaaaagaagtgagacccactaacaaggttgtaaaattcctgaactaggacaaactaggagggtaatccttccctggaatatttgtttacctcttctagaaagctcatactgattcagttgcctaggagatttttaggattattaaccttgtagtctctgttcaagacttcagggcaaaaaaaaaaaaaaaaactacagggctaaactttaaaatgaaaatgagtttgttatataataagggctttaccaagtttgatagttttattaggggtggctaaaacattttagagcataatttctgaatttcacaggcagttcagtgcttatctcttctaaagaatggcttaaggagaaagtcccactctcattttttactaagtaattattccatttatattcttgtgtcatttgagttcacaacataaatctgtagttgggaagtaaacagtcatatctgcaaaagtgaattttaagtgggtccttcttgagtcaaaaaataagtcaacatacattctccgctagccttgcaatttgcagtatttaggatgatgcatctacattaaaaaggcaccaagccagtcctgtaatattcttattttcactgagtatgctgtacaaatacatgttctggtttgggattctatgtggtgggttattataaactttattaaggttgatggtgaataatctgacagacttttctataggagtcagactgaaagcctgccccccacccttttttagaggcagagtcttgctaggttgcccaggcttgccttgaattcctgggttcaagcgatcctccctcctcagcctcctgagtagctaggactacaggtgcaccaccgcacccatctgaaagccccatctttagcatatgcatagcatacgcattttgctcttttcacttggatcttcattctttctgcctgtttgccacccctctaaccagtctcctgagtctgaggcatagaacagtctggctcaatgtgcttggttaattggtgcgtcatctagtcctcggagacccctcttcatcatgaccagtgttttattgaagtggtttgaatgatgtgctgaatgatgaaagcaaggaccatggcttagaaaaatgtctcaacataggtaaagaacatagtcagagaacaacacaaggtcattgtcactgtcatccaagtaacatcatcttctgaagttttttttttttttttttttttttgagatagagtctcgctctgtcacccaggctggagtgcagtggcacagtcttaactcattgcaacctccgcctcccaggttcaagcaattctcctgtcttagcctcctgagtagctgggatcacaggcatgcgccaccacgcccggctgatttttgtatttttagtagagatggggtttcaccatgttggccaggctggtcttgaactcctgacctcaggtgatccacccgccttggcctcccaaagtgctgggattacaggcatgagccacggcacctggccatcttctgaagattttttgggctctattattttgacaaaaagaattgtgagttttagaattacctttaccaagttaaaaataaacccatggaataataaatacgctgttctctgtacatgtaatatcatttttcttcatctccccaagatacagtttaaataaccatccttcatgataccaactctgatatctccagctgaaggtaatatcttcttcttctgaccttcacctgcatcttccttgtggcatgtaaattgtccactttgtattacagtaatttataggcatgtcatagttccttatgacaggattcaaatatgattctctcataatcttctatgctgtttagtacaattccattgccctagtgggtactcagtaaatctttttgactcaaatttttcctacttttgtaatggtttttttaaagcagtttcagaaaataaagatcagagtttaaagtgtgatggagtctttaatataaatgcccgtaagtgtttggagaatagatcacagtgttgtgcttgtgaagaagagctttcagtttaccaaggtatcagatccagatttgaattccacttcagccagcctaagctatagaaccttcggtaaattacttaacttctctgagcctcagtttcctcctctttagatgggagatctatttcagagcttttggacaaagttcacaagggaaaaaagccattatcccctctctttaaaaggaattaccgtttgaaatgtttacatttgaatcagactgctaatttggttaaagatggtgcaagctttagcttacagtttcacctcaacctccactaaaaatagccataacgtgatttacacacgcacacacaggcgtgcacgcacacacacacacaaaaggataataccataaagagaaagggaaaagagacaacagcactcaagttttgaatatgagacaacagtaaacaactgagcagggctgagaatacaagcaagcaggcaatctgatatattgtaaacacccaaagggtcaggaattggtgggacgagatatgtggagccaggagtcaaggtgggaccaagagaggagaattgctttaaagtcagtttgacaattatgataagactagttaatctttcatttattacaaactaatatgaattgctcatgaaaacccaatagaaaacaattgttaatgtactggagtaaacaccatgggtggacactcaatctaacaaaactgagtggagcgttttctggagcaaataaaataagtgatacctggcaccatagaagtctgggtcccattactacgttcagaggcattaagtgaaggtttagattctgaatgttgagacctcccaccctgttcctaggacactcgtgattactttacactcaaagattacttttcaggcaggagatagcagagactttctctagggaaatctgactaggaagacttaaagatccagacgtttggagttcccccaaggaaacagcctagctaaatcatgctcccaggagagcccttagtctacaagccccatccatgagcacagtttccagtgagattttcagtgccttactcttacagagacatttgagaaaggcctttagggtcagaacagaggcctacaacaactaaaaagaaaagcaatttggatggccagaaaactgtgcagagggtaaaaagttcaaataaactaccagttgtatcctcagaggactaaagagaaaatagtgcactcagaatataagaacaggctgctgtaacaaaaggaactttcagagaacagcaagaaataggagagaaatgaaaaaagaaccaagtcggccaggtgcagtggctcaagcctgtaatcccaacactttaggaggccgaggcaggcggatcacgaggtcaggagatcaagaccatcctggttaacatggtgaaactccatctctactaaaaatacaaaaaattagctgggtgtggtggcaggtgtctgtagtcccagctactcaggaggctgaggcaggagaatggtgtgaatctgggaggcagagcttgcagtgagctgagatcatgccattgcactccgcctgggcgacagagcaggctgtctcaaaaaaaaaaaaagaaccaagtcatgaagttcatgacaacttctcattaaagaaccaagtcaagaagtaacatgaaaaatagaagttccaggaagaaagaacagagaaaacaaaggggaagaaatcatcaaagaaaaattttaaattttaatgttataacatgggaaaaatatatgtttgtacaagattgcccttctcttagtattcctatagaaaaaaaatcattttttttccccaaatgacatatggcagtgttttttctcagaaaaagtgagtttttgttgaggattagtaatagaaattttcccaaggaaaatttactataaaaaatacaaataattggatataactaccttttgtctcattggaatgtacaagcttaacacatctaatttttacatacacatattgtttaatggatgccagataagactcattagatatcaagaaaatgaattgtgatcttctatacgtataagtaaacacataaaccatgtagagctgtgtaaatgtaaataaaagtatttaaaaggtggcatgggccatgtgtggtagctcacacctgtaatcccagcactttggaaggccgaggcgggttgatcacctgaggtcgggagtttgagaccagcctggccaacatggcaaaaccccgtctctactaaaaatacaaaaattagctgggcatggtggcaggcgcctgtaatcccagttacttgggaggctgaggcaggacaattgcttgaacccaggaggcagaggttgcagtgagccgagatcacgccactgcactccagcctgggtgacagagtgagactccgtctcaaaaaaaaaaaaaagtggcatggatcacccagcccagtacccttgacagaagcttctggagaaatttgatggcgagtttgtcattttgtcattttctttccaatatcatttttagattcaagggctgttatcctaatttttgaactgttaaagagcttagactggattaaccagaattcagttcacatattggcaccaacacttataatcagtgtgatcttagccagttcagtttgtcactccaagtgtcagtttcttatgtataagttgaaggtaacattagaattcattcattccttaaatatttattgaacaccttttacatgtcaaacacgttattaagtgctgggatacattggcaaacaaaataggcatattccctttccttgttgagcctacaatgtattaagggaggcagaagataaacaataataaacacttatgttttttgaaaggaagattagaaatatattcaatattctaggctttttcatgaacacttttatttaacattagcaaccacataaagttacttgaagaagtaagccttttgaaatagcatcttatatgtattgagtgcttaccaagtaataagaattatgaaacattatctagccttggctcttgcctctaaatatacagaactcattttccccccacccctacccagctgccaggaaaaaaaaaaaaaaaaaaaccaccaccctgacacagctgtttctaatgggtgtgtggttgtggctttgtttgcttttctagcccttggtgattgtgaactggtccgaggggtgacggatggctctgtatgctctgtaagcagctgccgtcaacttttccacaccataaaaatttgccatttggtgtgtttcactcaaatactgatattttctcttcttctttttaaatatttagtttcaagaatgtgagtgaaatcttactacatgttgaatattcctaacctgaaagcccaaaatttgaagtactcccaaattcgaaattttttgagcactaacttgaacctcaaaggtcacactaatgggagcatttaggatttcaggtttttggattggggatgctggtaagtataatgcaaacatttcaaaatccgaaaaaggccaatatctgaaatatttctggtcccaggtagttcagataaagtatacactcaacgtggatcatgttcagtctcctgatccaactagtgaaacattttacctgttgaccaaagtttttgctgaggaccatcaaaaggtgaaaggatctgaagggcccaaagacaaaggaaatttccatggaagattttataggaaagtggggaggatgtaattctggaatccttgtcatgggtcctcccctcccactgaaggatgctgaggaaaagaacatgtaacagtttctgtcactcattcccctgctcttactcccttttctgtaattctgtcttgatttttttccactgtcttttttttgggcggggagggggggggtctaaaattgtgtgtaacttaatgcaaaaggagctgttaaaatgacctttggcagatgatggattgactagttcagtcctttgcaaggtctgtgaagggatccagctgtctcatattaccatgcctaaatgtgcattttccaaggttgtcagtgattgtagtgaatgtgaaactggcagacaaagtgaagtgtttcccactgaataaagcattgttgagtttgctttgtgttcagagctgtcgggaacaaccatgagattgacaaaacaagatggaacaggtgctagcagtcccagctaagcattttgttattttgatggatttcagactgattttaaagtttttccaacagcacatactcatatcatgtatacacacaaatacacagaatttgaaatttaaaaaaaagcaaagtcttgatatgaagaataaagaaagacaaagcaggcatttgacaacccattttcagatgtttgaaggattgtcagtggagaagcagcaagctgatcttttatgacaagaaggctgaacctcctgaagctaaaacaaaagccaaaaaaataataaactcccatgactttctattcagtataaagaaggattttctgatggatagaactctacactttcctcctcaacagtgaaatcatttgcctttagaggtaaaaatgtcccatccctggggacacataagtagggactgaaggactgtttgtctcagatttttttctgtagaagacacagatataaggttagacaagatgcagtcatatattcatttggtcactcagcaaatatttttttgagtgcctagtatgtggcaggccctgtgctagtcactggggacactgctgagaacaaaactgacaaaatccctgctttaatggagcctacattttaaaaaagaatacttgatcattgtacctttttagacaaataagcgagttaagctgcacatggtgacgcacaccagtagtcccagctactcgggaggctgaggcaggaggatcccttgagcccaggagtttgaggctgcagtaagctatgatcatgccattgcactccagcaaccgagcaagactctgactctaaaaataaaaaagaaaataaataaacaaacaggatgatatgctaggagtaactgagtggtattggattacttttgagttgagatctgaaagataagaaggaaccagtcttctggtgacatgtctcaacactaaaattctgagtctatgataattttgggaaccatgtctgccaactttgagatatccagtggtaaaaaccactgctcctagaaaattctcttatatgccttatgttgtatttagaaactagaattttttttaacctaaagggagactttaacttaaagagagacttcagagcttgttaaatcagaccacttctcttagcagtgaggaagctggtctccagggaactgtgcagaagaggactggaatctgggtcttctgatgtgaaatgtagtgctctttcctctcttccaagctcttgacatcctcttgctcagtgtcattctaacaagaagggtgacaacatcacacttttttttaatgtaacacttaacaaagctatttggtattcattatctctttcaagcttctccccactctgaaaaatcagcaacttgaggcaccaaatattgtttcactttataagcatcaaagttcccattttgcaaatgaggaaacttagatccagataagttaaaggacttttctagaaaggttaagtgaatagctcaggcagcagcagtcaagtattctgactcatggattcaagtctgcttcttccattatgctttaggaaagtagatcaagtagtttgaaaaaagaagagatgaatggtaaatggaactgagcaggaaatcagataaaggaaaagacaggttaactgtgactctgctggtcagttaagactgcttttcataggattataccttacactatccctgtagctggtttagtgtcaccatatttcaaaatgtgctagttacctttcagaaactaaggcctagtttatttattaaaaagaaacacaaatattaacctaatctccagtatgtctactgtaataggaagtaggtaggtaaggatctcatctaattagtaaatatttatcaagtactacccagtgttggcagtaagggtacatactttgccctcagtgactccttgactaataggtagaaagaaaagtaaaagtgcaatggaaacatgtagaactgggcacatgagagtgtgggctgacatgagtgtcagagaaagcatttcagttattgattactgcttaataacctacccaaaattagtggcttaaaataaccatttatttactcaggattctgtgggtcaggaatcctagcaaggcccagccattctatgtagcatcaaaagcctctcatgaggttgcagttgggtagtggttaaggatggaagatccaagatgacttcatatgcgtgtatgatgctttggtggggatggccaggagtggctgggaccctcctctcccatctccccttcatggctagcttagacttcctttgtggtgcctggtgttctaagctgtgattgcaaaagctacagatctgttaaggcccaacctcagaaattacacaggattgttcctgccacattctgttgatcacagtgtaggttcttgatgatgaaacaacagggtcacattccaaaagagcatcttgggctgtagattcttttaaggccatcactggaagcacggcacatttcagaaagcttcctagaagtgctggtatctaagttaagttttgatgaatgggttagatttggagggcagtgttccaacaggagcagcagcatgtacagaggccagaagtatgagaatatcagctgtttatgactcccttgactttgaaatgtctagaaatagaaatgtgagtgaagttgagctcaatagactagaccccagccctgatgttttctcaaatacccacagctgcatgatttcagagaatggtttagaactggaagcccccaaagctaggtctctaagagaccattgtcatgattaggggtgcctgctgtcagaggacacaggtcagcgttacacaaactttttaaaagggtgttatttcttaattcttattatgaggattcaaatggctgttgaagtaaacacgtgagatggggtttggggcagttaactctaatcatttttaaaaaatttttatgggggctgggtgcagtgtctcatgcctgtaatcccagcactttgggaggctgaggtgggtggatcacttgaagtcaggagtttgagaccagcctggccaacatgatgaatccccgtctctactaaaaatacaaaaattagccaggcgtggtggtatgcacctgtaatccaagctacttgggaggctgaggcaggagaatcgcttgaacctgagaggtggaggttgcagtgagccgagatcatgctactgcactccagcttgggtgacagagcgagactccatctcaaaaaatattttttatgggtacatagtaagtgtacatgtgtatggggtacatgagatattttgatacaggcatacaatgtgtaataatcacatcagggtaaatggggtattcacctcaagcatttatcatttctttttgttacaaacattccaattatacttttagttatttttaaatgtacagtaaatttttgttgactgtaatcacctgttgtgccatgaattactagaattttattcattctaactttatttttgtacccattaatcatccccactcttctccttgccaactacccttcccagcctctggtaaccatcattctactgtctatctccatgagttcaattcatttaattctaatctttttcttccttggcaaccttttaatctttaataagaaataagtcatctaaattcatcataatggttaaatatgtgaaaatggtagctactgatcagtctaagcagtgatacgtaagagggccttgtcggttaagaccatcagatcctaatactaaagagtttgtgtaccatgttcattaaggtactgtggcatagaaacaagcaaaccaggcacctccaggttgaccagtctccaggagagatcagcatcaggggatatatcataatcaacaaatgcttattgtcaacctactgcaaaatgctatttctgatgtcatggagaacataaaagtttatgatttatactttgcccttaaacaagttaaaatttataaggcactagaaacacaggaagatgtagaacactgggaactgtcaccaggaaggatgtgatacacactgcccagtgaagggtatgggcagagagtggtatgaagtttgtctacaaaattgtgggtagagtcttctaggattaactcctgacagaagaggagaaaaggaggaacaatttgaatcaagtcctgaaagaataggtaggctggaaatctatctactcatctgttgcaacatctcagattccagataggaaaactgccctcagtgttgcattttgagctatgcaaacatttgaagaacattcatttttcaattagaaaagtaaaatggttgctctcattaatcatgactaaactttatgtctctttaactcagagtctctcacgaatttcctctcagtgcacagaataccatggaaaaagacctttgccattgtttttaactgacttttagagatttagttatatacccagatattttcattagtattctgtgagtagagctgttgatggaaatcaacatggaacggttaaagtgtctgtaaagctacaaaagtgggtatttttaaattgagggttttttccccttttttatttatcaattagctgccttatacttactatggcctagttaaaattgtatattccatttaaacacagtatctaaccaaaaagttactcagctagggtttttggtttaatgtagtatagacagattaatatacacatacacaaacataaacacacgcatatatatacacacacatatgcttatatatacataagtatacacatacatacacacacatatgcttatacatacataagtatatacatatatatctatatatatacacacttacacacacacaaggaaaaaaagaaaatgatgtaagtgaaatagcgtatgggagaggaaggagaattatgtgttttgggacagcagggttagaaagaccaagaaacatttaaagattcaaaacaatagcatttagcctgaaatctactttttatcatctttacccagccatcagaatgaagaaagacagtgtccagctgtagcagtagtttggtagcaggagaattagacgtaaaggtactaatgcctgaggggtgggtcatgaattaataattgctatgtggcggatgagccccgtcagaagagctgaaaatgaggaagttgccttgcagagcgctatcaatcactcagtgaccataacttccagtaattagtgtattttatgggcctttgcttcagtggctcgaaagcacatatgctccagtcacagctaaactttgctggagtaatattccaggatgatttatcctcctgctgcactgggatataaccctatattaggtgaagattgtgaactaagctgcaataaagtgtaagtttaggtacagtttgcccaggttgagacctcaatgtatcacgcttttcagcattcatggttaggctatagcaggcaatcatttttaacagtgaaacaaataaagcaattaaaggaacagcattaggatattgtacttgtgaattactgttgccctcttcctgtttaagtgtctactgtaataagcccatttctttttatttttttaaaaacgtactctgttagaaacatttgttcgttttttgttttttttaagttccagggtacatgtgcaggatgtgcaggtttgttaagaagtatttatctgtaatgctgtcttttctcccttattattaataatctgggacagaatgcagaaccttctgaatggtagataagtgcttgatttatttatttgtgctactgtttgggctccttaagtaagtttatatcagtggactttggtgaggacaagtagttgttgttttttgttttggttttaatattggcacccgttaaggcgcactcctgatgggaccctcacatttaggctctttctacacaaagaaaaaacattagttacaagctctcagactacttggcacttttcgtataggcataatgagttatttgctgtggctcacccactgcactagaagtctatgaggtctttgcagacagggtcctttgccattgccaaaacatttgtagagcccagtgttcctaggctcttaacaagctttgccaccaacttacagtatgaccttgagcaaattaattaagctgctggtgcctccattgggccataattctgtttgcgctgaagaaatccttagagtttgtaggaaagagtttgtgaaaataagcataaattgaaataggaaaaaatacgtgtgggttcactatattctcttgagagtaaagtatttcttcatcacttttaatgatggtgtctttgaatttccttaaatagacaccagtgataagctaatttcacaaatgtagatggaagggtgtacacagtttgatgcttttgttacatttattatcccatctttaatttgcagtgtattatgatatcatacaagttaataataataaaacaaactaattgtctttaattaaagtgaattagattttgattttaatatatttgctgtagtgagtactgataatgtggagggtcccaaaggttattagggcatgtttctgttaggcctgatggtgttagtaataatcctcttcctcatagttctagacatgaacaaatatgtcacttcatcagtctctgttactcgcacttatgcccctccacaggggttgcagattccacaagttatcagctaatggcgttatacattaaaaattgaagctttcctcactctgaggcctttcaaggctttgttcttaagccccagacactttggagtgcagctgcaaactataggcagaagattaaattaatttgtaactctttttttttttttttggtcctgcattactaaatcctccacatttaattgaaaccctacttcaagacgctttgtgtttctgtgttctttgttgtcagtttaacctccaaagcactttaacaccggtaaattgctgttatatcctttggattgtttttaaaccattcagtaagagaacagtgaaattgatacatggggaaaaaagtaaaatcttagagtagattttgaggtatttaatatttattatggttcttcaccagcatagtttcagatgatttaaactctttctctaggactgtgtaaattggtcttgggatgaaatctcacctagggaattttatgtaatccagtagttaagtctgattttttaaagtttccctgtgtctgagtgttccaaagtggctgctgcatttctataaaatgaagatttaactgcagcgcacaatctaaatgcaaaatccttagatggaaatttaattgtgtaaaatgtacacaaggtaattaagaacaaattttagaacatttcagactataaagttgtcattcagctagatcactggctatattgaaaatgcttattttcaatttgtagttatgccgagaaacatagaatatgtctaaattaagaataaaaaaatccagtgctcttcagtagaactgtaaatttaaaactactcccacaacatagttgatattctgagtaggagacttgattactaaaaacatgtcttgaatttgtgtcctgcacttgttttctggctacaatgtttgttttctctttatcatttatgattctatgacaataattatttttattatcaacaaaagccattctgttgctttgtcaataaataacttctttttgttaaaatacaaagatttttatcgtgttatatatttggcaattgttatgatctctctttcacgcacaggcacacatacaaatatatttgttatttaaattataaaatccaacatattcaaatgctgctaactgaagagcattttatagattgtggttggccaagtcaaaggtcaataagatgacactaaggaacgtcctatttttagagtgagatgttagttgtttactgctatttaagtgtatccccaactggtaacacttcagaccattctttttcagccttttacataataaacgtcccgcaagagagtcttcagcagtttgctaaatcttaagtatttggaattaaagtgtactttttaatttaacattaaatagaatcccttatctctacctccaccccctggccccaaataaataaagcttttccaaatcttttacgatgtgagctgctcccctcctgggaatgaaaaggatatgagacccatttgatgaattgctggcacttatatgtgtctacatttttcagtacactttttaaaaaaaaaaactagacttaagctgcctatattacatgcttcttttgtaaagatgataaagagagcaaagatttctattggcataggcctaatctatttgctttgttgtgattctttttttttctttcctttaactgttaacctatttataaatctaaatctacatacaaaggtcattggttggctgaacttaaaccattttactcagtaaatttaattaagaaaatacagtgcaactcataagcaaatgatttttttcctagttttaaaccaaaccaccctcttgagtgctgattgccttgcccgacccctagtgatacagaaacaggcaaaattaaaaaggacattaaagcttcattaaatctgaaacacatttagtacagtgacatatctgcaggccatttcagagaagattacatactctcttttgtaagtttcctaatttataataccttgacaataaaaactagggaaatgcaagtagattaatagaccagtaggggtaaaagatacagaatggccccaggtctgcctgtgtgtgaaatattcacttggagcatatgtgctccttcttccccataagggtcccatgtttattttgacttttgacagcctcgtggagaactcgttcttttttatttatttatttatttattttttgagttagggtctcactcttgctcagtctggaatgcaatggcatggtcaaggctcactgcagtctctacctccccgggctcaggtgatcctcccacactagcctcccaagcagctgtgactacagacacgtgccaccacacgcctctcatttttgtagagaactcgttcttcatgcagccatatctactaagaaaccattttctgttttacctcctcccaatagaacttgataaaaagagttctagagcctggctatatgtttccttctacttttctataagacaaatagtgtggaacataaacactgtagctgcattagacctagagggatagaggcatacatagaaggcagcggtcctctcctggggccttaaaatgactgctttcagtgccagcctaatagtgcacttgccagttttcactggcatagattcccaagtctttcaacagcccagtggtgacactctgtaagagaggaagtgattgtcatcatgctgcaattgcagcggtacctactagttaagatcaaagaaccattctctgtcttctaactctaaagaggtcagacctgcaagatgtcttacaagcagtcctcccaggaacatagttaaaaggtaggactgaggttccacaagatgtcaggaaataacactgaaagcaaagccagacccatgaatgatgagttcaccagttcaagcactggcacctgttcccaagcagactggtacagagaggctcccagctgaccaaactgcactaaattttctctctgttgtcttgcatggcattgtcttacagagcaaacaaataacatcagccatccttttttaccttgtacagtcatgacagagagggccaagtagatgaatgcacattcccaagttggctggagcctggcctctctgtagaaccatgaccacttgcaaccggaagctttgtgttgaatcgggaagaattcacattttttgctgtatctcactccgttttaagccgtccatttaccattgcttaattctttaaattgcaagaaccaatggtcagtgttggcacctgccagctagtttagatcttgactatatgtgtggtgggcaagtttcctctgtctttaagccatgtgaacagaattattccatggtccctgatgacatgctgagcatatacccaagtgaatggcgcaatgcctgtggaaggtcttgagctagaatgttctaagtgctttgtagtagttattaagctattagcttttttaggtgtgagactctcctcttgctggttttctaactccaaatggaagtatatgcaaaagtcataatccacagatcactgtgatacctgttaagacactgcagactgttgcaaatgcctagttcacccaccacagtagaccatagtaattcctcctgaatcagtgtgcacactctgattggccagaaacaaactattttcaaaatgtagggcaaacctacgaacctgtattgaaaggaggtggggtggggacagaggatgggagaactgagtctctcccttttccctccccgtacatagacaacaaacataatcacacaaaacttcgaaagggagtttggcaaacatctacactctctttctttcaccccatcttgtgatgtttttgttatgtacagtggaagagattaatgatatccatcaaatgaaatgatgatagtatacctatatcttgaaaatccatacacatatcagtgtatattttgtgtacaagatatgagtacaaggtaatgaaactaggtattctaagacatacatatatacacatacacacaagcatatgtgcaaatgagtgtgggccttttcaaagtagtcactttacgaggtcataatgtttattcctgttacatggctattgttcatattggttttagaactttgataacttcagcatattcatgtctaagcaacaaaatatttagtttttgtatgtggctttgggttttggtaatatccataggctattcaaaccttagtctacaaataatttacatgatgaacaagctgaggggtataattttaaatccaagataaggtgcatactaataaaatgaaataggtattctgttaattgaaataattctaaaacaattacaaaaggagaattcagaaatgtttgagcagtgtcagtgtctttgaaataagcgcagaacttctcaagatctagaaaggcagtttcatatgcaggaaggaacactggattaagttgcaaatcttagggtcagttcctaggcttccacttattaactgtttgggagctacttcagtgggactctgggttttaatctttgaagtgggttgatgctctcttagatccattagcgttaaagtccctgatgttgcgattctgctttgaaagtaattacaaatacatgtaaatgatgtcaggactgaggattggccacattataaaattgcaaagttttgccactattttctttaaataggtttttgtatgtttgttaaattttatctttttggccaggttcaatggcttagccctgtaatcccagcactttgggaggccaagccaggcagatcacttgaggtcaggagctcaagaccagcctggccaacatggtgaaaccccatctctactaaaaatacaaaaattagctgggcatgatggtgtgcgcctgtaatcccagctaccttgggaggctgagacaagagaatcacttgaacccaggaggcagaggttgcagtgagccgagatcacgccactgcactccagtctgggtgacagagcaagactctggctcaaaaaacagtttatatctttttgctttatatcaagcctattcctggttggatcattttgtttttacaggtgaggattcaaggatcaaaattaagtgactggctcagaaacagagcagtttacaaatcaagttagattggaagctttcagacttagacctacagttctgacttcacaaccttgaaatggccatttttcccactagtgggtagaaaatggatgaaaaaactttaacaaatggatgaaaataatggcgcagttttcaatttcataataatgtccattccccacttcctactaccctccatttatacttgtaactgaaaattttgtgggttagtaacaattagatgttcccattttacaagactaaaagcaaagagtttttacatctctgtctagaagaaactgtcacacacacgtaaatgtgaataatgcccatatagctgagaatattactaagggaaaccacataaggataatgttttgttattaaaattaaaatattttatcaggggtgcaacatcgtccattgaaaatgtccattctaaatacagctcttaatgtaattacagcaataatttagtttgtacattcaaggttgtgaacttttttatatttgctggatgcagttctgaaatttagtacttgtctgtcttaaggagatctgccctgcatgcaaatctataactagacaaatattatttcctttcccagcttgctcttgggaggtttccatatcctcaggtaagattgttcattactgctgtttgccactgtgacattcattcctatgtatgaaggtgcagggagcaattgtgaacatttgagccacatacaaataaatctgtcctgttaaattgaaaagtggtatcttaaagggttcatttagaaatctctattgatttttgatttttttaaactcctgattttttcttcttgttaaaggttgagagtgatcattgtgcttttcctttgtgtgacattcgggattgttttttttcctggtccaataccatgtactcattttgaggttggaggagagagccagctttttcttgatacactttttaagctcttaaattcacttaaaattttttgagttaaaagattaagacaaagggtgaaagcatctaatctaggtcattatttttgctaggcaaatatataggcccccaattttatgagtgtaattttgaacatattatttaaaaatattttgctccctcctgtctacatttgtaaggaaacaaaacagtccattatagtagcattgctgactctaatctttattaaaatttctttaagatttttattatagaagggtaccagcactaaaatagaaagctattttgtggtttgaaaatgattccccagtttgtgggggaaataagtgaaatgtctagagggatgaaaaatgaatggtttgactgttttcctctggttgatgttcactgtttttctggcatcttggtctgtacaggccaaagtgcctagaggcatgtctgatttaaaggtggtgttggtctctgctctttaagcatctattaacttgctattattatgcaaataagtgttgtattacacatactaatttatgcatggttagattatgcagatgcatcacaaacatggttattgaataataggatggggctcattctctctaccatctttataagcagttttaagcaaattctcctggtaccaatgtggacatttaaagaccctttactcaatgaaatgtctctttcgtattcttttgctttcatagttaaagccatcagataagtggaagagaaatcgtccaagttgttaggttcaagagtgttagtctcacttttcaaattcgtagacttttttgtttaaatgtaatcttttccttatagagaaaatctaaaatgcagttgcttggcatgaatgctggcatttagtgagattttagtgtatatagccttgctgcttagctctaggtaacccatcaaattaaaattacattttcaggatttatagctcattagaatatttatcttggtaagcttcttattctgtcagtaatttctaaacaattcagcttggccaatttgtgaaatcccctaaaattttgaaagtgaactcacaagccctatgcagtatatttctcaaacaaatcttagtagaaaacttataagccatccagtaaaaattccaaaggttgagaatgtagcaatattcttgagattcctaatgtctagagtagttaatcagtgagatttgatgggtgatgagtctaagaaatggattttgccatggccaggtgcagtggcttacgcctgtaatcccagcactttgggaggccgaggtgggcggatcacgaggtcaggagattgagaccatcctggctaacatggtgaaaccccgtctctactaaaaatacaaaaaaaaaaaattagccgggcgtggtggcgggcacctgtagtccctgctgaggcaggagaatggcttgaacccgggaggtggagcttgcagtgagccgagatcacgccactgcactccagcctgggcaacagagcaagattccgtctcaaaaacaaaaaaaagaaatggattactgccacatttgacaagtgaagcacatgaaagctgtggtcaaatttgagaagaggctatttacctttgcagtatggttttcctgaatgtctaaatatatctttacttgatcagtcaagtggaagttggaaaattctaatactatgctgaactccctagttagcaacaacctttataccagagttggggcgggaaacaactgtattccttgaatcatgatagaatgttgtcaccaaattgttacttctatctgaaataatagaagcagctttgatgccgttaggcctatttcctaagtttttcaacagaagttggggtgcgtcgttgctagaaccactaatgacttttggtggagttggcatttattttacaggctttgtactataagctgaagattgggaaaggatactttataaatgcctttcctacccctcccttatgccctcaaaaaaagcacatgaagaaaaatgtgtatttttatagtgtcactgaggctgagttatggaataacaccttctctttggcccacgttatgtcatttgaactcctaccactctgtgaaatagcctcccctcataaattggacaaacagaatggctgatttgctcactgttaaaactgtgactggtttggtttctttgaatcccaagtgcagtaggcaggagtgaatcatagactcttagagttggaagggatcttagacatcatcaaatcaaacttctctacaatgtctctgaaaagcaaacatccacactgcttgaacacttccagtgacaagaaactcactatcttacaaagcatccacagggtcaaagcagtgttctatttatcaagctgagaactatctcatcctaagtgtcactcactagtctgatcctagaacacatgagagcctttcatatatccttaagatcacattggtttgattgttcctaggactagggacagtgccagggaattgctgctgtgaacctaaagtctaatcagggcaccagacctgagttgtcttcactagtggcaaattgagaggagtggcctattggaaggagccctggaccatgagccagagtattagaattagaattaggtgctaccacagtctcactgcaggtcttaattgttgctttgtaactctgaggtgtcagtttcctcatctctaaaatgaggattctaatgcctacctcttctatctgattaaaggaggtatgctgatcaaatgagactatggatatgaaaccactctgaaaagtacaaagggccacccatctggatcagatgttgggctgcagcacaaaacagaatttcccagctatcaatcataggttgtaaaaggatgttcttagcaacatgccagccacaattggagcagagtataaaatgagcagagggtaaagtggggaggaggggccagcttcaagacttgtctttcccccagctcagtgtcagtgctgctgacagcatcattagcagcccctcttcctgctggtgacacagtgtgtacccagtgaggtcgcagagagggaggagtgttgggaagatactagggacagtcagtgccctgggagcaacataaaggttaaagggctgggtttttgttgagatagccattctgtatgagtttcattgttttgtgggttgggtctttgttatttgaaagcactgttttagtttcctttaggcctttgggttgcataacttccttggcatgcagtttagggttctaaagaaaaaaaacatgaggagcacagtcttattactactgcctataacaggaaaaacaatggtgtcttggcttcacctggcacctttcccacatagggttccagtctcaggctgttacctgactcaggctgtgcattctacctgcagggacttatttccagcctctaggtgagccaactcaggctcagagaggcaaagtaccttgctttaggcaggaatgggtacagttaggtctaggacttgcagacaaataagccaactccctggctctttaacttcttaattcgtttggctattcatacccctgttctcctttccactctgccccacaacccttcttctagtttgccctctctgccctagggaggcctcttgtatagatgagaaatgctgagcattggagggttgtgccattgtggatggtgacaagaccattccccagatcccacttgcttttcttaccatgtatttagcagagtaacgggagatccagagggacccagagccctcactgaccccagtgccattaaattctgggtgcttgtgaagcatattctgcaataggataatgaaaaattgcatttttaaatatcttgcgaacagtttctcaatttctggaacaatttagctttaatagtaatctggaaagatgtgaaggtctagacaaggactggagctgcctatagttaatcatgtagatccaaattcagttgacttaaaaaacataatggtgggcaatggtttgtttaatgacaccataatttaggagaaatgaaaaggattgcctgctaaaaattgtcatccttcattcaaactttacaacagtgccctgcattaggatgatagcaaatccattaaggagacttctcaggggatgcatcagctctggcattgggaaatttggcaagcaagatgccacaggaaagtgaagataatacagacacaaatgtatttaaagtacttttgcatgtataaaaatactgttcttcttttggctgcagttcctgatcttggttaataaattacatcaaaatgacctgaagttaaaaaaaggaaaaaaatctgagcaaatagtgcccctggtattgtaaagctttgaatgttttcacaccccattaatttattacttctctttcttcatctttaaatttcattttttttttcaaaaattccgactccccgctgctgcagtgattttcatcttgttgttaattttccctgctccatatggagctccagacatttcacctggaggctgtactagattttgctgtagtgatcgtacttccggaggccaaaactgtcatttagggttcctggtgcatctgtctgcgccaggcttttcactggcatgggagagtgtgaataacaaattggatgcacctgagattcggatgattagtgtgttttgtgaatctccacgacttgtaagcagatagctctgtggggagggggggcttaacagcgactgtgggcgaatctgtactcacaccttacatttggggctttgcaagggaagtgcaaacatcctaggcagtctgagtgcagagagagtaacaaatatttcatcctgccttgtcattgattagaaaagagcctttaatttcatttcaccccatgttgtgattaatttgcattctttgtcagaagttaatggagttttttatggttcactctgaaatccttgaagacatcagacttgatctgatgtttatacaaccgccagcggaattttttcgtttgattgatggcaagcttgatgttattccaaacggctttttaagctgtttttaagaattatttgaataaaatgcaagcaagatattcttgtaacgatccagtttatctgttaaaaatctgtttcaaataagatgataagtagtaaaaaaggatcaaaaagataagagaaatagtgaatagtgatgttatttgttaaaaacacataagaatggcattcaaataaattattgcagtatatggagaagatcacttttattgggaaaaaaaaataccatcatctggccaaatagaataatttggactagggtaaaaggaaggtctgaatctttgggatcagaaacttttactaccaattggctaattctcatttattctgccagcttttgccaccagtgtacaaaatagagatctactttacttaactcaaggagacagggctgtcaggcctgttagctgaacaaaatgatgacatattgcttgtctcaaagaggcattcttaaatcccaatacaagttaaacataggtagataataagtgaaaaatatgcattcttaatgatataacgactggcaccttccatagatagttcagaaatgaaaatatcctgttgttaaaaccaagatacttctgtcatccttgggtaagagaaatgtgtgttcaacccctatatactacatatcaaagtatgagaggagctgtaggtggcatttgcttcagaacctcctgctattaaccaaggaaatacgttttgcaaatgctttttgattaccaataacatttgtttgatttgggagctttgccttgcttcagcagattcttgctgtgctgtgactgctgctagtgagacttactcataggtcaaaaagctacttatctgagcactttcatttaaaaccgattaatttatttgctgcatctgaaagtttgctaaataattgggtagttttaattgaaattactgctttctgatccttgtattaacatgatctaaggtcctttttattatatgcaatccatattattgaccagatttgccctgttttcatttaaatgtaagcagcttgtcaaggagaaaatattttgtttaacttggcttggaaacgtgctattttaatgtgttttgtttttttcaattgacagactgtcttttaaacattcatttattttgtagtaataaattgtgctctggatagagtatgtgtttcagaatagagtagaaagcatatgttcttaaaactatttaaaaacattgagcacttttcaaatgctaatgttgaagtactagagtttttacacttaattttatttgtgttttaaaagcctttgactagtatattgttactaattctaatgttgattgtttactgatgtcttatattctatgttaaatttagaccacagatatcattatcttatttatgtttactgatcacgcctggaattgcaaaatacctaaaaagtttgcactctttgaaaagaggtattagaatctatcctttgttgcataaactttttgaagtttggaacatgaaggatttaagtaaatttttaaatatacagttttttgtatgtgaggtctttaatcaaggaaaaaatagcaatgagtaatcaccccaaacttcaagtactcacctttaatttgcaagagtttaaaggggcactatgcatgcaattttttttctaaacagatgtctagcctatatgttttaattcattttacttttgtcctcactatttaggatatagacatttaaaatatcctgatatttcaagcataaaatcagatttatattccataaaatgcagagacgaaatttaagtgacatgaagatgttcacttatacacatttgcttcttcctaggaatttttaaattgccagtgtcaaattcttctccatatctattgtgtacttatcaagaagtctcattattttatttgcttagcctatgccagaaacaggaggtgggttcctagtatgtccttaaaatagagcagaaatggaagagacatcatccccaatgtgtgggtagcttagaaatgtgaaattcttcattaaagataaattatttgttaatacttcaattgagatatctgtatttggccagttaggttcgtgattcctgtgttgtttgaaagcactaacctcatgttggtttgattctgtagtaccttctacactattgtatgacatacatctcaattcaacattatttgtcactgagcacctactctgtgcctgactaagcactaggagcacaaaaatgaaacagatgtggtctctgctctcaaaagagtgcagtccagttggaagaaaaacataaaaccaatggcagttgatataaaaggaatcctccaggagatgggatgctctgacctcaagaggaaaagggagtggtcagctcacttcaggaaaccaagaaggtttcacagagtagatagctgacgcttgagccgaggctctgaggcaagaaggatgggaccatgattcctttgtaatttttaaataatcagtttagcccagaaatagaatagaaggttaaagtaatgaacttggacaccaagtcataataataaacttggtgtccagtctggctttcacgtggcagctttgctattatctctccctcctaggctctgtggtccaggaggccttctacttctctccctttgcaagaagcatgggaaaggatgtgctaggtactcaagtccaaaggaggttcatctggtaaaagataaaggtctaaaacagcatattatatttggtgttgttccagtactttaacagtactaccattgttactttcatttccctaacagcttagcaattctcctaggtaacttttaaagtcaccgtgggaaggaagtaagaaaagggaggggagcatggtagaggagggaggtaatgtgtcaggatggagatggcaagtgtagcagggaccagataaagaaattgggtttgagaattttgtacatccccttgacatgactggggctgatctgaggttggaagtcattgcattttaaggtctctgcccttgaggacagttggcacatgcccctgaggggttccctgccaccctttatgaatttggcttggtatatcacggcattttctagactgctggggaggaattgtcatgatcaaatggactaatgcctaagagagcactttgaaaaatataaggtggtaaacaagagctaggtaatattagtattatttatatttccagaaagttcttcagggatttacctatgtaactctgaaaatatatgaccatgtctcacaccaggtaggactaaaatgaattatttttctgatcccacaagagccttcctttacagactttcttttttgagttataatttatcattcacaatcaccatataatatatagaattatatacagaatctcgtcatttttagttcagttactggggaccatgattcccttacaatttttaaataatcaatttagcccccagaaatagaattgaaagttaatgaacttggtgttcagtctggctttcatgtggcagctttgctattatctctccctcttaagctctgcggtccactaggccttccacttctctccctttgcttttattgatgcagtctgctactttatggaatcataggatttcagcatgtgaagagatcttacaatgatctagtccaactcttagattacagatgaggaaataggagtccacagccattaaatgactcactcatgattaccaggtattcagcaacagggccagactgtctcccactcacagtgcagtggtctttttactttagagggatggtgggggagaaagtgagataaggcatccagagactgtgagtctaaatggccgtccttattttacacacatatccactcaagtactgcctccaactggtgtgtctgcagagatgaaaattactgtcccaggatgctctgtgcctgccaggtaattgctgactggctatggatccctggggggagaatggtcctcaacagcagtagtagcagcagcaacagacaaagacatcaacttttattatactccagtgttttacttatcaccattcagtatggaaaacttgggtagatttggggataggggctcattggcttccaagttaaaaaggggacagacctggccgagctttgtttgagcatagattactttttagatgtttaacagttatggattaatgcgtgggaggtttgggaattcttcctcaactaaaatgttaatgatgctaagaacccaaccctcttcagtgccaataaaacagacgagctaagttcattgaaaaaatcaatgagttgcctaaaaggagcaaagagctgattcgatttagggctggagattgccaggacacaccaggtggaaagagggtcccagagaccacgaggagctaggaaaggaggcagttgtctgtttatgcacagagccaaggtgtcatctccaaggaattttgggaaaccaaggcagccaattggaaccaagtgtggactgttaggctgcacccatcaatgtctgcagatggtgaccaccacggggagaaggaaagaacagcttggggaatagaatagtcttttttttttttttttttttttttttgagacagagtgtcactctgtcacccaggctggagtggagtggcatgatcttggctcactgcaacctccacctcccaggttcaagtgattctcctgcctcagcctcccgagtagctgggattataggagtgcatcaccatacccggctaatttttgtatttttaatagagatgagatttcgccatgttggccaggctggtctcgaactcctgacctcaggtgacctgcctgcctcagcctcccagagtactgggattacaggcgtgagccactgcacttggcctagaatagtcttatgagagaagaagctattggcctacaggttcagaggaggagagaccaaaggggtaatgaagcttgtcttgttttgttttctgttcagaaacaagttgcagagagcactcttctgggcataaggcatgaggcgacctggactccaggcctagttggtaaaatcctttaatcaaaagaaagttcctggccaaaggcctccttccaggccctgctctttggatagccctatgccttcttggtagccaggcagctggaaacactcagtgattcagggtagagggcataggaggcagcaaatgacacacccgacaagtgacaaattaagtcactgacagtatatgatttctacccaaacatacgcacagagctaacctgagttctggtcttggcttttcttattagttgcttgaccttctttctttttggacttcagcctcctcacctggaaaatgatggaaatgccctaggttagtaatttacagaattgtgggtagacagtgtatagaggagatggggatccacccacatacacatgtacacacaaccacacgagcagctctgcttctatctggtaatttttaaatgcatctaagtaataccttatttgaactagagttatttcgtaaacagagtctgaaaaatgctggacaggatatttctatggtctgctttcaccttagatgagcagcttcctcctcctgtccacaccttcagccctcttgctcatcaccatctccctccgattacttccttgaagtttactgaaacctgattgtacctatatcaaaatatgggaggtgtgaagtaaaactctgaatcaaatatcaaacattggagccaggtgtgctagctcaaacctgtaatcctagcactttgggagcccaaggcaggagactcacgtgagcccaggagtttgagaccagcctgggcaacacagggagaccccgtctctacaaaaaatttaaaaaccagctaggtgtggtggcatatgcctatagtcccagctattcaggaggctgaggagggaggatcacttgtgcccaggaggtccagtctgtaatgagccatgatcgtgccactgcattccagcctgggcaacagagtgagaccctgtctcaaaaaaaaaaaaaaaaagataaagtaagtcaaactttatccagttcattcttgatccatgacttattttgtttaaatctattttgaatttcatttacagtcaagccagtaagacacatgttaattcacaagattgtgtgtgactatatatatatatatatatatatatatatatatatatatattttttttttttttttttttttttttttttttttttggagatggagtctcactctgttgcccaggctggagtgcagtggtgcaatctcagctcactgcaacctcctcctcccgggttgaagcaattctcctgcctcagccgccctagtagctgggattgcaggcatgtgccaccacacctggctaatttttgtatttttagtagagatggggtttcgccatgttgggcaggctgatctcaaactcctgacctcaggtgatccacccacctcggccacccaaagtgctaggattacaggcatgagccactgcacctggccaattttaagattatttccctccttatcccatatgaaccatgtattggctgcaatacaactgatctcaaaatctcagtaggccacatccaaatatatcatggtaaaaaaatgttcagtgatatgtggaaccaaaactaatgcagcaacctttcttacaatgcctagaaacattaccatgtggtagggagctttaggggttggaaggatggggggaagctgtcttagaaatctatagaaccctgagggaagaaagcaaaactccagagacttgtattttgtccaaatactgagtgacttttagaggagagtccaagccctgtgcttaattaaatcttagccctgctactaggtttcaggaacctttaataagtcactcatttctgtgggccagcaattgtattctatccatcttttgggtcctagagtctagtatagcgcctggcatagcataaggacttaataaacatatatgaaatcgataaagtaattatgtagcccaagtttactttttacatgtttgcaatcagagggaaccaagaacagaaatcctgaggctctaaatcaattgttttggcccctttcttttcttccatgtcccatcctcccactctatccagccagcatgaatacctgagcataacaccttctgaggatatgtgacaacttgtcttcacatgggcacacacctgtagtcccagctactcaggaggcggaggtgggaggatcacttgagtccagggaggtcaaggctgcagtgagctatgattgcaccactgcaccccatcttgagcaatagagtgagaccctgtctcaacaaaaaaaaaagtgtttccttttcagtctcagatttctttttcagtatataaaaaagatttatatacttctttcagtaagatttatatacttctcggtcttctctcatttgagccaactgtgtgataaggctatcagaaatgtgaatgcatggcctggcgtggtggctcatgcctataatcccagcactttgggaggctgagacaggcagatcgcttgaggccaagagttcaagaccagcctggccaacatggcgaaaccccgtctctactaaaaatacaaaaattagccagacatggtggcatgcatctgtaatctcaggtactcaggaggctgaggtaggagaattgcttgaactggggaggtggaggttgcagtgagctgagatcgtgccactgccctccagtgtgggtgacaaagtgagactccgtctcaaaaaaaaaaaaaaaaaaaagtgaatgcacttttagcctccttgagtctcggctgtctggtgtatcaggtccaaaacatagtgatctaagcccgtcaatccgaggtctgtgttcaggtgtgggtgtcatactttatgaggaacatacacatatggaaacaaattcagagaaaggtgactgtggtggtggagaataggaaatcatgcctgggttcttcaggcagctttcatgtccaggtaacagaaaactcaactcaaaggagccctaatcacaaggggaaataactggactgcatgactgtaaagcctagtcttccttgctggttttagctgggacttgactcagcaattcatattcggttctctccttagtaggcttcttccttcacagaccaagaatggttattggggttcctggagcaacccacttcctgtctgagaggggaacagcaggtctcttttcctcagaagcaaccaaaggccttaggctgcagtttcattggaccagttcaactccctgtgcccaggggatttagatgttgctgactaatgtaggtctgaaccacctaccataccctagagctgggggtgaagtcatcttcccatggaacacacgggcttcttgggggtgggggagtgttgttggagtatccttagtaataaaggggagaaggatagagggcaaccaaaataccaactgatcataaggaagaaaacagggatgttcattcaagaaagacaacattgtggagacatgactgctatcttcaaatatatgaagagctgtcattaaacttatatgccatagctccagatcatgggcacatcttacagaaagacatacttcttggattcaaaataagaaagaactttttttttttttttgagagggagtcttgctctgtcgctcaggctggagtgcagtggcacgatctcagctcactgcaaactctgcctcccaggttcatgccattctcctgcctcagcctcccgagtagctgggactacaggtgtctgccaccacacccggctaattttttgtatctttagtagagatggggttttaccatgttagccaggatggtcatgatctgacctcgtgatccgcccgcctcagcctcccaaagtgctgggattgcaggcgtgagccactgcgcccggccaagaaagaactttgttaacagtttaatctgcccaaaagagaatcattggaatctcatcattagaagtcttgtagcaaagacagaatacctatatgtttggaatattataaagtgaatttctacattaggcaaagaattgtactaggtgacttccaacatcatgtagaggatttaagctaagagaggtgcaaactaaatgaaagctccggaaaaaccctctcagacattttgaaacattaaaatgttgctgtagcagatttatttcaccataaagagtagagtagtctaaaggaccgttctcagaaaaagcaacacctccttcccccagctgcccctttcccatgtctccacacacaattaatattcttaaactggattctaaaataaggccacccttcttttgggacaaagaaaggagaaaagactgatatggcaaatgtctaaaatcttcaaaacttaggtacttaatggactctgtggacagacctcataccatcaggaaaaagattttataattcacattaatcattttaaattacaattctaagcccctgctttccttgcaaaattcaagtctaaacattaaaatgtgcaattaccaacaggaagatttactttggctcttatacacctatgtggtgtgggacatgagctatgtcaattttaaatacacaaaggataaaacagtatgaactggcagccaggtccttttttttcctcctcactgactggcagacccagcaaatgaataatgtttcgctgtacctcaatgctccagctgttgtattttgtgtgaaaatgcattgtccttgatactcaggaagcagtgaggccaagtaaactaatttatggctgtgatgattttctgtctggtcccatcagagctgtgccctcctgtaggcatcttaaagcctttctgtcctacctagctgcttgctaaattcagggatatgtagtttttgcttttcaaaactggtcactcctgaatacagcaccccagctggagtctgagatttgcgccagagagaaggtgccagtgagtagatcttagaatgcgagaatcgttggttccttcttataacctactgagtagctgcctgctaaatcttcctgtgacttttttaggtcctgtgaaaatatactaatagacccacagacatgataagaacttgagcaaggacagaggctgatgaacaggggagataggattgcacaagtgaattatacgtgttcacctgaaattattggaagtagtatatattatccatttattttgtttctgaatgcatttagtatcttcacatatcagtttgctaaaagtcccatttgtagttagccagagtaaattttgttctcttcctttatttaaaagtgatttgtttgggaactctttaagttagtggtactaggcaatgtatataaagcttatcatggagcagtggttttgtttttctcattgaaggctttctgagatatggacactttgtttttgcaagttataatggattggaggttgtatgtccctaagttttaatatccagcacagtgccagataaaattagattgattgctggtacctacccttgggtaggaaaaataaacatggctcctgaatgggaagctctggcttcaaggaatctttgggcttctctagctcattccttcactttgtagatgacagctctaagccccactgaagggagggggcttctggggaccatgggcatctgactagaatcccaggggtctttcttactccaaagttcatgcgttttcctcacagtggacagtctcctaacccagccgtcagggtcaggccaggcactatctatgactttgagcgctgctcccctctgagcctcagcttccctaaagcaaagtgagtagattgaactagatcatctctggggttccttcctttcataaatactttggatcataattcttcatttagaatatgaatgtctcagtttcccataatccctgtttatatttagccagggttatagcttaatgcatctgatttgaaaagagagtccttgcaaaatagccacagctcctaaaatttgaagttttaaaaaaaagaataaagagctcaacattgaaagctagaatgtgatgccagtagcacaacaaatgaaaatgctattctttaaaaattccaaccatatgatttaattttatatttcttctttctatttaagagaaaataatacaagcttgaaaagcagtaaatatgtaaagagaaaatttgtcaactgatattggaagatctgacctaggtcacacataaatcttccagacaagagctgcagggcaagccgtaatttcagagagtaaaagagaaaatgaaagctatagctggtgtcttctctaagttacataggtagattcattttagttttctgattgtgcctctgaatataatgtaaaaggggctggtagcaagatctgttttaccacttatgtaaaaagctcctctacagagagcaaagcataaagtgagacttccaaaattgctttttatcaccagagccattggctaaatagttgaggacccacaagcaaacttctacattggcaatttcctttctagcatcatttttcacagtcataagtcatgttataagaattttctaattgctaatgatggtccttgtaaggaaatatatgataaatgttactataataataccaagacctaactggtacttgtggctgccttctatgaagtcattcttccccatttaaacacataagagtctgccttacatcagaatgagacgtaactatcccctgttagtgtggttttaaatcttgaatctaacagctaatgaaagaaaaaaaaaaatctatgcccagaaaagggaagaggttcatctatcaaaatgcaactagttctagagactgattaacaaagtgtgtgactggaacaattactgttctctcattgtcccaaagtactagttagacatagaaaacactcaacacacgcaaaatgtataagcaggaatgagggcttggacaagttagttataaacagcatttcgtatgttgtgaggtgcaggcagtacatcagccctaacaatattattgcgttcctctgaactctgctctcacagctaagcatttggaaggcagacccagaataaagataggcattcacaaagccaacattttatattgaggacccttggttccacttttaatgtgctataaactaggggcttcactttttcatgaactgtgtgcaaaagcagaggcaatgactggaggttgactgtttggatctgttttatggttgctgtgcctatacagtaatgtgatcttgaaaaaggtaaacaacaaagagtttagcagtgaaaaatatgcctaatataaatacagccgagtacatggcagttcagaattttaaaaatatgactgtggcattaaattttctggtggaattaacagaggaacataatacagcctttatggcaatatatctgagacagaaaaaggagataatacatctaactctatggtctatgtggcattcatataaagaaaagcacagtagctttatttaattgagaaaatgaatcaattacaatgatgttgcatcatcaaattcttgtgaaatagaagatataagtcactgcattgtgtaactgttaaaaagtaattgagtatcttaagcattttgaatcaatttcaggtactggcactgttaccttaatacaaaatttatgaagatgatttcatataatatgttgctatcaaaactgtataataaaacctgataacgtctctctttaaaaacctgggcaaaacagtatagttataagattataaaaaaagactttgatattgctgtttttctctttcttttaatgaagagcaagcataaatagtacagttttaagttgacttagactaagcttttaacctgcaaaatagggcaaactagagactttaagacctcagttcatgaggaagtttcctcccctcagttaatctgattcacacaactcatatgtttctggggacagtgtttcataatccatttctgaattcatttcaaaacctctcacttagaatgtttgctgcatgttctcctcagagaatgttgtcatccccctgactcttggaaatttgtgaaacacattctctttgatgtcagaaatggatttctgattctttattcattacaaataactccgttgttgaagcagatatatcttactaggaatgtaggggtggggggagtatcagtgtgtgcttgaaaaaaaaataaaagcaaactccatagatatctcatgtcataggagaggttatccaggcttttcagtatttttttaaaggtagtttggcttgttactgaaattcttaaccacttccgggtggtggttacagctccgccttcccttgtaatgtaaatctttacctgcagaatcttgtctggaaatactcatggactggagaaaccagaagaagcagtaattcaggacaacatcaagcagggactatcaacatagactaagccagtcaacctgggacagaggtttctgaaagtagtgattggggaggaagtgatgaaaagccaataagagcaatgagtgggcgccgtgttcatttgacaaatatatgggaaaacactttttaaaacactcaggcagtaggaagaagggtgtgctgatcagccacatggatgcaaaagaaatgcataaacatagctgcagctcttgagaaactcacagtctaggtgagaggaaccaacatgtcaaaatggataatttatcaacaataccataccaagtataaatgtatacaaatacagttgttttcaaataactctatgatcataggcaagtgtaatacagatgctggaaggaaaggagctctggaggagccccagcaccaccacaccctggcgctgaggcctcaggcccggacactgtcctctgataggcccagctttcccatcatagaataaagatgatcatccctgccaaactcagggtggttgtacagatcaaatgagtttgtatatgggaaagaattttttaaaacacctttaaaaacatataagggattattactagtttccctgtattttaccggctggttggagcccagttatctcagaaaacagttgacccatcagtatttggttcctgaaaagttctctgttagaaaatgtagtacctggagtttcattttcattgagtttataataactgtaagctttatttttcctggatggggaggcactgaagtgtttagtactttaatgactaagtggatgttttattaatttttatgtcacgttttagtagctttgtaagaaatgcagtttatcagtgttaaatgtgtgagcagcctgccttcagaatgttgatcagaaatgcgctcttactggactctgcatttattccctaaaaatcagtgtgaaacttccatgaatttgattttcccagagagcattgctgccctggaaacaggcagaaggaactttggaaaaggtggagttgttaccccactcctaagttaggtgcaaatacttcaactacataattaaagttttcctcacaaaataggggattgtgagcagacactggcaggaatccaaaattctaatttctgactatgatttaatttcaattttaaataaatcggtttttaatttaaaaagagtgagcttcgtaacattagcaatgattgcaacattaagcccagtgttcacaatctagcagtataaaacattatttatatctgaatcgtaaacagccttttgaaatggattatggtttttctccctattctaatacaacctggagggtactaaaaagtgttgtgtgaaattaacattctgctgactttcgcctataaatgagaagcgagctattaacatttgtgtattttcattatgtaaattgtgttaacacatgcccacaaattgccaccagcaatgcaataattttctctcagtgatcataatgtgtccaagtgagtcattttgattatgacatgctaattacatattgccttttttcagattcagaaaaaccagggatctttaatggtaagctttatgagttcagaaaaaaattcacttttctttttcctgatggctgcttcctttgcatgcttgaatgccttgttttaaacttagcaaattgcattttgaagaaaatgcaaacctttaactgcctgtattagattaggtaccattagaaataatagaacctcctgagcatcaatgtttttataagagtttgctgttgttgattaatcttgctatattttattgcattaatgattttttctttccactccactgtaaagatattacatagaggctaatactttttcctctcttcttttccattgcagcctctccagcttctgcagtgcattgttgatgaggtgaggcatcgtcttatgtgctttcactcctaaagtcattcctaatggtgtggaaagcttatattttgtttcctaatgaagcacaatgcccaacatccttggagcaagttgtgttgtatggctctgagctgtgttacgtgaactggccttgtcctgaatcccactcttctgattctggccaagaaaccctgcaaaaacagactatcccgcaggctggtcctcaggggcatcagatgccctaaagacaaaacacaataatattaattgaccctctccctggccagatggggatggaactggaaattaaaatgatatcatttttttctgcaacagttatttaaagtcattcagtaggcaagggtcagagttgaagagcaagcataagctggatgaaatttgcctgccttgagttatttacccaaagcatatcagagtgataaaagggctcaaaaactctaggtcaacagttcagcgttaatttcctaattaggcatttttctcagaatatgtccctaacatcttgtgtattctagtagctggaaacctgtattctcacattttaattgagcttacttctgatcatccttatccattgaattccactgttcctttgccttcatggtgctaatctacctgcctttctctctcaatcgactttgtctacttcttattctgactttaaattccttttctgtaaaccatcaatcttataatacacaaggctttcaagaaacattaacattttctttaaaaactgagatttttggggcttgggtttgcctactagcaatgtttattttttaaactttaattttataatatttaaaacagttgtaattagagagggaaggcagtaaatgattcagataggaaagtttgaaagaaaaaaattgtaattcataattattcctctcaattaaacatctgcataaccagttatgaaatttgggagaaaaaataaagatcctcctaggaaaaaaataaacacacacacacatatcacaataatagtaagagtggggctctaacatccttaatggttgcatcagtcagtccatatatcccctgcaagccataatccatgttgatgtaaaaatgaaggcatcgtcctgaaacaaatggaggctccattatctcaaatatcagacagacctcctggatctaatagctcatcaatatcctctgttatcttagattccaaaagcctactatccccatcagaatcctcccaatttaactggttttcctgaggtccccctccagttttgcttgaggaagtgtctggggaaacttgcctacccagtttcgtgcacagccttctgtgtttcctgggctctaccgttggtctgccaggctcctaggcatcagaacatccaggtaaaggcattcctcaccaatactatgtgtgtttctcatttgaatgttttctgcatcaaatagatattttcattccttatttaaagtaacagttattgctgttcaatttaaaatatcttacttgtttaatttgggcaaaatcatgagacttttgaaattaccatggggagatgttctatttaagggatgaagattgatgaagaacaataatgtgtaacttaaatgatatatttttcttcatagcatttctttcttagtcaagagaaaaatgtaacttagacatatattcctgtttactctaaaaccatcttccttgtggaaacttgggaaatgaacattgcctttgctaaaaccaggttgatcttggaactgagctgatattctgcaataaaagtattaggaaaggattggccagatgacctgccttagacaagatgaatcatagcatctcggaaaggaaggattggtggggtcctgtacttactgcacttgtcctatgtgtctgtcagagttctcattgctgtgatgcagtgttcctcatagggtggaccaaggactgattgcatcagaattacctaaggctcttgttgtaatgcaaattcctgagcccagatcgctgaattag

SEQ ID NO: 15095 - DNA, 93510 bp, Human
  misc_feature (1)...(93510): n = A,T,C or G
tgccacatagttatctgtatgagtttcacatctggccagatagattgtaaactctttgtcaaacacattcttgtattgctctagtgaacctagcactgtgccattcctatcaaatacttacttgtgggaggcatgattgaagaaatagaacttttcaagaaattttcttcagataaagtatagactgggtatggtggctcacacctgtaatctcagcactttgggaggccaagtctggaagattgcttgaggccaggagttcaagatcagcttgggcaacatatcaagacccccatctgtacagaaaaatttttaaaattagttgaatgtggtggtgcacacctgcagtcccagccactcaggaggctgaggtgcggggtatctctcgagtctaggtttgaggttacaatgagctatgactgcaccactgcactgcagcctgggcaacggaaagagaccctgcttcttaaaaaaaaaaagagagagagaaagagaaagaaatgaaagaaagaaagaaagaaaaagaaagaaagagaaagaaagaaaaggaaggaaggaaggaaagagacaactattgtcatgggaaacaaactgaaaagaataatccacagtgattttatttgtatttatgtgcttaattacatacttaagtatgacaactccacagagtgctcttgctgtctcttcaaaagattatggctttggtcaggcgtggtggctcatgcctgtaatcctagcactttgggtggctgaagcaggcagatcacttgagttcaggagtttgagaccagcctggccagcatggtgaaaccccgtctctactaaacatacaaaaaaaaaaaaaaatagccgggcgtggtggtgtatccttgtgatcccagctacttgggaggctgagtcaggagaatcacttgaacctggggggtggaggttgcagtgagccgagattgagcaactgcactccagtctgggtgacagagcgagactctgtctcaaaaaaaaaaaagtttttggattccagctctaagcgtcaccatttgctgaagcgggatgtccagatggagtgaagggggctgagtctaaagacggagagagagagaggccagctagggctggggataatgagggagctgagggttccccaggacatattttttacactttcttttttgttgttttttgagacaaggtctcattctgtcactcaggttggagcatggtggcgcaatcacgaatcactgcaaccttgacctcccgggctcaaggcattctcccatctcagcctcccgagcagctgggactgcaggcgcatgccaccatgccagctgatttttaaattttttgtagagacaggggtctcactatgttgccctgacttgtctcaaactcctggcctcaagtgatcctcccgccttggccttccaaagtgctgagatttatagtcgtgagccactgtgcctggtccatactttcaatacaaatgtatggtgatactactgtgaacaggtcctagatttaccaaaattatctttttgtgtgtttgtgtattttaaggttatatctctgtagagaaatgtcgtatgaatttattaaatgtatctttttatattttgaagttatgcctctttggagaaaggtttcaccttatcaggtttcatcttaatcagttgaaaaccttgctgtccttattctctttccccaggtctcccatttcatggtaagtcatcctcagctcccagtccctctttcccctggttctgctaggggtctttctctttgctgtctttcctggacaaatgatctgacccatagattcaggttgttgtgccactaagttctcccatgacctggtctctcagcacatgtttggcaggttagggaggtcacccagtcccttctcacccagccgtggtctcttacaagaaaaaggagacacaaggtatctaggcaagcttgcacattctgactaattgattgcatcatagaatccttgaacaagaaccagaactccagagagggaaaacatctatcttgctgtgtttggacaggccagcccctgaaacatcttgggcaatggagggttaacttctcaaagtttaataggcaagaccagcaaccatgcaacaaggtaaattgtcctcacgagaactccaaagactatttttctctctctttttttgaggcagggtctcgctatgttacccaggctgctctcgaactcttgggctcaagcaatccccccatcttaacctccccagcagctgggactacagccacgcgccactgcacccagctgacttttccttctaagcatctttggctgggcgtggtggctcatgcctgtaatccctgcactttgggaggccaaggtgggtagatcactggaggtcaggagttctagaccagcctggccaacatggtgaaacctcatctctactaaaaatacaaaaaaattagctgggcatggtggcaggtgcctgtaatcctagctactcgggaggctgaagcaggagaattgcttgaacccaggaggtagaggttgcagtgacccaagattgtgccactgcactccagcctgggtacacagcgagtctgtctaaaaaagaaaaaaaaaaaaggaagagagagcatctttatcttcattttctaacctttaagtgttactttctcccagtaacattttgcccagaaagaggtgatgaatatagatttaagaataagattttccccatgttgctgcctttccagaacaagtgagttcattctcatttgtctttcttcagaaatcttttatctgtctttctcccattagctggaatgggtgctccatgagaataaagacttgggttccattcttcctattgtccccagagcctacatactggctggcattgagtagcaattgaacagttttctgaatgaatgaatgaatgaatgctcaaataagcacatgaattaattatcactttcctttgaatctctccattcttcttcctcacccaatggggctcgatccttatacacagaagatactctataaatgatgattcaatgaatgccaagccctgttctatgcactgaagaccaaaagaaataaaagacatcattcctgctctgtaagaattcataggctagtaaggaaagaaagatatataaatatctgtaatacaacatggtaaacaggaacaaggtgacgactgttcctgaccatttcctgtatcctttagatcaggaactctcaacctttgtgcacgtgtatgtgtgtgtgcatgtaccatgtaccccttggacaatcaagaatacaagaaaccttgtattctttctcagaataatgtttttaaatgcataaaatacacaggattataagggaaattaatggcatgaattacatttattaaaatgttaaagtggcaccatggtaatacatgcatgtatttattaatgcattatgcagcaagatccagcaggaacctaataacaatgacaattttgaagtcttttttttttttttttgagatggagtctcgctctgttgcccaggctgaagtgcagtggcgcaatctcggctcaccacaagctctgcctcctgggttcatgccattctcctgcctcaagcctcctgagtagctgggactacaggtgcctcccaccacgcccggctaattttttgcatttttattagagatggggtttcaccatgttagccaggatagtctcaatctcctgatctcgtgatccaccctccttggcctcccaaaatgctgggattacaggcatgagccactgcacccggcctgacaattttgaagtcctgatgagtgtaaacactactttgagacatttgcaacaacagcatagatatgaatatatctgtgatttctctttttttttcttttttttgagatggagttttgctctgttgcccaggctggagtgtagtggcacaatctcagctcactgaaacctccaccccctgggttcagtcaattctcctgcctcagcctcccgagtagctgggattacaggcacctgccaccatggccagctaatttttgtatttttggtagagacggggttttgccatgttggccaagctggtctcaaactcctggcctcaggtgatccgcctgccttggcctccaaaagtgctgggattataggcgtgaaccactgcgcctgacccaatatatttgtgatttccactggagacaaagtcacagatgctgctagcactagtgggtttgttgcccacattcagaattaaaggaaatgctaaatttcagttacagactatcagaaattaatttgtatttttttcccacagaagcttacggatatcaccttctacctgaagggtctctgatgcccaggttattaatctctgatcagaatgttctaatggagctggcacttatttagagacagatcttagatggcagatctaagcaattttagcattccttgtagtacagcactgatggtagtaaattcacgcaacttttgtttgtctgaaaatgtctttttacccttccttttttaagaatacacaatacacagttctagtttggtacttttttcctccagtattttaagaatgtcatttcattttcttctggcttccataatttattttgggaagtcagttataattcttattactgtttttctgcaagttttttttttttcccctttctagctgtttgtaagggtttctctttctctttagtttccaacagtcatttaactataatgtgcttggatgtgtttttgttttagtgcatgtgttctttttttttctttttttaaatttatcttgcttgggctttgctaagatcttcttgaatctgtgggttaatatctttcattgtttttttgaaaattcttgttttatgactcattatttctcctctttccttctgaaattccaatatgcaaacattagagcatttcatcctgtcttacatctctttcaagttctgttccagtttttttgccattttttttttctctgtgcttccgtttgcataattccttttctttcttttttaccttttttttttttttttgagatggagtctcactctgtcagccaggctggagtgcagtagtgcaatctcagctcactgaaatttccgcctcttgggttcaagcaattctcctgcctcagcctcccaagcacctgggttacaggtgcccgccaccatgcccagctaacttttgtatttttatttatttattcatttatttatttgagatggagtctcactctgtaacacaggctggagtgcagtggcgtgatcttggctaactgcaggctccacctccggaattcatgccattctcctgcctcagactcccaagtagctgggactacaggcgcccgtcaccacacccagataatttttttgtatttttagtagagatggagtttcaccgtgtcagccaggatggtctccatctcctgacatcatgatccgcccacctcggcctcccaaagtgctaggattacaggcatgagccaccgctcccagcctaacttttgtatttttagtagagatggggtttcaccatgttggccaggctggtgtcgaactcctgacctcaggtgatccccctgccttggcctcccaaagcgctgggattacaggcatgagccactgcgcccagccagtttgcataatctccaataactagtcttcaagttcagtgacagattttttttctgctgtggccaacctgctcttaagcctagccaatgaattcttaatttaaaacattatatttttcaattgtagaatatccatgtccttttttagagatttaatttctctattgacattatttatcttttcgtccattttttctaacttttcttttatttttctttaacataattacaaaaatcatcttaaagtccttgtctgctaattccaacatctgggttacctgtaggactgtttgtgttgtctattttttctcttgcttacaggccacatttttctacttctttgcatttttttttaatattaagcataaatagccatagagtctgatgtagatattatttttcaccagaaagagaacactctttcttctctcaggcagctaaggtgatggactgatcactttgatccagtctgatattgagctggatcagttcacttttcgtttcaaatatcagctgagcatagtggctcatacctgtcatcctagcactttggtaggctgaggcaggatgaccacttgagctcaggagttcaagaccagcctgggcaacatagatctcatctgtatttttttaatttttcaaattttaatttaaaaaatacttttgcccaggcgcagtggctcacgtttctaatcccagcactttgggaggccaaagcaggtagatcacctgaggtcaggagtttgagaccagcctggccaacatggtgaaaccttgtctctaccaaaaatacaaaaagtagctgggcatggtgtcacacacatgtaatcccagctaattgggaggctgaggcaggagaattgcttgaactcaggaggcagaggttgctgcgagccgagatggcactccagcctgggtgacagagcaaaactctgtctcaaaaaaaaaaaaaacagtttcaaatatcttagagtcatgcctgtcttgtgtttattacaggcccttttttcaagcagccttctctttctcaaatacaacaatattatagggtatctttctctgaatttcaatctagccttctttactgcccagaacttagcaaaaatcctatggggagaactggcaggtggggaaaaccagctatgcatttgaagcttctccagattctactctgtctagccagctcacatgaccataaaagctggctgctttctcattctctctgagtagtcttgcctctattctggcaagtctaatctcccccaacccatgccgagactcaacaaatgccctcatagaggaaagcagtcatgaatctccactcactttgggagggtcccttctgctctggaatttaattccattagatttccagccttccagtatctctaaaaagaaatatatatgatttttagtttatccatatatattttttctaattgctatagtggacacaatggtctactgctcccctcttacatcctatatcctaaccaccaattctaaatattttaaattcccattacaatgtcttattttattcatgagttattaaaaaaaaaaaaccaaaaaacaaaaaaccttttaaggccgggcacggtggctcacgcctgtaatctcagtactttgggaggccaaggtgggaggatagcttgaggccaggaatttgagaccagcctgagcaacatggcgagaccccatctctactagattaaaaaatacataaaaaataaaatttaaaaaaaaaacaacttaaatttgtacatttgtaatttccaagtatattgttttaaatttgatcattttgttaattttaacttaattatatgttgatttatggcctatatcagggattgactaattacttctgtaaagggccaggcagtcacaattgtaggctctgtgggccatatgatctgtgctgttgtaacaaaaaaggagccatagacaacatgtaaatgaacgggtatggcttggttctaataaaactttatttacaaaaataagtgacaggttggatttgtcctgcaattcagtttgtcaatccctggtctaaattatcttaattatttacaaatttattaagacttgctttataaatatgtttgctttgaaatttgagtgcttttcatgtgcacttaaaatatattctgtattagctgggcacagtggctcatgcctgtaatcccagcactttgggaggccgaggcaggtggatcgcctgaggtcaggagttgagaccagcctggccaacatagtgaaatcctgtctctactaaaaatacaaaaaattagctgggcgtggtgccaggtgcctgcaatcccagctactcgggaggttgaggaaggagaatcgcttgaatccaggaggcagaggttgcagtgagccaagattgtgtcattgcactccagcctgggcagcaagagcaaaactccttttcaaaaaaaaaaaaaaaaaaaaaaaaaaaaatacatatatatatatatatacacatatatatattctatattaaataagtaattctatatatttattagattaaacttgttttgttgttcaaatcttttataactttgttgattttgtttgtttgcttgcttgatctaatggcagagaaaaatacatttaaatttattcttgtaatgtggatttgtcagagtatttctgtaggtctaacaattcttgctttaatatttagaggttaatttattagaatattaacatctggccaggcacagtggttcatgcctgtaatcccagcactttgggaggccgaggcgggtggatcacctgaggttgtgagtttgagaccagcctggttaacgtggtgaaatcctgtctctactaaaaatacaaaaattagccgggtgtggtagtgcactcctgtaatcccagctactcgggaggctgagccatgagaattgctccaacccgggaggcggaggttgcagtgagctgagatcgtgccactgccctccagcctgggtgacatagtaagactctgtcttaaaaaaaaattaatatcttaattttaagatattaattttaaatgattaaaattatttaattattaattaacataataattaaacatcaaatcattcaatcatttaattaataataattataactataactattatctttatatataattacatataataggatattttatatatctatatatatcctacatatatgtaggatggaagcgaaggattgataaatgtatcttctcccaaagaagacaagtatttcagcatgcttttatgtattttagtctctcttacccctatagcccatcatactgaaatggtctagaattttagttatgtgctattattcataaactttcacttatttggcttcctctaagtgttttgacggagagatattatgtggcaagctgagggtttaaatcactgagaatatttttattatgccatcatatttgaatgctaatttcgctggatataaaattctagattcaaagatccctttcttctgttctttaaatctattaccttattcttttcttgcatcattggttgcaagtctaatgccaatctggttcttgtttctttttgagtaatctgttttgtgtctctgaaagcatttaaaattttctttttggctgggtgcagtggctcatgcctataatcctggcactttgggaggctgaggcacgaggattgcttaaggccaggagctcgagaccagcctgggcaaaatgttgaaaccccgcctctattaaaaatacaaaaattagccaggcatggtggtgcccacctgttgtcccagctactcagaggctgaggcaggaggatcacctgagccttgggaggtcgaggctgcagtgagccatgatcatgccactgcactccagcccgggcgacagagtaagaccctgtgtctaaataaataaagaaataaataggattctactttagaaattttatctagcttttttcatttattattatatattacaaaaaggctttcccactctccatcttttgtatttttgtagctccttataagcctaaataaaatactatttaccacacaactgagtgctgataaaagtggtttgttttaggccaggcacagggctcacgcctgtaatcccagcactttgggaggccgacacaggcagatcacctgaggtcaggagttcgagaccagcctggccaacatgacgaaaccctgtctctactaaaaatacaaaacttagctgggcgtggtggcaggcgcctgtaatcccagctactcaggaggctgaggaaggagaattgcttgaacctgggaggcgaaggttgcagtgagccgagattgtgccattgcactccagcttgggcaacaacagcgagactccgtctcaaaaaaaaaaaaggtttgttttatagtgaactgtggagggataagggacaaagctgggcacaaaaatagatctgatggtagggttaggactgagggggcagaggaaatgagactgacatttcctagggaaactgacaggttagccaatgttcctattccaatccatcttcttggaaactgcctgccatttcctctgacatctgaagcacttgctgtaaagcactcactgcttacactatggctgcctggctggctttccttgagaatatgtatatttaatctgtattttgtctatgaagctttttgagggctctgtagttctactccacacattgcccactcacccatcccattttcctccggtagctgctacatggaaagtactatggatcaaattggaaatccatctctcctctcaaaggcagctaaagctatgtggtcaggctctgggccccagattccagtcctgatttctgagtctgctttccaggtcagggaatgcactggggctgacgacaaggctggaacgtcccgggattgaagcttggatccgaactgttggacggcgtctggagttttgcacaaaagagaattgaattgtagatcagctgggaagttactgtggtagtcctggtgccctgcggcctccagcgactggaaccctgtgggagcacatagctggcattttttgctagagattaggaagtcttttgcttcctctgtgaaaaggcttgaattcaatggactgtgtggtaagatgaagttgttttttttttcccttattgataaaaataaaacagagatttggcttgggttattacgcagtggtgggcacatgagcttgctctccagtgtttggcgggaagccagttgaagagcatgtggttacatttttgtccggcatcatcaagagtgtagagaagctgtgattctagcctcagaggagcgagtttttattgtggggtgactcttcaaagaccatctttatgcaagaaatgtcagaggcccatttcatagtaagtttctttggaagttttgttttcgtcgatgctatattatcactcatgggctgatgtcgtctccttatgatggtgtccctaagagccttcacaggcctagggagcactggttggtggtgggaggcccaggctgagaggcaggtctctgtgttgtatttcttcctgggctttagtctgtctctttctaaaatgggctaatcctctctctgccctcttcctcatgtggtgaagggcgttgggacaacatgcaaatatggttcaaaggagaagtgaagctgctcttttgtactctgtcacatttgcttgctctgaattgggtcttttgttagcacattctttgaagtagaacttgtccatggttgactttggtgtcttgatttggagaagaaattgagtagtgcccaactgcaggtagactgagaggctgaactgggtttgcatggggtttgcaggatgtgcagaatggttaaatgaatgtatgaatgaacatatgtagatcgaatgtttgatggggaacctcagaatgacccaagaaacatgtttctccagaaactaagtagatcttgggctgtgaagtatttagtacccataacaagcaatgatagtttaaatatgtagtccaaaaatttcttcctcatcagtcaagtcataaatgcaggacttaaaggaaaccacatgtgagaggtgtctgtgacctaggatattggaggcctgggtcacagttaggaatcaggacctcgcaaaatttacttaacattctccagaatgtggcccaatctacaaagccaccctcatgtcagctgctcagctggagagcacatgtgcttgaagtttctttcaccttcactcttgctttaataaaagcatgtataagtccaggagcttattttatactttggttgatcagcgattgtgtcttcactaagaaccacccatattgtcatccttgggcagacacgaggaaggatgaaaggattgacctgcgagaatctagagaactaaggccaagggaagcaggtcagatggaggtagattgcatctcagatttaactggccaatgatgaaaaaaggttttgttttttttttttagacagagtctcgcactgtcacccaggctggagagatctcggctcactgtaagctccgcctcctgggctcacgccattctcctgcctcagcctcccaagtagctgggactacaggtgcctgctaccatgcccagctaatttttttgttttgtatttttagtagagacagggtttcactgtgttagccaggatggtctcgacctcctgaccttgtgatttgcccacctcggcctcccaaagtgctgggattacaggcgtgagccaccacgcccagcccggaaaaggttttttaaagagtgaggtagcacctacctggatcttgtcttgggtgggtgctatggtctgcatgtttatggccccccaaattcataattgaaacctaatctccgatatgataatattagaaggtggggtctttggaggttattaagtcatgagggtggagccctcacgaatgtgattcatccccttataaaggagaccctagagagcttgtctgccccttctaccagtgaggacggagtaagaaggctgtctttgagaaatgagccctcaccaggcaggcaccaaatctgctggtgacttaatcttggatttgccagcctccagaactgtgaaacatacatttccatcatttgtaagttacctagccaatggtaatttgttgtagcagcctgaacggaccaagacagtgagggtgggagtggaatatgatgtgctagattctttccagttttcaaataatatgcttttaccttctggagtttcatcccctgtgccactaatctctgaattgctaaaatctttgcatttttgtctcctactctccactttatcaaacaacctgtcctatgtctctgtatagctgcagactcttatcagacctctcaaaatatcgtttatgacttcctcttccatgtggaggacatgagagagtgagagagaactgggatcttctgtacttttaatgagtgaatccacatgattgtaggcatctagaatagggctctcaaactttagcaggtcacagaatcaccaggagggcttgttaaaacacagattcatggttccaccccaatgttttccattcagtaggtctgtggaagggcccaagaatgtgcatttctaacaagttcccacctaatgctgttgttactggtgcagggaccacactttgagaaccaccaccctagaggacggggaccaagccagcccactctcagtaaaatcccaaatgcagagggggcagattaataagtaccagggtgtgctgtcctcttcctcctctttctcttcctcatcctcctcctttatcgaggcttacctgatccctgcctcaggggcctccaaagaaaactctgacttagaccaatgtgtcccagattcaatgtcactttctataggaagccgttcatgaaccccaggattagatgttgtggcttcctatactttttcttgatagctatcatgattcacaatttgcaactgtgatttgtgtgatttcttaatctctgtttcctccagagaatgtaagctccatgaagacaggatatacgaatagtaggaaaaaaggaagggtttgggtggggaatggtggtgagtcacccttaggattgtgcacaataaaagacagtgaaacaacagattttgtccccaaagaataaaggaaggggagggaggaggaaggaaaaaggtggcctggaatatccattagaacgttggctgccaagtctagcccagctctctctggtgccaaccagaggtttgcctgctctattttggccacagagtgggcatttcatctctccacgcattttaaaatcctagttgtttctttttttagctctgagctacttacccgctctaagcctcagctacagcacccataaaacaaagaattaaggctccatggctgaagagacctaagtacaacacccagctctgctactgttgcatttccatgagtgcctgaattaactcctgtaagcgtcggcttccctcctgaaaagggtttctactcctaatcttgttgggacacttccaggaatcagggcacatgaagtccttagcacaatccctggctcaatgcacatgagtggccattgtcatcaccatcttcaatatcaccgtcctcctcaccattgtcaccatttctgtccccacacccaaggtttctgaggtctcaatgggataaaataacttcataaccatgaagcactgtctgaatgtcaagggcatccaagtgccccatcccctgcccacaagtcctggagtaacatccaaggatgccttccttccccaggacgctggcgcaggctcaaccccttgcaagcctttggtgactcttgattttacgacaaatacatcttttgtctcttctgttttcaggacttcaactaaccaactaaagaactgttccccagagcattgttcctgagaaggaaaagagtccaaacacctacccacacctgctttgtgccaagaatccacagttggattgcaaggacagtgtatgttgtccttttggaaaaatgagagtgagcccaaatgaagaacaagcaaaggtgtctcaagtcatcccaaggcaactagggggttgcctgggctgtgacggcctcacttctgcatgagactctctctctggcttttcgcattaagtagcttcctgtccttctctgtaaaacaaaatgaatgagctgggtgcggtggctcatgcctataatcccagaactttgggaggccgaggtgggtggatcacctgaggtcaggagtttgagaccagcctggccaacatggtgaaaccccttctctactaaaaatacaaaaaaaaaaaaaattagctgggtatggtggcaggcgcctgtaatcccagctacttcggaggctgaggcaggagaatcgcttgaacccaggaggcagtttgtggtgagccaagattgcgccactgcactccagcctgggtgacaagagcgaaactcagtttcaaaaaaaaaaaaaaaaaaaaaatgaatgaaggtataatctggcagggtgcggtggctcacacatgtaatcccagcactttgagaggccaaggcgggaggatcacttgagaccaggagttcgagaccagcctgggcaaaatagagagatcccatctctaccaaaattaaaaaaaaaaaaaattagcctgacgtggtggtgcatgcctgtggtcccagctactctggaggctgaggtggaaggatcacttgggcgcaggaggtcaaggctgtagtgagcccatgatcgcaccactgcactccagcctgggtgactgagtgagaccctgtctcaataataataataataatataaataaaaataaaaataaagagctggctgggtgtggtggttcatgcctgtaatcctagcactttggaaggccaaggtgggcagattacttgaggtcaggagttcgagaccagcctggccaacatggtgaaaccccatctctactaaaaatacaaaaattagccaggcatggtggcaggcaactgtagtcccagctactcaggagactgagggacgagaatcgcttgaacacaggaggcggaggctgcaacaagaggttgcaatgagccaagttcgcaccaccgcactgcattccagcctgggtgacagagtgagactctgtctcaaaaaaaaaaaaaaaaaaagaaaagaaaaaaagaaaaagaaaataaagagctatccaagtctcaggatcttaaaaggtagatcctggggtttaagcccacttattttacagatgaggcccagagagaggcaaacactttcccaaggatacacagtaatttgtaactgggccaaagctcactatagttaagtctttttgtttgaggtgactgagataatgccatctatgattttttcttttaaggcaaatgctgtgctgatattcctcacagtttgagacttgtaaaatgcctctcttccctgagtacccatctgtcctctactaccctcagggtttgggactgatgctctgcagttgagggacagtgtgcaagattggttaagaatggaggagcctgatttcaaatctcagcttggttagcttacagccatatgaccttgggaagctacttgactgctgtgagcctcagtttcctcatgtgtaaaactgggaaaatagaacttatgaggagttcttgtgaactaatgcctgtgaggtattatatttatagcagtgcctcgcagacaggaagtattcaataaatgctaatttattgaatttaatgacctccaagagagttgcttaagggcaaagtggaagtcaattgaatagtgggtacatcctctctgaaagcaaggctaaaactatgtaaaaaaaagcatcactggaaaggaagaaggaatccagctgcttaagccaagtggagtggctcactcgtgtaatcccagcacttcgggaagctgagagaggaggatcactggagcccagcagtttgagaccagcctgggcagcatagtgagatcctatttccctttttctgagacagaatcttgccctgtcgcccaggctggagtgcagtggcacaacctcggcttactgcaacctccgcctccagggttcaagtgattctcctgcctcagcctccagagtagctgggattacaggcactcaccaccacgctcagtaatttttttagtttttcttttttcttttttttaagacggagtctctctttgtcacccaggctggagtgcagtgacatgatcttggctcactgcaagctctgcctcctgggttcacgccattctcctgcctcagcctcctgaatagctgggactacaggtgccagccaccacgcccggctaatttttttgtatttttagtagagacagggtttcaccatgttggccatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggcgcctgtagtcccagctactcaggaggctgaggcaggagaatggcgtgcactcgggaggcggagcttgcagtgagccgagattgcgccactgcactccagcctgggcgacagagagagattccatctcaaaacaacaacaaaaaacaaacaaacaaacaaaaaacagaaaggaatccagctattagcaaaattcaaatgaattgtggatttttctgttattaaaatgtagagatatcaggatccctaaactcaagtaaatgacacaataaacgaagcatcaaatttgaagctgtgttatgatggtgcctgtgccagatttgggggaagggcaatacttggcttacacagatgctctagatcttgaagagggagagaggggcacagttctgcggcgacatgtgcgagtaccagagagagggccagttacttcggggtggagagtatatggagaatggaatgactagctataaaccagcttgcatggtgggctggtggaaacaccagtttctacatgacctctagaccaaacactctctagacaaaaagcaactctgctttgaatgaccttcaaagcgaatgccctgggccagtcccaagggttccttcccctcctcctactccgtctcctgggtaacaacattgtaagactgggaagaaaggaggtgatagcataatcttctctgtcatgttacagacccagggagcttttaagaaataaataccaatgggaaagaggtaacatgcattctctgcaagtactttggtaactcatagcagtgttttaactagactcgggaagttgcctggggatcagaaaggaaggcaaaaatgtgtgtggaatttgtcaaaatttgttaagcccatatagcataataaggagaacatctatctataaaaacaaagttaaatcataaattatagctgagtacagtggctgacacctgtaatcccagcactttgggaggctgagggaggagaatcgcttgagcccaggggtttaagaccagcctgggcaacatagtgagatcccgtctctacaaaaaattaaaaaattagccagctgtggtagtttgagcctgtagtcccagctgcagaggctgaggtgggaggatcacttgagctctgaaggtggaggctgcagttagtgtgattgcactactgcactccagcccaggtgacagagcaggacgctgtctcaaaaacaagcaaacaaataattgcaaggcatatattttatttttagatcacgctttacttttttttttttttgagatggagtttcgctctcgttgtcctggctggagtgcaatggtgcaatctcggctcactgcaacctccgcctcccaggttcaagggattctcctggctcagcctcccaagtagctgggattacaggcatgtgctaccatgcccggctaattttttgtatttagtagagagggggtttcacctcgttggtcaggctggtctcgaactcctgacctcaggtgatccacccacctcggcctcccaacgtgctgggattacaggcatgggccacctcatgaggcgcctggcctcatgctttgctttgaactaggggaaccatcagtgcctctgtcgaggaagctcatagagaaaccagggacaaatcctagaaggctttacgctttcagccagggctctccatatcattttggttatgcactccatcagtaaaatatttttgtagacacattgtattagtctgttttcgcactgctataaagaaatggccctcaattatgtcataataacatcacacaagtatttcagttgaaaaaaaagaaaagaaagaaaaagaaatgcccgagactgggtaatttaaaaaggaaagaggtttaattgacttacagttcagcatggctagagaggcctcaggaaacttgtaatcatggcgggaaggcaaaggggaagcaaggcaccttcttcatacggctgcaggaaggagaggtgcagggtgaagggggaagagcctcttataaaaccatcagatctcatgagaacccactcactatcacaagaacagcagggggggaaccgcccccatgatccaactccttccacctggtctctcccttgacatgtggggattatggggactatggggattataattcaaaatgagatgtgggttgggacacaaagcctaaccatatcacacattcctcagtacatatattttaattattttgagattatatatctttatgagtccacttatgcgaaatggccagaaggcaaattcacagacacagaaagtagattagtggttgccaggggctgggggaaggatcgaatgagaatggctggtaatgggtatgggtttccttatagagtgatgaaaattttctggaattagtgatgatggttgcacaaccttatgaatatacagaaaaccactgaattatacactttaaagggtgagtcttttggtatgtgagttatagctcattttttaaaaaatcacatataaataatgtgtacattataaagaatagccttaaaaagttatagggtgagattttaaaagtcgtaagtagactgaatgcagtggcttacacctgtaatcccagcactttgggaggctgaggcagggtaatcacttgagaccaggggttcaagaccagcttgggcaacatagcaagacactgtgtctacaaaaaaaaaaaaaaaattaaaaattaggctggcatggtggcccatgcctgtggttgcagctactcagcaggctgaggcaggaggattgcttgtgtccaagagttcaagtttgaggctgcagtgtgctacgatggcaccactgcactccaacctggtcaacggactgagactctgacttggccttttggagatgtctttgctaatttccacttctattggatttcctctccaaagcatgactctttctttggacatagtcataagcagagaaggttgtagttggtgacgaggtaccacttccagaccaggctccagggaatttcttctagaatgacaggctgccagaaaccttgactgggtgcagtagctcaggcctgtaacccagcactttaggaggctgaagtgggaggtttgcttgagcccaggagttcgaaaccagcctgagcaacagaagctgcagtgagctatgatggcgccactgcattctagtctgggcaacagagcaatactctgcctcaaacaaacaaaaggagaaactttatgacattttacctgggtttacgaatactctagaaatgtgtctgcactatgtcttggttctcagtattagggtgtttagcttcctaattggtgaggacaaaaatgagaccgacaatcctctgaccctgccttctttgaacttggcctttctctaggcgttcaagacccagctgttgagagtagaaaagcagaagaaaggacccgaggtcagcaagtgccctccccacaatggggcagatctgccagcgagaatcggtaagctctggtgtttctttctttctttctttttttgagacgtttttgttccatcgcccaggctggagtgtagtggcgcgatctcggctcactataacctctgcctcccgggttcaagcgattctcctgcctcagcctcccagtagctgggattacaggcatgggccaccacacctggctaattttgtatttttttgtagagatggggtttctccatgttggtcaggctggtctcaaactcctgacctcaggtgatccgcccacctcggcctcccaaagtgctgggattacaagccgctctggtgtttctttagcttctcagagggctcacatgtaccatagcctgctcaacctgctctccctggcagaggggtgtgttggggtccatcttagaggagggaaaactctgaccaagagcacagcaggaaagcgtcatgaggcaaggcaggagccccctcagacccagcctctaagtcttggtgcagcaggggccacttgtgttctgaccaagggaagcccagaggatcgttctgtatccccctggttaattgctttttagacagttatgctgcgaagtcatcagtgtgtgctggaaataggagtttggctttttcttctctaagagaagccccctctggctgaattttatattgccatgtaaaaatgggcttctgcccattaaaaaaaaaaatttttttttttttttgagatagagtctcattctgttgcccaggctggagtgcaatggcatgatctcggctcactgtaacctctgcctcctgggttaaagtgattcttgtgcctcagcctccctagtagctgaaattacaggcgtgcgccaccatgcctggctaattttgtatttttttgtagagatggggttttgtcatgttgcccaggctggtctcgaaaccctggcttcatatgatccgcccacctcagcctcccgaagtgctgggattataggcgtgagctactgcacccggccaatttttttttttttttttttaaattttaacagagacaaggtcttactatgcttcccaggctggtgttgaactcctggcttcaagtgatcctcccacctcatcctcccaaagtgttgggattacagtgtgagccactgtgcccagcccagaagcccgttcttacatcttaaagagctttgattctccccctggatgttgaaataaaccctggaaaatgtttataggataaattatgttctgagtagcgggctcatttcaaattaatctatgctgtaggtgggtccctctgaagcaaggactacagctgttccaccccgccccccaccaacagaacaatctgggaaattgagacacagtgggcttgatctcaaagacaaacacagtgctcatactaactgagtgccctgagcccagaacactctcagagccccatttaaatcactgcagtggcctggcctgtttgctttatgaagactttcccctggtcagcccttgggtggcaaattaattcctgattagtatctgaaagtggacaatacaagctcaaggagttgcttccacctcgaggcaagaggtgagggtcttgggcacgcctggggtggttatctttccctcagtcctacaagagtagcttacaatgccctcttcagcttctttgagaagggctttgcaaagtccagctcaggtgcatccctcctgcctcccagggtttttcgtttgtttgtttgttgttgttgtttttgaaacagaatttcactcttattgcccaggctggaatgcaatggtgcaatcttggctcactacaacctctgcctcccaggttcatgcagttttcctgcctcagcctccccagtagccgggattacaggctcccgccaccacgcctggctaattttttgtatttttagtagagacggggtttcaccaagttggccaggctggtctcgaactcctgacctcaggtgatccacccgcctcagcctctcaaagtgctgtgattacaggcgtgaacctctgtgctcagcccctctcaggcttttgagaggattgaattctgtcctgttcctaatgcccaactggaagctctcagcctcattctcctttgtggaatccaaggctcctgtgtggttgtcagtggggagtggaggccactaaatacagaaaatcaaaattcctcttagccgttgggtctcttaggcctcttccttttctcctccttcaccccgcaaccagagtgagaaaagttttgcctgctctgggaaagaaggagcccttctaaacctggaagcttgtttgggatgtcattgccacctctcatggcccccttcttgtgcccctgcctggctttgccagtcccaggcagaatgccaccaggaatttaaagcaggccaggccagccttggagaggtggcacaaagcagccagtgtcacaggcgccatgtggcagtcagcaggtttggactcctgcacccagagttcagtgtcaatctgacgacaggccctctttggtgcttggaggtccagggagaggagcacaggttctgggatctcagacacagatggaaatccagcagctggacgttgatttggtcccatcaattagcccagagcagttgtagttcttattgcctggagcctctgtcaatccatgatctttattgtagctgctgccatttaccaagcaaatcctctatgcccaccactcccaaaggcccagtgaagaaggtgtcattcccactttacagatggggaaactgaggcttagagaggttaaattcctttgccaagcttgtacagctggtcctggcagatccaggacataaactcaggactctctcactccaggactgtgctctttctacccaccatcaagctcaaggctgaaagtgaggtgtgtgactccaaccctatcttcctaaggatagatatattttgagttgttccaagcttagaaactcatgctcgggatattgaaatttccactgttagtgtaaggaagggccaaaaattgcatggtccatttggtttctttctcataggtttcctgacaattccaagccccagagagtatttttccctgttgccttactattaattctcatgtaggcttggaagtatctgcaagccttcattagagccatttcagcagggagttggctatcatgggggtgtcagtgtaaggcctaggcagttttggctttgggcatgtggaaaacctgcctggattgttctggaagctcagactgtctatgggatgctattttttgcttccgtagttttcctaggaccataattttttttaattttattttttatagatgggatattgccctgtcacccaggttggagtgcagtggcacaatcatggctcactgaagccttgaactcctgagctcaactgatcctcttgcctcagcctcccaagtagctgggactagaggcgtgtgcccccacaaccagccagtttttaatttttttttgtagagacagggtcttgctatgttgcccaggctgttcttaaatccctggcgtcaagtgatcctcctgcctcagcctcctaaagtgctgggattacaggtatgagccactgcacccagcttaggaccttgattatgtgaggtaggacaagaagtgctggaaagatcatccctgccctccaggggagatacacacatggattacccctgattcttacagggactacctgcatgtccatgggctgctatgcaagcttccaggaacttcagtctccttccttatagagtgggattgccccttgtgctctgtcactctgggttccatcccttctcacccactaatagtggggaggaagaagaagagctaatatttatgctgtgctttctgggtctgggcactaagataggaggcactttacaggttgttattacagataaagggctgaggagggcctcagtatttgtattcgtatttttcccccagttttcccccaacctccaatgctgcagagatacctgcaggggtgagtggagattgacaatcagaatcctatgagatctccaagttgagagcagagtcctttgaagtccctaggcgtcaccaatatacttgagtttgggctacatctgttctgacttggggctccccagaaagtttgtctctagcagccctgagattggttgggaccaggacccaccctatcccctgctagtggtaggtggaaaggtggggtgaggctctaatccatctgattcatctcccctttcactggacaagactgatttggcctccactggctccagagcaggcatgctggctacactcccaacactcatttctggaggtgtgacttgagcccattaccaagcatttttattcacccccctgctccctatctggcatcttctgtatgtggggacgtttatcaactctgtgctccttgggtagccttcttctgtgcccagtgacacaggacagctcagttcccagcctcagccagatgccctgggcatgttaggcaggtgggctggtactcacatgtgcctgaggttcccagcctcagttcacctccaataggtctaggtttccttttccatgaagtattccagcaaccagaaagtcaagcatctaaacaggccagcttgcacatgatttttggagatactggaggaggaaggaagatatctccaagatatgtatgcactgtcatttctgcctccaaccttgaaacccttctctgtatcagccagcttttgctatgtgtgtggtgtaataaatcaccttaatacttagtggcttaaaacaataatctcttatttaccggcaatcctgtgagttggtaatttggactgagctcacctggaacggctcttctctgtcccatttactgtcagactggctccctcagaggtctgcaggcagcttgaggtctgtggcttctcttccacatctgaaagttgactggctgtaggcaagggtggtaactgggccatgtgccacacatgttcagcagaataactggggctcattcacatagtggtggttgcaagggttccaagagcagcatgggaagtcaagccccgaagcacaagcatatttctttcttttttttttttttttttttttttgagacagagtctcccactttggctcaggctggagtgcagtggcgtgatctcggctcactgcaagctccgcctcccgggttcacgccattctcctgcctcagcctcccgagtagctgggactacaggcgcccaccaccacgcccggctgattttgtgtatttttagtagagacggggtttcaccgtgttagccaggatggtctcgatctcctgaccttgtgatccacccgcctcggcctcccaaagtgctgggattacaggcgtgagccaccgcgcccggccctgcacaagcatatttcaagtgtctgtttgcatggcattgctattgtcctatgagcccaagcaagtcacatggccagttctggagttgctgtgagtggagactatgtaaaagcatgggtatagggaggagaattagtgtggctgttttttgcaaacaatttaccacaccctccctatccattcagctatcatcaggaaaaaattcatatgagcttttctcttgattggcagcagcttccaaaatttgtgaggcaaaggaagttataaaaaagcagaatctgccaggggcagtggctcacatctgtgatcccagcactttgggaagttgaggcaggtggatcacttgagcccaggagtttgagaccagcctggtcaacacagagggactccatctgtacaaaaactaaaaaatgtggccaggcacggtgcctcacacttgtaatcccagcacttgggaagctgaggcaggcagatcactcaaggtcaggagttcaagaccagctgggccaacatagagaaatcccatctctactaaaaatacaaaaaaataattagccgggtgtggtggcggatgcctgtaatcccaactactcagaaggctgaggcaagagaatcgcttgaacctgggaggcagaggttgcagtgagcagagatcatgccactgcactccagcctgggcaacagagcgagactccatctcaataaataaataaataaataagccaggtgtggtgttgcacacctgtagtcccaactacttgggagggtgaggtgggaggattgcttgagcccgggaggtcgaggctgcagtgagccttaatcatgccaccgcactccaagcctgggcaacagagagagagagagagagagagagaaagagagaccctgtctcaaaaaaaaaaaaaaaatagcgaggggagggcagaatgctaactcatctttcgcagaccctgccaagagctggtcactgcttgatggccatgttgcctccttgctcatcagggaagcattgcatcttcagggtgggagacacagcggggcctgcggttcagtagggattagatgcctgtgctcccacagctcctctccaggcctctgccgcagctccggtgctgctgcgcttccattactgaccggcacatctgtctttcttagtggattgtgggctccttgagggccgaaccacggttgtctttcatcttggactctccagcttccaacacagtgcctggtacatttgtaagaacctagtgtttgtgtgaataaattcatgaattgcacatgactgagctctgctgcatttcatccagagaactggtaatcatgatagaatttgcttagacattccaaggttacttgtaattacttttgttttctgagcgtgattgattagttataagcatcaatatgttgtgaatgcaagttgctaaaatgcatttgtaacactttacttgtcctgtctttctctaaggctacagcagctgaaaaaccaaaacttcatctacttgctgaaagtgaggtaagaaagctatttttttttttatttccttctgtaacattttctgtaaaagatagtgcgtggcaatcccctttgggataatgattttcagccagccaagcagctgtgcagtggcttctccagggtgtggagcagtattgacctccaacttgctccctgctggactcagtacacctgaacagggaaggtgctttccaagggtgcctagtaacagaggcccccttcttagccctttcttggaagcagaatgctaattgtcagagccaaacacaaggccttcctgccttggggatgcatggtgtcctgattgtgagagaccctgggaggggaaatggaagggtctctcccctcccgtcttttccattttacagtcaggcatgccagaaacttggcacccatctgctctgcacttcaatatggacaagtttcagatctttcctgtcgacatatcccatttagccccaaatcaaagagtttcctgcgctgtttgtgctgacctaccctcttccctcccattccccaagcacacagcttactatctctttaaagtggcaacagagtggatctgagatgggttgcttcatgcgaaggtggtgaggtgtacactttatgaatcagcttgggagaaaagcacagaaactctcgatttcccctgtgtccggggccattacctagtcccaggtgacggccaaagctgggtgtggattcaacctagagccccagagctctgccctgctcctcattccactgattgcgtagctatattcttgttcttttgaaaataaataagactcggtctccagcctcaaaagacttaatgactgagaagtgaagctcaatattttttcaaaagagaaagttacaacataggtgaaacgtgctttaagagccgggtgagggagtggtcaaccccgtcttgggtccagataacaaaggctggatagaggtgatgagatttgcagagagtcttgaagaagaggaaagcatgtgtcaggcgaggaagggcatttcaagcagagagagcagcatgtgccaaaacagagcctgcaaaaatgggaaaaagctggggagactgaggaggttggatgggactgggattggttgtccagttgagaaactctgacagcatggcctgaaggatcctctaggctgaggagtcctgtgattacattgttttctgtctggcagtagcaaggagcttgagctggaggaagccttgggcatccaggaaaccagagagggggtagggggcataagtgtagtgagacctccaggatgtgtgctgtgcaagatgatctacttcccagtgggaagaaagtacagttgaccctgaagcaatgagggggttatggacactgaccacccccacatcatgcagtagaaaatccatatataactttctactcccccaaaaccaaactgctaaaactactgttgaccaaaagccttactgataacataaagtcaattaacaaatattttgtatgttttatattctatattctgtattcttacaataaagtaagctagagaaaagaaaatgttattaagaaaatcataaggaagagagatagatttactattctttaagtgggagtggatcaccatgaaggtcttcatccttgtagtcttcactttgtgtaggctgaggaggaggtagaggagggcttagtcttgctgtctcaggggtggcagaggcagaagaagatccaggtgtaagcaaactcctgcagtgcaaaccggtgttgttcgagggtcaactgtattacaattccattgtcaccaactttttaaagacaaatcaacgttggtggccttgcaggtacccaggactctcacaatgaggaggggttgatagtggccccctcctttatttcctagaccatctttagcatattctgaagcatcgcagctttagaattgcttggttgaggccggatgtggtggcttattcctgtaatcccagcactttggaaggccggggttggcgtatcacctgaggtcgggtgtttaagaccagcctggccaacacggtaaaaccccatctctactaaaaatacaaaaatttagccagacatggtggtgtgcatctgtaatcccaactacttgggaggctgaggcacgagaatcgcttgaacctgggaggcggaggttgcagtgagctgagatcctgccactgcactccagcttgggccacagagtgaaactctgtctcaaaaaaaaaaaaagaaaaaaaagtgcttggtcgggccaggtgcggtggctcacgcctgtaatcccagcactttgggaggccgaggcagatgtatcacctgaggtcaggagttccagaccagcctggccaacatggtgaaaccccgtctctactaaaaatacaaaaattagccaggcgtggtggcaggcacctgtaatcccagctactcgggaggctgaggcaggagaaatgcttgaacccaggaggcggaggttacagtgagctgagatcatgccattgcactccagcctgggcaagaagagagaaactccatctcaaggaaaaaaagaaaaaaaaagaattgcttggttgaagtagtcttatgtatcatgttatttgggtttaattagactgatcctcacaaaataggcaagtggttttaaaagatttctgcataaaaaatgtgggttgagacaggtgtagtgactcatacctgtaataccagtgctttaaaagaccaaggagaggatcacttgaggccagggtcttgagaacatcctgggcaacatagcaagacctcatctctaaaaaaaattgtaaaaattagctgagcatggtgatgtgtgcctacaatcccagctacttgagaggctgaggcaggagaattgcttgagtccaagagtttgaggctgcagtgagctatgatttgtgcccctgcaccccagcgtgggtgacagtgagaccctgtctcttaaaaggaaaaaaaaaagtagaagcttttgaagctaacacaaatgaacaatgagaaaataagatggctgataattttcctacccctggtacagactattcagctacatcatggggttgaaagaagataaagatcttattagatataatgccaagtcagtcaaaaaattaaaaattagcaggctatttaaattctggctttacatatgatattgttaatgatgaactaatcactatgtgtacagagtgccttgagagaattagctaatgacactactaggccaccaaattttaaaatagttcatctttatctctttatttatttattttttggaaacagagtctcactctgttgcccaggctggagtgcagtggcatgatctcagctcattgcaacctctccctcctgggttcaagtgattcttctgcctcagcctcccaagtacctgggattacaggcgtgcgccaccatgcccgacctatgtttttattttttttaaatgaaagtataatttactaccagtcaaacacacaaattctgtaagcttaataagtgtgttgttgttgaaacagggtctcgctctgtcatgcaggctggagtgcagtggtgcgatcttggctcactgcagcctccaccccgtgggctcaagtgaccctcccacctggtctcccaagtagctgggactacagccatgtaccagcctgcccatttttttgtttgtttgtttgtggtttttgtttgtttgtttgtttgtttgtttgagacggagtctctctctgttgcccaggctggagtgcaatggcgtgatctcggctcctgcaaccttcgcctcctgggttcaagcgattctcctgtctcagcctcccgagtagttgggattacaggcgtgcgccaccaggcccagctaatttttgtatttttagtagagacggggtttcaccatgttggttaagttggtctcgaactcctgacctcgtgattgcccagctcggcctcccaaagtgctgagattacaggcgtgagccaccgcgcccagctttgtttgtgtttttttgagatggagtctcactctgttgcctgggctggagtgcagtggcgcaatctcggctcactgcaacctctggctcctgtgttcaagcaattctcctgcctcagcctcccaagtagctgggattacaggcgcctgccactacacccagtaattttttgtacttttggtagagatgaggttttaccatgttggccaggctggtcttgaactcctgacctcatgattcgcctgccttggcctcccaaagtgctgggattacaggcctcagccaccgtacccggcctatttttaattttttttttcagtagagacagggtcttgccatgttgccccggctggtcttgaactcctgagctcaagcaatccacctgcctcagcctcccaaagtgcttggattacagatgtgagccaccatgcccggctgtttaagaagttttaacacacgtatacacctatgtaaccgttgcccagttcaagatatagaacattttcatcaccccccaaaatcccttcacagtcttttccagtcaatacttcccatttcctgtcctgacagtatcactattctgacttctatcaccagagcttttccattcttgaacctcatataaatataatcatacatatgtactctcttgtgtctggttttaatattttaatgttgctgcatatatcaaaaggttattcctatgtaattttgttttttgcttttttttcatgaggcattttatttgtaaatatgtataacatctctagaaaaagaatcccaggattttccttcctgtgtgttttcgtcttgcttctttatggtccatgatgccagctgagactgtcagtacaatgaaatcaaactggccagatggaagcagattattctgcatttctctagatctttgagttgcacatcaaatctggggctgatcatgccacacttgtttagactgcctgtgaggttcacaacaatttgcctagctctgtgatcatccatgatttcaaattcgccaatataaccatgcttcatcatcacagtgagaaaccagacgatgactttggagcatggcctaagaacctggtgtttgtctctcttttcagcattgttgatgctcttgagagcatcagccaggacattaatgtgcaccactgtggtggcgtggaaagatggcaaaaagagccctgcgtgattttgtacgtagaaaatcctagaatacccacaaaaacctattagaactaataaacaatttcagcaaggttataggatacaagattaatatacaaaaatcaattgtagccaggcacggtggctcacgcctgtaatcccagcactttgggaggctgaggcaggtggatcacaaggtcaggagttcaagaccagccttggtttcagactggtgaaacccagtctctactaaaaatacaaaaattagccgggtgtagtgttgggtgcctgtaatcccagctactcgggaggctgaggcagataattgcttgaacctgggagatggaggttgcagtgagccgagatcacgccactgcactccagcctgggtgacagagcaagactccatctcaaaaaaaaaaaaaaaaattaaattgtacttcttctataaaattgcaatgaacaatataaaaatgaaattaagaaaacaattcctggctgggtgtggtggtgagtgggtcacctgaggtcagaagtttgcaaccagcctggccaacatggtgaaaccccatctctactaaaaatacaaaaactagccagttgtggtggcacacacctgtaatcccagctactcgggaggctgaggcaggagaattgcttgaacctgggaggtggaggttgcagtgagctgagatcacaccagtgtactctagcctgggtaacagagtgagactctgtctcaaaaaaaaaaaaaaaaaaaaaagaaaagaaaacaattccatgtataatagcatcaaaaagaacaaattacttaggaataaacaagagaagtatagacttttactctgaaaactacaaaggattgttgaaagaaaataaagaagatctaaattaatggaaagacatcccatgttcatggattggaagacactattgttaaggtggtaaactccccaaattaatatatagattcaacccaattcctatgaaaatctcagctggcttctttgcagaaattgacaagctgcttctaaaattcatatgaaaatggaaggggtgccgaatagccaaaacaatcttgaataagaagaaagagaactcacatttcctgatttcaaaactttaaaagcaggctgggtgtggtggctcacacttgtaatcctagaactttgggaggccgaaacaggtggatcacctgaggtcaggagttcgtgaccagccttgccaacatggtgaaaccccatctctactaaaaatacaaaaaattagccaggcgtggaggtaggtgcctgtaatcccagctacttgggaggctgaggcaggagaatcacttgaacctgggaggcagaggttgcggtgagctgagatcacaccattgcactccagcctgggcaacaagagcgaaactccatctcaaaaaaagaaaaaaaaaacttataaagctacagtaatcaagacaatgtgatactaacattaggataagtatatagctgcatgaactgaaattgagagttcagaaataaacccttacatttatggtataatgatttttttttttttgagacagagtctcactctgtcgcccaggctggagtgcagtggtgcgatctcagctcactgcaatctccgcctcccgggttcacaccattctcctgcctcagcctcccaggtataataatttttgacaaagatgtgaaaacaattcaatggggaaagaaaagcctttcaacagatggtgctaagactctgtctctacaaaaagtaattttaaaatttcctgagagtggtggggtgcatctgtggtcccagctacttgggaggctgaggtgggaggatcacttgggccctggaaggtcaaggctgcagtgagctgtgattgatccactgcactccagcctgggcaaaacaatgggaccctgtctcaaaaaaaaaaaaaaaaagtttgtaggtttcatttgtttgctttgtttgtttgttctgagatacatttacaggtagaattcttagggtttggtaacaggttacatgtggagcccatgggagtggaaggagttcaaggatgatggcagattttcagcagaggcgatgaggggctagttctgcctggaacactcttttcctagacactggcatagtgtccctcatcttattctggtttctgctcaaatgccacatcttcagaggtccttccctgtccatcctgactaaaatgaaatccctaccctttatttgttcaacgtgtgtatcagttagtattagatttggctggcagtaacagaaaactccaaaatagcatttggataaacacattggaattttgtttttctctcaaattttagaaatatagaggtaatgtggtggggggaggggggaggctgatatggggcagcttgatgacaaggatgcaggttctattctattttgttgctttgttttgtatgggcatcattcccagagttatctcttttttttaattagaataacacacatgtattatctacgatttttgtaaccacccagagggttcactttgcccactgcctagacagagctgatttatcaaggtagagaattgcaatagagaaagagtaactcatgcagagctggctgtgtgggagaccagagttttatcattactcaaatcagtttccccaggactatttctctattgcaattaaatccatgcaccatgggtcagcagtgaccggcctgtagagacagtagcggagtcaacccccagtccaagagaagtaggcggccacttggactggcctctggatccgtcaccagagggaggctaccgaaccaggattacccttatggcaggtagtcttaagggcaatcctggacaagctcccaaacttgtaaccgcccaacaggttcaccttgcccactgcctagacagagctgattcatcaacaggggaattgcaataaagaaggagtaattcactcagagtcacctttgcgggagactggggttttactattactcaaatcagtctccttgagcatttggggattggagttttaaggataatttggtgggtaggaagcagccagtgagtcaggagtgctgattggttgggtcagagatgaaatcatagggaattgaaactgtcttgcactgagtcagtttctggctgggggccacaagatcagatgatccagtttatcaatctggggggtgccaactgatccatcaagtgcaaggtctgcaaaatatctcaagcactatcttaggctttacaatagtgatgtaatccccaggatcaatttgggagggtcagaatcttgtagcctccagctgcatgactcctaaaccataatttctaatctttttgctaatttgttagtccttcaaaggcagtctgatctccagacaagaagagggtttgttttggaaaagggctgttatcatcttgttgtatttttatttttattatttatttatttatttatttatttatttatttatttatttttgggggacagagtctcgctctatcgcccagaatggagagcagtggcccagtctcggctcactgcaacctctgcctcctggattcaagcgattctcctgcctcagcctcccaagtagctgggattactggcgcccgccaccacaaccagctaatttttgtatttttagtagaagcagcgtttcaccatgttggccaagctggtctcgaactcctgacctcaagtgatccgctcgccttggcttcccaaagcgctaggattacaggcgtgagccactgcgctcagcctcatctttgttttaaactataaactaagttcctcccaaagttagttcagcctatgaccgggaatgaacaaggacagcttggaggttaaaagcaagatggagttggataggtcagatctttcactgtctcagtaatattttgccatgggggtttcatgtttgtgggtcaggagttgggataagctgagctaggtgtcctgccttgggtcatgctttcctgctcatgtggttgtttgcagcgttcggttccttgtagctgtaggattcacatcttgcttcttctgagaggcctggaggctagaagtccaaattcaaggtgttggcaggcttgtgctccctctgaatcttggagaagaagaccctcccttgcctcttccagcttccagtggccccaagcgttccttggcttgtggcagcatcactcccatccctgcctgcatctttgtatggtcatcttctttctgtgtatgtcccttcacatggcgttctccctgtgtgtcccaaggttatctcataatccaagatgattgcaggatctccagccactctgcctgtcctccagtcagcgggaaggaggaatggcaaagaagcaggaaagccacagaatagctgtgtctcttaagggaggctccagaagctactgagacactctcactttcatctctggccagagcttggtcacatgcctgcatccgactataggggaggctggaaatggaatctttattctgggaggcctgagttcacctaaaaattggagcattgattagtttattaggacaaaggggaaatggatattgtgggatacagctgtgtcagctgcgcctgccttttctcctagtgcctggcctaatgtatatttaattagccatttgtttaccatctgtctctcccgatcagaatgtgggctgtgtaaaaccaaagaagaaaactgaggtaccagttaaaaaaaaagaaaaagaagaaggctgggtgcggtagttcacacctgtaatcccaacactttgggaggccaaggcaggcagatcacctgaggtcaggagttcgagaccagcctggaacatggtgaaaccctgtctctattaaaaatacaaaaaattagccaggtgtggtggcatgcactgtaatcccagctactcgggaggctgagggaggagaatcgtttgaacccgggaggcagagtttgcagtgagccgagatgatgccactgcactccagcctgggcgacagagtgagactctgtctcaaaaaaaacaaaaaacaaaacaaaaaaaacaaaaaaaaacaaaaaataagaaaaagaaaaaaagaagaagaaaatgactgaggtgagtctcaatcaatttagagttaattttgccaaggatgagaatatgcccagaaaaaagagacataagccacagtaggatctgtgacccacactttttccaaagagggtttgaggacttcaatatttaaagaggaaagggtggggctgggtgcggtggctcacgcctgtaatcccagcactttgggaggccaaggcgggcagatcatgaggtcaggagattgagactatcctggctaacagtgaaacaccgtctctactaaaaatacaaaaaaaaaattagccacgcattgtggcgggcacctgtagtcccagctactcaggaggctgaggcaggagaatggtgtgaatccgggaggtggagcttgcagtgagctgagatcgcaccagtgcactgcagcccgggcgacagagtgagactctgtctcaaaaaaataaaaataaaataaaataaaaaataaataaataaaataaaaaataaagaggaaagggtgagcagtgcaggaaagaggaaagggaaaaaagggaagggtagataaaagagacaaggggttgcattcttttgagactttgattagcttagtgttccctgaacccacagttcacatgtgaaatgaggagggtggaggaacagtcagctatgcattcatactcagtgaatgtgcatttttacataagtaaagtaagcatagaataaaggaagcagtcaaatatgcgtttggcgcaggtgaaggaagggataacttctagtccagtccttgtcctgtacctgtgatggtaagctgtcagtgtacattgtttgggtgaaattcaacagaattctgttttagggtaaagggatttcctcatgagcaaattgtgagggaagccccctgggaagatatgtggcctacctttgcagctacctatgtagggacaaaatgggaggtgttttgggtgacacagttcccaagctaaacactttcctttggcatagggagtttgttggatttttgggttgttcaccacatttccagtgactaggaaagtgcagggcagattaggtgtttcacaaatatgtgttgggtgaataaatgacaaggaggggaattgagaagagtaagtttaaggagaagaacatgactgtgttggaagatactgagtttcgggtgcccatgggacatataagacttgattctcataggcagctggaaatataatcacgaacttgggagggagatgtggctgaagcccttgacaagagtgattctttgggaagggcatagcgagacagacctacagaaaacagcgagagaggagacatactcagcccactcagtggaatcaacccaagccagaagtctccacccccaccccccgggggagggcaacttcttccataacccacttatagcccctctggccttgcagatctgcctctctgtttggtttgagaattccccttataaaggaactctgcagggcccagatccacttgccacgctttaggaatctaagccacgactcagtctcctcggtgcaggttcttggaccccttcactggacctgagtgaaataagagaaataaggacaatatagtaaaataaatattgcattttgtcggaatgacaaggtgggctggagacacactgccttggcttggatcccagcttttccattcagttgctgtgtgaccttgagaaagtcacttaatcaccccgtgattcagtttcctcatctataaaatggggatattacgagtatccacctcattgtgttgttttaaggatcaatcagtcaataaataagtaaataatttagaacaatggtgtatagtaagttctacctaagtgctagctattaatataaagccaaatgtatttagcttacaaagcaaccattatttttacttctctgttttaaaatatattttcttttctttttttttgagatggagtctcactctgtcagccaggctggagtgtggtggcacgatctcggctcatggcaacctctgcctccccggttcaagtgattctcctgccccagcctctggagtagcagggactataggtgcacaccacacgcccagctaattttttgtatttttaatagagacggggtttcatcatgattgccaagctggttttgaactcctgacctcaagtgatcgacccacctcagcctcccaaagtgctaggattacaggtgtgagccaccacgccccgcctaaaatatattttcttttaggaaagcggttcccaacctttatggcactaggcactggttttgtggaagacaatttttccacagacccgtgtgtgtgtggggatggtttcggggtgaaactgttccacctcagatcattatgcagcaggacaagctgcagacaaaactcctcagacaccgagttaaagaaggaagcggtttattcagccaggagcatcggcaagactcctgtctcaagagccgagctccccgagtgaacaattcctgtcccttttaagggctcacaactctaagagggtccttgggagagggtcatgattgactgagcaagcagggggtatgtgactgggggctgcaggcactggtaatcagaacaaaacagaacaggacagggatttttacaatgcctttccatacaatgcctggactctatagataacataaacggttaggtcaggggtcgatctgtaactaccaggcttaggtcaggcagggccaggcctggtttcgggtctggttccttgctttcgggtctggttcctgggcgccaggctacctgcctttagttttgcttctctttctttttctgagtataaaacaatatgagagggtctgtctctcttctctcaattaggcactagattctcataaaaagtgcacaatccagatcctttggatgagcagttcacaatagggtttgtactcctacaagaatctaattgcactgctgatctgacaggagacagagctgaggcggtaatgctcgctcacctgctgctcacctcctgctgtgaagctcagtccctaacaggccacagaccagttggggaccctactttaggaaattatgattataggatatgaaaatcatacacctaaaaaagatcctggtctggcatggtggctcatgactgctaatcccagcactttggaaggctgaggtgggcggatcatgaggtcaggaaattgagaccatcctggctgacacggtgaaacccatctctactaaaaatacaaaaaattagctgggcgtggtggtgtgcacctgtagtcccagctcctcgggaggctgaggcaggagaatcacctgaacccgggaggcggaagttgcagtgagttcagattgcaccactcggccaggcgaggtggctcactcctgtaatcctagcactttgggaggccgaggcaggcagatcacctgaggtcaggagtttgagactagcctgaccaacatggtgacaccccatctctactaaaaatacaaaaaaaattagccgggtgttgtggcgcatgcctgtaatcccagctacttgggaggctgaggcaggagaattgcttgaacccgggaggcggaggtcacagtgagccgggatcacgctactgcactccagcctaggcaacaagagcgaaactccatctcataaaaaaaaaaaaaagagattgtaccactgaactccagcctgggtgacggagtgaaactccatctaaaaaaaaaaaaaaaaaaatctggccaggcatggtggctcacacctgtaatcccagtactttgggaggccaaggcaggcagatcacttgaggtcaggagttcgagaccaggctggccaacatggcaaaactccctctctattaaaaacacaaaaattagccgggtgtggtggtggatgcctctaatcccagctgcttgggaggctgaggcatgagaatcgcctgaacccatcaggcagaggttgcagtgagccgagatcgtgccactgaactgcaacctgggtgacagagccagactttgtctcaaaaaaaaaaaaaaaaaaaaaatcctttctaagccatataaaaactcagaatctaatttttgtttatatgtttaacttgctgacccatgtcatcttagagcctaggaaccctgcctaggtgttgacatgaactctgtgtgagcattttccagtatatcttggtgctgttgataaagagtcagtctgtaaaatatttgaagagattattctgagccaaatatgagcagccagtagcccatgacacagccctcaggagatcctgagaacatgtgccccaagcagtcaaactacaagtttattcatttcaggaagacaataaaatatcagtcaatacatgtaagaggtacattggttggctgggcctggtggctcatgcctgtaatctcagcactttgggaggctgtggcaggcggatcacctgaggtcaggagttcgagaccagcctggccaaaatggtgaaaccctgtctctactaaaaatacaaaatttagctgggcatagtggcaggcacctgtaatcccagctactcagggggctgaggcaggagaatcacttgaacctgggaggcggaggttgcagtgagccgagactgcaccactgcacttcagcctgggcaacagagtgagactccgtctcaaaaaaaaaaaaaagtgataaggggttgtggagaccaaggttttatacagatgaagcctccagatagcaggcttcagagaaaagattgtaaatgtttcttattagacttagagagtctgttctattctatcagtctgttgatgttaatgctggtcggatgggactgaattccaaaagggatgaaggtatgatgaagtatgtctgacacccccattccatcatggcctgagctagtttttcaggttaactcttgaatgccctggctgagaggagaggttgaatcagatgatgaggaggatggtgggttagaattttatttgtggtttacaatgctaactcgaaggaaaggattgaggactttttcctggccctgtgaaggtcgttgtgtgtgggtgctgggagaactatcccaggaaactcagggtaactggcaaggtgatttgagattgctctggtccaaaagataacgatttcatttggggaaaccatttcctttggagagctggctgagataaggagctagtctgaagcctgggaaggcctcaacaatctggttaacccttcctcctccaggatacaattctttctttttttttctgagacggagtcttcctctgttgcccaggctggagtgtagtggcacagtcttggctcactgcaacctccacctcctgggttcaagcaattctcctgcctcagcctcccgagtagctgggactataggtgcatgccaccacgtgcagctaatttttgtgtttttagtagagatgggatttcatcatattggccaggctggtctagaactcctgacctcgtgatccgcctgcctcggcctcccaaagtgctgggattataggcgtgagccaccgcgctcggcccaagctacagttctttacgcctatgacttttgtcaggctcagaggcaatttaatgaggatgggatgtctagaaagggacagggtgggactcggatttccttggctcttctgaggaacttttaccttcaaaggggagtagaagccactgcagggtggaaggaaaacttccgcttccccctccgtgaatttgctgaaaagtcaacagacaaaagacgattaagagaaaaggcatacacattttctaatatgcctagaagaaaacacagtgattaccctaacccttcaatggagtacagaagcttatatagccttttatttctgagacagaggctcactctgtcacccaggctggagggcagtggcatgagcttggctcactgaaatctctgcctcccaggttcaagtgattctcctgtctaagcctcctgagtagctgggattacaggcttgcaccaccacgcccagctaatgttcgtggttttaggagagagatggagtttcaccatgttggccagcctggtctggaactcctgacctcaagtgatccacccgcctcggcctcccaaagtgctgggattacaggcgtgagccaccgtgcctggccatatagcccttttttttttttctgaagctggtaaggagatggggaatatgctaattctgtaattctgcatgatttctcaggagaaagaagggatcagagaattgagattaacttgtaaatggctctctttggaaactgaataagcccgagagacagacaggcattttatccctctaggggtggtgacattcttcagtcttcttttctgcaatagagaatcagataacgggaaggggaagggaaaaaattgttcccccaggggcatccttctggtcttttggtctttcccctttggaggtggggcagtctcttccagtgtctgttgatctttaagggcctttcattcaaaatactctttacacaagggagccgtattttggggtgaattatgttggtttccttcacctccttgggaggtgggaaatgtgtcctgaaaggtcagggcctctctgagtggagatgaacaggtcagggttgagtaaggaggaggctggcaggggcctttatgatacctgagaggactggggcttggatggagcaagagaggcactgatggagtaagattcaggtacaagacttaagtcttgcatcctaggcacggctcttgcctcatcctcatcccagccctaataatgggaggctttttgccggtaaattcccattattaggagctgaaaatgtcaatgccttacaggcgccagtcagcagtgtcaagcagtgggctgggtggggcctgggctggctggagctcccctaccctgtctaaagggggcggtggctgctcagctccagcatatgcggggaaggcgctggctaagataaggagctagtgccatgatgaccacgttgccacaggatcaagtgggtcctgtgtggtgtcacctttaggtgcctgaaatctagattttattttatttattttattactatacatattttttgagacggaatttcgcttttgttgcccagactggagggcaatggcgcaatctcggctcaccacaacctctgcctcccgggttcaagcgattctcctgcctcagcctcccaagtagctgggattacaggcgtacaccaccatgctgagtagctgggattacaggcatgtgccaccatgcctggctaattttgtatttttagtagagatggggtttctccatgttggtcagtctggtctcgaactcccgaccagatgatccgtctgcctcagcctcccaaagtgctgggattacaggcgtgaggcaccggcctgaaatctagattttaaagtgaaatttcttaatttttttttaagggcaggcacaaatttataaaacatcaggtgggccaaataaaatgttacaggccacagttttagcttggtggttgctgatttactgaccctgttataatattggaggtcaggactttgggcaaatgaaagagaaaaggaggcagactgagaatgtgattttacaactccagcctctccaggggctgggtggccagtgtctcctcagcagccttctcccgcaggaagcagaactgtctgcaacgctgatggagtcacagtaaccttcaccccactgagctcaggatctgcagagccactaagaccctggagcaactgccttcagcatccaacagaagctgctaaaaggattatgggtcaattcattttagacatttcttccagatgttcccatggaaagctagggtctaaatcagtggtcctcattcctggcagcacctgagtttcacctggggaactgttagaaagtgaaacttggacggcattcacattagtccagtctctgggtggggcttggacatcagcatttgtagaagctccctaggtggctttggtgcagccaggttggaaaccactgatccaactaatagaaatgctaggttgggatctcttccgaggcatctctttaggacaggctgtgcatgacagtcccatagtgtcagggttctaagatgctccaatggtttaggcactggtcttaattttcgttttttcgctctctttgagaccttaacaaactctatagggctgggcacaatggctcacgtctataatcccagcatttttttctttttttctttttcttctttccttttcttttctcttctcttctctcttttcttttctttctttttttctgagactgtctcactctgtcgcccaggctggagtgcagtggcacaatcttggctcaccacaacctccacctcccaggttcaagcgattctcttgcctaagcctcccaagtagctgggactacaggctcttgccactatgcccagctaatttttgtatttttagtagagacagggtttcactatgttggccaggctggtctcgaactcctgaccacgtgatcctcccacctcagcctcccaaagtgctgggattacaggcgtgagccactgcgcctggccaattccagcagttttagaggtcaaggcaagaggatcccttgagtccaggagttcgagaccagcctgggcaacatggcaagacctcatttcaatttaagaaaaaaaccaaaacacccaagctctataaccttcacatcctcattgactgattaagtgcagataatgatatttgcccttctaacctcaccaggctgttatcaggagaaatgaagcaataaatgagaaattgctctgcaaactgtcaacgttatgtaaacattgctattcagagtgtgctcccaggtgcgggaggtacagctgttatctgttggagatcactcctgaagtaacattcctagtgccatgggtcagatgggaattggtacagacattccaacttagaaggcagcctttattgtcttataagcaggtgcgtttcctggggtggcagcctggcactggtcactccaaccccaacttgtgtaggaggtaccacagtaaatgagtagagagagttcaggggacttgaagggaagtggagggccatctggagagggagggaactaaggactccctgtgggttggggtcttcctgaggatccagggagtaactgtcaaggagccttagcagggatctaagagctatgcaagagcaaaaagaggcaaattattaaggaaattagtgaagtcagcactggaacaacagagaggggacacagcagtgcagcatgggccctggcctcaggaagctgtctgattggggcagataggaccagccccctagaagacagtcacccatatcagttaggcagtcatgactcagtgttacttatctgaggcccaggttgcatgaggggttgggggtgggatggacagagcactggctgggcatcaggactaggctggagtcctggctcaaaactctaccacaacctgacactgggcaagatggcccacctgtggcatcccaggttcctgccctgtaaagaggagtctgggtgtatatccagatggactgtgagcacagcctgagtttgccctgtcgaggtgctgaggcctgggagattggggtgagtagctgtggtccagggaaggttggcaagctgggccttagatgagaggggatgcttggtcaggcagaggtgagtggagaaggcagggcaaggaagggaatatgagcggcgaacaaatggagtggacatggtgggggcagaggatggtgggaagtggccttgttgcggccagagtggaggaagagataagtgggaaagagtggagtcgattacagaaggcctcggaaaccaggcagagatgtttaaattggctctctcaggaaggagagggccatgaagggatttagggaagggtcatgacatgattatgctgcattttagcaggattaatgtgacctggtgctcagaatgacttggatggcatgaggccaggagccgaggaggacagttagaagactcttgtaatatttctggcacagggagatggactgggagttgggaggtggcaataggtcaggcctagagacatttctcaggaaatattgacaggccttggggcctggttgcattcatggagtggggaggaatgagtcaccttgagaagcagtttccctctcaaaggccagggaagacaaagcagaggcagctttcctgcctgcaaacaggacatttcagggtaacctggctcttccaagcgtcagcttctccctggctccagctcagataggagttgtaacaacgggttgggcatgggtgatggcaccggctggtggctgggttaagggccatgtttttgattatgcattaggcttattcagcctgccaagtgccaggccctgcgcttgtgtaggagacagagcaattagcaaaacatagtcctccatcctcaaggagtttccagccctgtgagcttggcagatctgcagaactcaaatgaaatggcagttgagaacaaccatcttgttctcattcactccattttgcttaacggccatgtaggtagttccaaatgtttgatgtgtaccagaaaatctctctcttcctggtttataattatgatccagggcaaatccaggttttgttgggcttgaaaattaaataaattggcactctctatggaaaataattcaaatataaatatacaaatatcacactgctaggccctcccagggcctagaagggtaggaatgaaagtgagagtccctgaagctttaaccgcattaacttttcagtcagttctatgatacctgccattccttaagtgtgtattatgtgcacgtattttgcgtacagtattacacaacaatcaaggggaggtgaggtgggcattagtgtcttcatcttatggatgaagacacagtctcagaggtgattcaagatgcccctctgcataggccctaaggcagggggtggggactgtgacctggacaggaagctggggcctcaggactgcatctaagctcctccttttctgtgggtgatggtggctgtcaggcccctgaacctacgtcatccctccctctgatttgactgtacctttgctaggcctggtcaagggctagggactcctaaagtcaagagctagggtagaggttgggggttggatctcagggcaccatatggtgcagacttggttgcaggaaagtgacctatttaggcagaggggctctatacaactgggaccacagcaaaccctagaggtgagcacctgcttcaaagactcacagatccaagctgtgatcctagatctacaacttcctggctgtataaagtccagcaagactgaggcctcactgagcttcaatttccttacctgtctaaccagaatagcaacaacttgtttgtatatttgagctcattacatgtcattttgtaaggcactaaagctcctggaggcttccggaacacagaaataattaatctaagaatcctaaagtggctgtcctggtagcacctctagggagtcctcccatcctacgtaacttcctctgggaaagtagaaaacacggcacctgggaaggggcgctgaaccgtgccccaagtcccagtgggcctggatgcccaagagcaagaggaggcccagaggatggggacaggccacgacctgtggcccaagtcccgcccagagggagtgcgccctgagggagagccaccggagctggtgactcgggggcgggtgctctggggtgtcgctttgggttcagcaatacaaatctgccagctggagattaggcggggcacgccggggagaggtgatgcactgccgctgaagacccaggtaggccggtgcgttcggcctgggtgaggaaggcgcgggacccgggtgcgaggactgcgtagcgtccccggctcccgcttccgcccgctttccacgcccacttctgcaagtcccctccggcacctcggcgtccaccggactcctaggggcgagccctcatttccgaggaatgggaccgccttcgtgcccccggggctgccagtccctagactagccctaggggcttctcgtcccggcggagccgggcggtgcctcctgcctgcgcctcgcacctccccgcctggcacggcccacccgggcacggcgccgccacgcgtgaaggcccgcatcggctccctacgtgggggacgtgcaggatgatgcggggtcgggggggatttcgctcgtcgcccgccccctttccggcgcaggagggagcggccgacccgtccccgctccccggccgggacgccaccgccgggcgttgcagaggcgcgccgcaaccaatgggcgtggaggaggtgggtcggctggcggctgtcaccctccaggggacgggagcgcggagaccgggcgaagacggagctgtcgccgcgccccgggccgagggggaggagccgggggaggaggaggaggaggagccgccgagcagccgccggaggaccacggctcgccagggctgcggaggaccgaccgtccccacgcctgccgccccgcgaccccgaccgccagcatgatcgccgcgcagctcctggcctattacttcacggagctgaaggatgaccaggtcaaaaaggtgagcccccgcccgcgccgccgctggtcctggccgcagccttgcgttccggcatccgctcgccgcctccgctgcctccatcctccggcgcccggccttctccgggccagcatcgagttggactgcagggcgcaaggaaagccttcgccttcgattctaccggcattgtcagtgtctctgtgtgtgtgcgtttttgggaggggggcaatcgggcggaagacccccgagaccgggctgcctgctgcagtgtccttgaaacgggccctggatgtcagataggcccccgggctgtgcggggaggtggccggtgggcccttccgcagggcctgttcgggagggtccgagcgccgtgggaggaggtgtgatcatggagatgctggggaggtgatcgagcagcaggcgggggtgctggctggaggccaggcctcccatatttggggttcctggcggagggtgtcgggtgccccggagaagctgtcgccgggctctcccagttgtttgagctgctcgttaatctgaagacgaggtgacccgcccggcttcccggaacggggaggggcggcgaggccaccggaaactttgctcataggcctcgtgtctggagcggcacgtctgaatggaattttttattcctcttaagctgtaatttctagccagcacaggagctcaaataagcgactggtcatttgagttgggtggacgcctgtggcatgcttgttctagcacttggacgcatgcatcctcctgtcctgaggtgttgttgcctttgacatcttagtgtaaaatactgtccgctggcaggtcttaaaggtgtatttgtctcttctgccagctgtgctaccatattttaaagaaacagcctaagctgtagggaaagacgcccgttttatcagtgccaggtctggtacaggctccaggcccacccaccctgaacgtggtgacgttattgctggggttagctgggatggactggcaaagtcatcttgactttggcgttcagacaggtggagttctacaggtgaaaggcaggagtgacaggccttgattttctgcccggcaagccatagggtgttccatcctcttcctgtgcatctaagacgactccctcatctggcaccataggaaacaggcctactgagggcagcgaccttatcaaggtcacccagtgagttagaggcagagccagtcagggggatccaggtctcccagtgcctccacccaggaacttcaccagggtcctcctggaggtcagcttccaggagggagtgggtactgagagacaaagccgctggggaccctgccgtgatcttggatcccatggtgggtggggaccgggagtgaggtaggtaggagataggcttgggaatgccatctgccattgctctttatggctttaagcactctggggttgtcaaaccgtggcactcgaaacacttgctcctatggagcaccctggagcttccctctggccactgacctgggagctgtgcgtgcgggtgtgtgcatttcatgagttttctctagtggtgttgtgcatcactgatgttcttcccattggaccagggagacagttctcccggcatggcaagaagtgcccagaacaggcctcctgaagccaagagttcactgtcctcctgcacgtggtgtcctttatagctcaagacagtgggctgctgggctggggggtgcctgggtgaccttgtaaacctccagtgtccacacccaccaccacccacaacagactgctggctgttggctgccggtggcctccagcagctgagctgggctgaggtttggactccattcagtgggacatgttttctcagacatacagtgtctagggtgggcccagagctctccactcctgtgggtggctcaattcacatctatggatgcacagtctatctcctaggcccccgtaggtacctgagtgtgtgattcagttgacccttccatccctcctcactccgagtttgggattctgatgttcttcccttctcttccccgagaaccttgctggaggaaggtcttaaggccaaggtttccaccagatattatttgtcaaggagattcttaaaaacaagatgtttgcttgcatttcaccacggacttcctatgctgctttctataggggagtacgtggattcctgccagggggtccactcattttgcatagtggactgtgtggcacagccatctgtgggtgtggtcctggctatgattgcgccaccgcactccagcctgggccttctaaggacagtgacatagtgggtacttgctccagtgacctactcagttttgcccaagtgtgcagatgctggggaccacatctgctcttctggggcccaggatttcttagagaccagctctttccacgtaccactcaccataggaaaggctaggtgaaggtgcgggaccccctgttcttcctgtggggctggactctgcctgcctcccagcagggacctgctgaggatggttcccccccagcgtgggcagccatgatgattcagccctccagctgtaggcagcctccggggctctggagacagacctggcatccctcagtaactctcatctatcttcttgccctcagagccagaggtaggagaagggaagctggggaccatgccggggaagtttttgggattgcttagaatccaaacgtgatcatgaaaatggtgtcatttctttcttcattgcctatgaggcacatcaataattcaactccataaaaatatatcctgggttgaaacagttcaggtgtctgacttcccagcttggaaccccattatccagacggcatctgcataaattggttaatgggtgctgttgaagagggtgtactggcattaggctgagctaagcacaaaacacatatattcctttcactcttctagtgcctgtaggaggaaagggaggcatatgtgtgcttgtgaaggattccattcatcagaatcccagacatctgccagttctgcagctagaggctgggttctttgacctctaagtaactttaaacacgcatctcatctcgccagcttcttccactcggtttagccattaggagcttggagcagggtgaaggattgcatagtgctctgtttgtttagaaagggaagatgggtccaggaaggtcagaacttggcttctaaagaaagattagacttcctttcctccaggcttgtcagaatggtgagcaaatgccagtggattttctctgggcgagatccccataacgctaagtgatttccactagtaggtgatcatgaaaagggtgtcatttctttcctcattgccttgaggcacatcaataattcaactccataaaaatatatcctgggttgaaacagttcaggtgtctgacttcccagtttggaaccccattatccagacggcatctgcataaattggttaatgggtgctgttgaagagagtgtgatttgtccaatggccgaactcaggagtccttgagtacttgacccaggaagacaggggagagtaggcttagcaattaaagggttgcccaaggtacattccttagagcctatgtgttccagctgcaaaagcaagcattaaaaataaataaataaataaaaggccgatgtagtggctcacacctgtaatctcagcactttgggaggctgaggcgggtggatcacctgaggtcgggagttcgagaccagcctgaccaacatggagaaaccccgtctctactaaaaatacaaaattagctgggtgtggtggcgcatgcctgtaatcccagctacttgggaggctgaggccggagaatcacttgaacctggaaggcagaggttgcggtgagccgagatcacgccattgcactccagcctaggcaacgagagcgaaactccgtctcaaaaaaaaaaaaaaatgcccattcattattgctcaggggtgagagaggtgatagttagaaaattgtgaaaaatctggctgggcacagtggctcatgcctgtaatcccagcactttgggaggctgaggcaggtgaatcacgaagtcaggagttcaagaccagcctgaccaatatggtgaaatcccgtctctactaaaaatacaaaaattagctggacgtggtagcatgcacctgaagtcccagctactcgggaggctgaggcaggagaattgcttgaaccggggaggcggaggttgcatgagccaggatcatgccactgcactccagcctgggcaacagagcgaaactctgtctcaaaaaaaaaaaaaagaaaattatgaaaaatctgtgggttcttgcagtggcaaagaaaaaaaagaaaaaattatgaaaagtcagcctgggcaacaaaattaaacctcatcttaaaaaaaaattttttttagcctgctttggtggcatgcacacacctgtagtcacagctactcaggaggctcattgagcccaaaagattgatcccaaaacagtgagctgtgatgctatgattgtgttaccgtactccaggctggatgatagagcgagactctgtctcaaaaaaaaaaaaaaaaaaagaagaaagaaaattatgagaagtgtctcataacctctcaattctgatgttgtacaaatattcagtgagagcttcttggtgaatcttgactttataatccctgcctttcctaccttagatactcctagggtttctcccaagagaagccccatcactttatctggttggatagtttgggaatgtcatgaaggaataaactggcaggcagggtgtctgtgaggtgctttcacatctggccaagctgtgccatgctcccacgctcctactgttctccggagaagacataggcagctttccccttacaagactgatttggcatgactgggactgtctgtgtgtgtctgcagtcagggattcctggcagacagatttagccactggaatcacctctgagcatgcctgagaaggtccagggaagacatggataaagacagggagctgtatacctctgcatccaggaatcagttgtggtcagactgctggcacctgcttatggatttgtttttatttttttatagagacagggtctcaccatattgcccaggctggtcttgaactcctgggctcaggcagtcctcccgccttggcctccctaagtatgcttattgatttgaaaaccctgaagatcaaatctgatcacaggagctcaatcatttctttaaaaaatgtttgatttttttattatgtgcagaggactgtgctaggctggggtgacaactataaacaaggcagaaacggtcccagttctcatggagcataaaatatttgctggccgggcgtggtggctcatgcctataatcccagcactttgggaggccaaggcaggctgatcatttgaggtcaggaggtcgagaccagcctgaccaacatggtgaaaccccgtctctactaaaaatacaaaaaaggtgccagatgtggtggctcatgcctgtagtcccagcttctcgggaggctgaggcagaagaatcacttgaacctgggaggcggaggttgcagtgagctgacactccagtctgggtgacagaacgagactccatctaaacaaaaataataattaaaaaaaaatgaagtatttgctgtgttatatgtgcaaagcatatgggctatgagggcccacagcatggtgtggtcataccttgggtgggaaatccctaggctaggaactgcttacagctaggctgcagatgttagctccttaagtgcttcaggaagctgctcccatccccagttctggggatgtgttagtctgtttggagtagcaggacaggtgcccactgccttctggcctaataaaccttaacaacgggatcttttgcaaccacttaatatacactgggttgtgttcattgtatttgatcttaaagaaaaataggtaaaaattttacagtttgattggtcttgatttctggaaataacattgacttctggtaaacagtacacatcagggatattatacttagaaactttgtaaggtggagtcaaaattaattgtcacaaaaatgtgtattttttttttttttttttttttttgagatggagtcttcgctctgttgcccaggctggagtgcagtggcacgatctcagctcactgcaagctccgcctcctgggttctcgccattctcctgcctcagcctcctgagtagctgggactacaggcgcctgccaccactcccgtctaattttttgtatttttaggagagacggggtttcactgtattagccaggatggtctcgatctcctgatcttgtgatccgcctgcctcgacctcccaaagtgctgggattacaggtgtgagccaccacacccggccatgtattttcttattctttttttttgagatggagttctgctctgttgcccaggctggaatgcagtgatgtgatctcggctcattgcaacctctgtctcctgggttcaagcgattctcctgcctcagcctcctgagtagctgggattacaggcaccagccaatgctcctggcctgcatttttttttttttttttgagatggggtctcactctgtatcctgggttggagtgcagtggtgtgatctcagctcactgaaacctccatctcgcgggttcaagtgatacttctgcctcagtgcccccccctgccccccagtagctgggattacagtcgcctgccaccatgcccggctaatttttgtattttaaatagagactgggtttcaccatgttggccaggctggtttcaaactcctgaccgcaagtgatctgcccgccttggcctcccgaaatgctgggattacgggtgccagctactgcctctggactgcattttttttttttgagacagagtcttactctgtcgcctgggttgtagtacagtagcacgatctcacctccctgcaacctctgcctgccaggttcaagcgattcttctgcctcagcctccctagtagctgggattacaggtgcctgccactacacccagctaattttttgtattttttgtagagacggggtttcaccgtgttggccaggctggtcttgaattcctgacctcgtgattcacccgcctcggcctcccaaagtgttgggattacagacgtgagccaccgcgcctggccgctttttttttttttaatggctttttgtctctgggcatcctggaacacttcgtgagtgtcatgtcgggtatgaattatatatatatgtaattgagattacactataaatgtttctgcacacaactatactaacatatgtgtaggtgtgtgtatgctttcatatgctctttcaaaagcctcagcgaggttgtcagtacaggaagtattattcccgggcttcccagcacggctccctccccagggcatcctgctgcctgccttgtgtgttgcagacagaaggcaagcaatttattccccatttagaaacagagactgaaggcccatccagaggagataaaacatttttctaaggtcgaaagaaaatcaggaataggattcagagggctcttcttgcttcctctgtttccttcttttaggagaaaaacctgtccttgttgattttaatgttttaccttggaacctgtattttaatactgtcccctcacaaatcaatacatttgagttaattttttattatgaaatatttgaggcacataaaagaagattgaggttcacataaacacctctgagtctgctactcagcttgagaagttatagacacaattacaattacattacagacacagttgaagccctttctatgccatctctgagatagtttgctgcttctcccttcggaggtgacctctgtcctgaatttggtgtttatcttttcatgcatgtttttacgcttttattacatatgcatatgtctataaacagtatatggtattgctttatagatatatggttttgatcttttgtaaatggtgctatactgactatgtgtttaagcaatatatggtattgctttgtgtggttttaaacttttttttttttttttttttttgagatggaatctcattttgttgcccaggctggagtgcagtggcgcggtctcagctcacagcaacctctgcctcctgggttcaagcaatcctcctgcctcagcctcctgagtagctgagatcatacctggctaatttttttgtatttttagtagagacggggtttcaccatgttggtcaggctggtctcaaaatcctgacctcaagtgatccacctgcctaggcctctttccaaagttctgggattataggcctgagcccccacactcagccagttttaaactcttataaatggtgctatactgtatgtatccttccgccatttactttcttttagctcaacattgtatttttgagattttaaaaatgttgatctacgtaactgtttcattaaactgctctggtttcttacagagtataaaagctccctagttaattcatctattctgcttttgataggcatttgtgtttctaatgtttcaagtgacaaacaatgccttggtgaactttctctagaacaactcattcagcgcatgcacaagtttctctaggctctaagctgtgtacctagggctgagatcaccaggcggagagatgtgtgcgttttcccatatacgagattctgccaagttgccatccgtggtcatgccagttcacactcccatcggaagtatgtgcaggttgcctttgttccacaccaacccttgttatggtcaaacctttgcaaatttgtaatagatgagttttagtctgtttccttcctcagttgtttccattcacatcacagtattcgagctgtgtttaaaattagcccatttcctgagttaccttatcagagtccttgcttcagagtcccacggactgaagttgacagctccatggactgctgctgctgagatatctgcactggggagggatagttgatgcagggaaaggcttaggatggctctccatggcccctggtgctgtgggctgactccgttaagcttttctgggagttgaaacacacatttgtgagctttcacttgcacacactttctctcttcccgggtggatccgacccgggtagggcaggcttatctgttgcgtaaatgtgcccagctctgctcagagaaaactcaagccagcagcctctcagaccgtcttccgtaaaaggagagggtggctgtacccacgtggcagggaaaactgaaccgtgaagtcggcggctcagccctttgcacacagaagctgagctgtccctgtgcgaggcagaaaatgtcggctcatgttcatcttgagtctatgcctgattacaggctccagactcggagacctcgagggtgccttacagggaagggggcattcagtgcctactaggcgcccggcttttctttttcttagcaggggtcttatttaatcatttctagtactcatatgaaccaaagccaacattcattgttgtattcattgccatgtactgtgctaaaggcatcgtgagcctttgcttagttcatccccacaacgcccttgtgaggtgggtgtgatttcagacggtgaggcccagatagtgaacgatagagccagcattcagcctcatcaaggctgatggcagagctcctgcttttattattttctcaattgagttataattcacctaccatgaaacgcatcattgtacagtgtacaattcagtggtttctaatagatttacaaggttgtccgagcaccatcaccatctaattccagaatattttcatcaccctccgaaaaaaactacccgttagcagtcacttcccatttcttcctccacctagcttctggcaaccactatctacctttttttttctttttttttaaatggatttgcctcttatggacatttcatataaatggaataatataatatgaggccttttgtgtctagcctcttttatttagcataatgtcttcaaggttcatccatgtagtagcatgtgttagcacttcattcctttttattgctgaatgctattccattgtatttatctactacattttgtttttccatttgtcagttgatgggcatttggactgcttccactcttttcggctgttatgaataatgctgctctgaacatttgtgtgtgaatttttttttgtatagacatgctttctttctttcttcttcttttttttttttcagatggagtcttgctctgtcaccaggctggagtgcagtggtgcaatcttggctcagtgcaacctctgcctcccgggttcaagtgattctcctgcctcagcctcccaagtagctgggactataggcgcatgccaccatgcccagctaatttttgtattttcagtagagacggagtttcaccatgttggccaggatgttcttgatttcttgaccttgtgatccacccaccttagcctcccaaagtgctgggattacaggcgtgagccaccgcgcccggccagacatgctttcatgtctgttgggtgtatatgtaggaatggaatttcttggaaaacccctgcttttaatcgatttaaggaggaaggcatcaactccattcagaaatgagcaaacgaaggccccccaggtggtgaattgactttctgatgaccacacaactcatgaatgacagggataggaacactactgctggtcccctgattcagaaatccatgttctttccaccattacacccaactctcattgtgcagtttagggaaacagatgcaaggagggaaagactggggtgggagaggggtggaattggcttgggatcctccaggttccctgccccccatctcctgcccctccccagcaccagcatggtgtctcctgcctgtgcctgctgcctcacccccagccccatttgcttagtgttgatgagccccttccacttgggaaggaaatggatccgataaggtcattaacagtgaaatgttaggaatttgccctgtttttcaaatctcccttttcatttgtctccctctcccattcttgtctgcatttaaaagaggaccccccaggagggcaatgcttaacctgcatgaaaaccccctcaatgctccttgcgatgcccactcctggcctctgcctgggggtactgtaagcagctgtcgattccatcaattgattgacacatggggcttgtcttcagccatgttattcacccagacctcatgtccctgatgtctcctggtgccttctaggaccctgtctgggtgggtgtggtgagtgaagtaggagacccaggctactgctgtgataaagacaccacctcacctttacaaagttctgtttcatttataaaatacttgatttaatcagatgcttactttagttggatctttccatcaagcttggatgtaggaatttcttcctgcatcttacatatggggcaggtgagtcccaggaagtggaattcatgtgatctcggtggccagaaagcagaagagctaggatgggtacacagacctccctaacgccagtgggcaattcttgcagtacctgcagaaccagaacggtggtccagggctccagactccaaagccattgatggggttcaggacatactatccccaaatagtaatatggcatttgagaaaacagcagaagcaggaaggtctctcacctttcccctcccttcttccctgatgcagactctcattcaagaaggtgtctaccttatacccagaagaaagggacatccttatctctggagatacagggacacagagaagaacaaacagggcctgccaagttctcttcagtttatcactattagatcatatcccctttctccagtcacacttcttcacgatcatccacttcttcatcaaacctgacatagggaaatatgcagacttacctgtttcttttctttttttctttttttttttttgagacagttctcgctgtgtcgcccaggctggagtgcagtggtgcagtctcggctcactgcagcctccaccttcctggttcaagcaattctcccacctcggtctcctgagtagctgggattacaggcatgcgccaccatacctggctaatttttgtatttttggtagagatggggtttcaccatgttgactagactggtctcgaactcctggcctcaagtgatctgcccgcctcggcctcccaaagtgctgggatcacaggcatgagccgccacgccgggccagagttacctgtttctttggaccttcatttccttatgaaggcttctgcgtcacctaaaaacttagattaatttgtatacattgttcttgttactctgtcttttgttataggggcctcagccataaacctaagatgggaaggaaggatatttcttttcagctactgcgtgttctacatttcagcggccttcttcatagaaactgtcacccaaggctctgataatggagatatgtcagaaatgctggggctgtgtgtccagaatagtaggcgccagccataggtggctgttgagctcttaaaatgtagcaagtctgatttgagatgtgctgtggcatataaactccacacaggttttcaaaaatttcatgtgacacaaagaatatgaaatagcccgttaatagttttctaatattggctgggcatggtggctcacacctgtaatcctggcactttagaaggctgaggccagaggatcacttgagcccaggagcttgagatcagccagggcaatatagcgagacctcatctctgcaaataattaaaaacgtcagctgggcatggtggcacacatctatggtcccagccacttgggagtctgaggtgagaggattgcttgagcccaggaggtcaaggctgcagtgagccatgattggagtgcactgcactccagcctaggtgatggagccaagaccttgtctcaaaaaaaaaaaaattttttttctgatattgattagacatagaaacaacattttggatatactgggttaaataaaatacattatttcatttgggagtctgaggcagaaggattgctttgattgtttgaggctgcaatgagccttgattgcaccactgcactccattctgggtgacagagtgagattatctaaaaaacaaaattaatttcatctgttctttttaaatgtggctagtaggaaacttaaaattgcatatgtggctcatattatcttcctgttggacagtgctctgctagatggtaaattccatggctcaggagtttgcactctgcatttaaagcagtgggtttctgggcatccttgggcctcagtttcctcatgtgtaagccgcagtttcctcatctggaatccattatctcgaaaggacccatccagcttgagcagtattgtgaggtgaccatcaagttccctaggcctcattttctttctttctttctttctttctttttttctttttttgagacagactcttgctctgtcatccaggctggagtgcactggcgcaatcttgactcaccgcaacctctgcctccctggttcaagcggttctcatgcctcagcctctctagtagctgggattacaggagcgccgcaccacacccagctaacttttttttatagttttagtagagacgggttttgccatgttggccaggctggtcttgaactggccaagtgatccacccacctcagcctcccaaagtgctgggattacaggtgtcagccattgtacctggcctggcctctgtttcatctgtcagataaggtaaatgattcctgccttgttctctgcccccacttttcaaatgagagaatggacgaggaaatacttggaaagtgtacacaactgtacaaatgccaggtgttatcattgtcactcacccagctcacacctgtagacaccttgagtagccaagtggaggacggcagcttcctggctaacagagtaggcagacaacagagccctgagcctgggcaggggtcctgagtgccattctgcctttgccttggattgtgtgagagctcctggaccatctgcatgtctgtgtgccctggccaaatggacagatgaaaatgacaccatgggctgctgaaatgccatgttctgaggactctaaagtgtcatggagctcctgtgtatggtatgtgaggccagaaggcagatttcatgattgctgttttactgatggaaatacacaagagatcgaagtgacttgctcagggtcatagagggaggcagtgcccatggccgaggcctgaggtctttcgatttctagctcagtccagtcccaccactgcagtatctccaagccacagcattgggatttggttgtctcacagtgaaagtaaacctgtctgcactcagatccttttctccctgttgtcgggaggtgctgggacagtgggaattgtgagactggaggtccagaggctggctgtttgctaagccatccaccaggaggctgagaagtaagcctgttgtgcctgccctgccacattccagggctgttctgttctccccgagggaatgggggcctgctttatttttagctagttcagtgtgacagccttgttctctttctgggcaaggacttggccacttttaccagtcaggaagctccctttagaacctccaggccctactcaggttctcctaggaagagggggccaagggaaggggagctgaagttggagtgccgctctgcttgctgggggcctggggcatttggcttaactgcacagccctaggttccacctgcctcatgtggggttcataacagctaccttacacattgtgcagatttggatggaggagcttagagcacccagcgtgggccctgtccacattcacgttgctagaacgtcagtttcttcatcaagaatggggatcctggctgggcgcagtggctcacgcctgtaatcccagcactttgggaggccgaggtgggcagatcacaaggtcaagagatcaagaccatcctggccaacatggtgaaaccgtgtctctactaaaaatacaaaaattagctggacatggtggtgtgcgcctgtagtcccagctactcaggaggttgaggcaggagaatcgcttgaacccgggaggtggagtttgcagtgagctgagattgcgccactgtactctccagcctggtgacaaagcgagactctgtctcaaaaaagaaaaaaatggggatcccattttcctcatgatttgttgtgcgtaaacagagttcattgaaacagaaccaacagtttacacatgctgagagacacatatgaacctggaagaagagaccgggcaaggctgtgtccccaggatggggtttttgagtgcctgagggatggttttggctttggtgatgatctcacacagacctgtcactgaggagccctgcggtggaattgattatcccagacacagttcctctggtagcttgcaggtgactcagcttgaatatgggagtgggaatcccgattatctttaggcccctctgtccctctgggcctcagccatgcagtggtgaagtgctgaggggaaggcaggggttagaagtgcctggaactctgtaccttaaagtgagaggccgctgccgggggagaagggctgggccattcggggaagtctccgggccttatctgagccagcaaaccctctgagacctccctaggctagtcattactggaggcctcccgcccagcacaggagccacccaacctggcccaggagccaccacgtggtgcctcctagggctcctgggcacacaaagggcccagagggcatggctcctgtacccctggcactcacggtctagctggcggtgtggaccatgcatgtgtccctgcaacgcccaggaaagacacacaccacgaagtgtctcccaggcagatcgactcctacatagtgaacacctaaggccgaggggatgctgaggagaggagtggacggtgtggggtggggcggatcatggcatgtgctcctgagaaggtgagttgggaggtgagctttgggaggaagaaggagctggggacggagaggcccaggaggcagactggacggggcttgcgaggaaggacctttgaggtgatgagccaccatcagggtgctgggggttagtggttgctttagggaccccactagatcagggctgcctcccctcgtggccatttccctccctgctcagagaccggctgccgagagcaggacagaaactaggttcccggctgccacccacactactgaggtggggctgggcagccgcagaagccatgtgcagtcaggaagaggagtccggggctgctgggcgggcacagaccacggtgcgggcccaggctctcagcttgctatggctgttgaacttccttcccagactgtgtgaaaggggaaggagcagatcggacagcttgttgtggctctgatcccagctggaggggagaagaggcctcctggaggtcacactggagtggcgtgcttttggcaaggccaggcagccatgctgttcttgggtggctggagctgtggcggtgatagcccctgtagtaccgcatctccctctccaggaagcccctggccctggctctccctggactgagaggatagagcacaggaccaggaatcagggagcttgctgtccaccccagtctctgcaagtatgtcgccctggccagttgaggaacctcctggccactcattcttgcccagggtgttggaagtgatggtacctgctctgcttctgcagacaggatgctgtaaggaccaacaggtaaacgcgctgtgccaattagagaggcctttataggtcaaagtcataggaacgcacccacttgacagatgggaagactgaggtgcccacaggatggcagagccagaagtcaaatgcaggtgtctacatggccccgactgtgccctgtcatcggaccgggaggggtcctgaggaagtctttagtacggctttgctagtttgagtcttagagagtgtctgcaggaaataggaagcgggaagtaggtttttaaagaaaaaagtgtttatgatataattccatttttgtaaaacaaaaagaaccatccatctctttatgtatgagtgtttgtttagggaggaagatagtcctagtacatagagctctaaagtccttgtacataaagcagggatatctctggggagactgggggaagaattaataatttttacttttatgcatttttatgatgttggaatatattttacaataagtatatattactgttattgcttcttttttgttgtttttttgagatggagtttcgctcttgttgcccaggctggagtgcaatggcgtgatctcggctcactgcaacctccgcctcctgggttcaagtgattcttctgcctcaccctcccaagtagctgggattacaggcatgtgccaccaggcctggctcattttgtatttttggtagagacagggtttctccatgttggtcaggctggtcttgaactcccgatctcaggtgatccaccagcctcggcctcccaaagtgctgggattataggcacgagccaccgcgcctggcctattattgcatctttaaaaaaaaaaatgaaacagtgtaaatgtttcaagtagttttgttagaatctttcatttgccatttttttcaggcatattgcctcccagctttagttttctaccaatgggtcaatagcattttggtagatgccttttttttttttttttttttgagatggattctcgccttgttgcccaggctggagtgcagtggtgcaatctcagctcactgcaacctctgcctcctgggttcaagtgattctcctgcctcagcttcccaagtagctgggattacaggcatctgccaccacacccggctaattttttttgtatttttagtagagttggggtttcaccatgttggccaggctggtcttgaactcctgacctctcaagtgatccacccgcctcggcctcccatagtgctgggattacaagcgtgagccaccgtgcctggccggtagatgtatttttcaggcattgagatgaaaggagttaggggtacatgattatgtcacttagggatgggagggagggaaatgacacttgatgcttactttgtttctgcacattaaaatcctccccataaccctctgaagtggaggatttattatctccatcttaaaagtgagactcagagagattaagtaacttgtccaaagtcacacagctaataaatcggatttgaacccagctctctgtccacagccctgtgtactttccaccatgtgaggaaaatggaaatgcttaaggtgaagccccaaatgggaggttacgagccctggaatctagacccagctgccatttctaaactccccaacttagcttgaatcatgggtctgtttcctctcctagataatggagataatgatgtctttcctgcctacttcactgggctgcagtgacaggagaaagggaactagcattaaagcacctgcttcctgcgtggcacttggcatccacaagctcatttcacttctttctacacagttcaaatgggataatgtatgtgaaggtcctgtatctgaagggccagtgcacatgtgagccattgctaattgtgatgttaataagcacccaggacccgttctctctgagtcagtgtccttagcaaagggaagtgaattctgatgttgaaatctctgtcctcccctaagctaacatctttcttaacccttcagggtgcacgccacaatttccttttgtaagtggagcgccttgcttggaaagttcattttaaaggcctgcgtcagcagcttcagtcacgcctgctgttctgcagcattctcgatcctcacgggagggtggatgagagagggagtgaaattttccatggctgtgcacccttccacggggtggggtgaaaatggctgggatggttaccagtggttactggtgcctcctgctgcgaccggcctgttcacttgggcatgtccaatcttgcgtttgttttttgtgcatgttctgttgggagcaggaggtggggctggggtcgggcacagaaatgtttgtgagttgattgcagtgctaggccattgagttctttccttggttggagggctctgagccagggaagcttggcgaggctgtgtgttctctgctgatgacatgtcctcctgctctgcgggggtccaactttgggagccgctgagagcttcaaggcccccttggtccacaagaaggagaatccaggacaagtgtctggaaagtgtttgagcaagagcgcccgccctgtgcagccggtctggctaccctcataggaagggctcttcactctgggcagcggtggacagaggccctggaggctggatgcgggttctcaggcaagagtctgagggacccagctcggtgtctgatgtctggtgtctgggactgggcgccttcccatttccatcccagcctgaccagactgaccagagtcccacatattcgtctcagacactggtttgagagggagcatttgagggcctgggtttctgtcatgactcctgggaacctctgtcttctgatagatggtccacagaccgaggcttgcagtggaagcagctggaagtggtgctgtgcggtgtcctccccaactcccaaatggagtgtggggagggattcttcgggcactgatgtttggctggagcagtaaagcagcggtgatgtggaggcagcacctaagagaaggggacaggattatggagatgtgagtgtgtgtgtgtgtgtgtgtgtgtgtgtaagtacttgtgtgtgtatgtgtgagtgtgtgagagtgtgtgtgtgtgagagattgtgtatgtgagagtgtgtgtgtgtagagagagagggaagaggggaaaaggaaggaggagagtaaagatctggagatgctgtggagaggaggacagaaatagaaaagttgaaaggccagactttggccaaatccccaaagaccaagagtcagcctttcttcctgggtttctggcagagatctggagcaactgggcaggagagatttctccaatgccctttcttcctccctctctccttcaacccactgcccattcccagcctctttcccagggagacaggcgtggtccagtggagtgccaggaggggctggtctgaacgaggaagatgcgttttgctcagtgaagtgctgggttctctgggcccctggaagttttctgcaggtgtctctagtcatgtgcttttctccagtgcctccgggccacttaaaggcccacagtccagaggggcatgtctgctgagtcctgcaccaggtgcctgcctggctgggcagtgtggcagataccagggagctgacttctcccctggcagcccagccccaggcctagggtatttgctggttcagtggccccttctgatctcccgaggaccagtggaaagaaagggcttcccttcattgtcctcattcatgtaaaatccaggaggccccagtttcagttccggccttgcctcaattgggcctcccttttggccccagtattcatgtctcttctgagaggggttgtacctcatgacgactcatgaacctgaacaaaaggaggaaaaccctccctccatagcagcttgaggaccaggccgttctctgtgtctgcagcctgctttttgatttgagcttctaagctttatttggatttagcttggttgtcctgaaacgttggggtttttggatcaatgtctgtgtgctgagctgcaccttgacttagaaggcaggatagctgtggagttatggagagctgccttttctagaagcttctcctgtccagcgggaaaaccccaacagctctacttggatctgccttctgcagagcaggggaccagtctttcttaaggggcagggatgattgtatggaggagccttagacttgcaggtataaaacctcactcccccagctgtgtgctttgaactaatcacttagcttcttggaccatcagtttctgtgtctgtaaaatggggattaagaacatctcccagacagttttgaaggttaaatgacatactggatcttgatatactgatatactgtaagccacaagagaattatatagtattattccaggatccagcattgtttgaattcctcctttgtgtcaagcaactgggtgagttccaaaggtctattcaatatgttttctttccctggggaactcacgcagtatcataggagatggacagcttggtaaaaggataatcatgatgtgtgaggagtgtggtcgttggggcgtgtccaaaatgctggagtagcaatgtaccttttttaaaattaaaattaaaaaaaattttttgagatggagtcttgctgcattgcccaggctggagtgcgatggcgcgatcttggctgactgcaatcttctctacctcctgggttcacgcgattctcatatctcagtctcctgagtagctgggattacaggcatgcaccaccatgcccagctaatttttgtatttttagtagagaccgggttttaccatgttggccaggctggtcttgaactcctgacctcaggtaatccactcgcctcggcctctcaaagttctggggttacaggcatgagccattgctcccggccttaaaattaaaattaaaaaatattttagaggtgcgatatcactatgttgctcaggctggtcttgaacttttgggcctaagcaatcctcctgcctcggcctcccaaagtgccaggattacaggcatgagccactgtgccagctagcaatgtagcttttattgtatgatcttgcgcttgctcctccattctccacgcagcagacacacaactctcatcatggttgtaatcagtaaagccgtcccaaggctcgctgtgctgtgggatcccgcttgtatttgtttatgtggctcatcaggccctgtgtggttgagctctggacagtctttccaggcacaccgtctgcttgttcatcacaaaaaccaccctccctccccttcggacttcacacatgcccttgcttgtgcctgggcatgctctccaacttcgcctctccaggaagccttctctcccatgcttgcaacgtggctgtctctccctgcagacccagggcactatgatggcaagggctgctgatgaatgccaccagccagaatagggcatggcttgtctctcctcccagggccatgtttttggcaattttatttcctttaaaaaatatatatacatatttctttctttcttttttttttggagactggatctaagtctgtcacccaggctggggtacagtggcaggatcatagcaccctgcaacctctgcttccccagctcaggcaatcctcccgcctcagtctcccgagtagctgggactacaggggcgtatcaccacgcctggctaatttttgtatttttttagagacgaggttttgccaagtttcccaggctgctctcgaactcctggccccaagcaatctgcctgccttagcctcccaaagtgttgggattacaggtgtgggccactgctcctggccaattgttaattttttttttttttagagacagtctcactctgtcacttaggctggagtacagtggttcaatcatggctcaatgcagcctcaacctcttgggcccaagtgatcctcttgcctcagcctcccgagtagctgagactacaggtgtgcatcaccatgctgggctaatttttattttttgtagagacagggttgttgcccaggctaatctcgaactcctgggctcaaatgatcctgctgccttggccttgcaaagttctagaattacaggtgtcagccaccatgcctggcctcttctggcaatttctattctggctcttggtggttcctgattgcccttctttgagctgctttattgtaaagggaaaaaggtggtagggctagtggttaggagtgggggcaaggatcatccttgggcgcagagagtgttggcagacattttgggaggcctaggtgggtggatcacttgaggtcaggagtttgagaccagcctggccaacatggtgaaaccctgtctctactaaaaatacaaaaattagcagggcgtggtggcgcacgcctgtaatcccagccactcaggaggctgaggcaggagaattgcttgaacctgggaggtggaggttgcagtgagccaagattctgccactgcattccagcctgggtgacagagatagactatgaaaaaaaaaccaaccccaaaaacaaacaaacaaacaaacaaacaaacaaacaaaggaaaaaacaccagtgttaaggtcttttcagccttgtggggctgtaaatctgtctctctatccagtgggagccttctgtgtgcaaggctccatgtgaggcactggggaggtcagggtgacacgcatggaaagctgggatccagaccagaccctgcctaggggtcagtgctgaaggagtggtgatatccagcctgaaggacttggacatcttcaggaggaagtgacagttgatttgaaccttgaaggttaggtgagctgggaagaaaaggaagggcatttcaggtagaggtgacagcagaaggaggagagcctggagcacctactaggaatggtagaggtggtttggccggagttcagagagcacagagccacacctgcagagggtaggtgccttggcagtggggaggcattgcaaggctttgggcagaggcatgacttgattagggttgcactttaagaggctgatgctgcagtggtgtagaagatgggttggaaggaagagattgaagataaactgttacagtggatcatcagcaatccaggcacacagagcagcagaaagagtggatggtgaaacaaaagaaccttcctcggtggactctacagggatagtgccatcaggacaggtgtctagctcaattctaggcacctagctggtgcccagtgaatccttttttgggagaataaatgcgaagatgccatgaaggacaaacaattagtgatagccagtgacaacccagggtgcctaaggttaggagcctgggcagcttgaggagaacggggaactcaggaagaggagcaggttgggtcaggcctggtgaagggtgggagtagtttgactcggaggtgcagggcccatggcctggcacacaggcccggcacatgggtatgggagcccaggggctgtctccattcattgaggctgggtttaaggtttctgtgctctgggcctgccaccctgtgttctcagaagggtcctagccctttggccgccatttctgtctttctagaagtcttgcccatggacacctgccagtactactgtctcatgttaataataatagctgatgtttattgagcagttactgtgttctaagtgcttgtgtctcatttgaacttgtcctatatgttaggtcctatctatcatctcagtttttcagttgaggaaactgaaattcacacagctgttaagctctggggctaggattgaacccagttggctggctccagagcccttgttcgtagcctctctgtcattcccatcccagtgagagtgagccagccaattctcagagagagaaggaggcttgaggtgttcctgatactggaggaaacctacctccatcaagtacttgggggttgaagagcagcttccatgtcatatttgagggttggaaaggatcttagagatatcgggttcattttacaggccaggaactagggctcagagcatttgcaagcctgttctgggtgacatggatgacagcagttgaatgaccttccgccatgcgatgtgccagcgtgcgtgttcctgtgcctgtgggagctggctatctcagcgggtgggtgcctcaccttgccctgtcctccccctcgacctcactctccttccttctcatccccctccagattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctggtaagtctgtcacccagagattgaaccctgagggctaaatgttctgtgaaatcttccttctaacttcatttgttcatacatttgctcattcattcattcaccattccatcaatctgctctcccatccatccatccatccatccgctgatccatctgctgatccatccatccatccatccatccgctgatccatccatccaatatgtgtctactgagaccttatgccagtcactggggataccatggttgggcaaggctgacctgctgtcattgactttactgtctagtggcttgtgatactttagaaagtgtagtgtttatgggtctcgcagatactgtgtgggttgctcttatgtcttcagaacatgaagaactccagaacaaatgaagggttcattttagggaaatctctccatcagggaatcaaagcttccctctcttcttatcccagataatagcaatcctaatggacaggtgggtctcagacttaaaggcagagattccagaccccctttggacagatttcacagatgcagaattgaggcagcccccaaaacaaagaaatacagaggggaggtagaattgaaagaaaaattgtatcctttcactctgcatcctgtggctcataccctgcagtggggcgttgggggagggccccctgaggattgtctgtttctcctccccagaggagtggtatcagcccctgcacctggctgagcggagactgagaagtcgcagtctggcctgctcagtggaagctgttcttcccggcagacccgcagttactagtttgtggaggtgaatgctgtgcttgctccagcgtggcgccctcacaggaatcccctgttagctgtgttctgtgctctagggtggggctcacctgctgtaggcagcagagggagggagagcaggaggaagtcaggtttcccttggggttgtgagtacacgaccagtgagtacagctttcacacacccctgcgatttcttccctgctctcgaggctcttatttaaaggagtgatttggggcatcttgtatgcagcctgcaaaatggacgccaggaaactgcagctgttgcaactgatgttcttgaaagatgggcaagtgggagtaggctggttgcagcaggaaaagacctctgctctctgcctgcagtcatcctgaatgagatttggacgctgataaagaggccttgtgctgttcactgtggccacgggtggggtctacttcatgctcacatattagcatgtatatctctgatgtaagcctactccacctccacccttttgtttaggtgttgattactagcacctacttctagctttttaagaactactgaagagattctggccatcagagtgaatagactgtggtctaccctgggtgtgttcgcttgtctctggctggagaagaaagaactttatatatagttcactcttgctttttcccagccatggatgtcacctacagccaggagcactggaacctttccaggatgaggagagctatgtagcagaggcatggctctgactgcttccagctgagagaagaggaaggagcggggaggggagggggtatgggcagcacccaggagagcacctgctttggctttgcttgggagagctcagaaggctacctgatccctgcgaggcacctggccctgtgtgactggctcagggcagacacaggggaggagacactttgcctcctacccactgggccctgctctcaagccagctgtgtcccagggacctatgtcagcaggggtgctctccctctccttcacaaactgtttccaggattgagagtctcaaggtgtgatccaagtgcagtagaaatccagccatttgccatattggctactcctccaaacaaggcttagaactcatactcatttgtgaaatgtatttttcacccccttttagagattcatagaaacggcacccccccattccaaatatttatgggtgggttcagttcatgtgccccagagcccacacttcgcttgcaatggtccctacagccccgcaaagacattgctgttgatgctaaggacttggatacccaacccccagtccacttcctgccccttcgtgttgtgccgggcttctgtcttcacctccccctgcctcttggctcctttatcatccaagaatcaggagatccctgcagtaatcagaatctgggtctcttaatagtaaatccatagtgctgttccctttttgaaatgttaatcactgcttcaactgtagtaattagtgacagaattagtggtaatcccaaaccacggagggataaattggcgctcaccatggtggagcaatgcctaagtggtgatgtgatttccaaggcaaaggaaggaaacaagcctttcctttcttgctgaccttgaccctggtcgactagacacagagttttggaactcaactgactttccagaagcatttctgaaaacatatctgatacatacattctgatacctatcagcccatttttaattagtttctttcttttttggtcattttttttttaatgggcagtgaggtttttgtttttggtattttgtagagatagggttttgccatgttgcccagactggtcttgaactcctaggctcaggcgatcctcccacctcccaaagtgctgggattacaggcgtgagccacctcacctggcctgtttttatttttattttttagttgttcttcaataatctgtatatcattaaaaaaaccccaaaaacctaaagtggctttttgctgctgcatatcatttttgaggtagtggatgaatgaataataaagaaggaaaatattgaagcctcttaacattggtgatttggctaaatagaattccctcttcaaagctactgtagggagcaagggaaaacgtcccctttgccctctgaatgttggctgaaaaatcagctcacaaaaggcagattaataggagaaagggcatacacatttattaacatgcatgtgggagaatcacagactgattactcaagtatcccggtggggcccagatacttacatttcctcttttcttttcctttttttttttgagatggagtcttgctctgttgcccaggctggagtgcagtggcacgatggttcaagcgatcctcctgccttagcaccccctacgtagctgggattataggcacctgccaccatgcccagctaatttttgtatttttagtagagacggggttttgccatgttggccaagctggtctcgaactcctgacctcaggtgatccacccgcctcggcctcccaaagtgctgggattacaagtgtgagctactgcgcccggccacacatttcctcttttcagaggggaggcaggagacagggaacagtaaatgattactagggagaatgaagatatcagggaacagagattaaccagtaccggttctctttggaaattgaataggagacagattttttttttttttttaagacagtctcgctctgtcgcccaggttgcagtgcagtggcatgatctcggctcactgcaacctccgcctcccgggttcaagcaattctccggcttcaacttcctgagtagctgggattacaagtgtgcaccaccacgctgggctaatttttgtatttttagtagagacgaggtttcaccatgttggccagactggtctcgaactcctgaccttgtgatctgcccgccttggcccctcaaagtgctgggattacaggtgtgagccaccacgcccggtttaggaacagacatctttaaaaaggtccattcaggtgtggtcagattcttcagtcttcttttctgcaatagataatgagataacagggagggtaaggataaagttctccttggagggtctgcgtggtctttatgcagataggagaaaagcattttccagcatctgttgatctttaagggcctttagttcaaaatactcattataccagggagccatattttggggtgaagtattttgggtttccctcactacccagtctcttgggaattgctgtccctctgtgcccagcctcccccattcgcgaagtgtcccttttttctccttttctcatttatccctaaggatattgtaagcactaattagagtgtaagcttttggaggctaaataggaatcgatacttcttggtttcggcttcattgttcctacacagcctttacccaaaagagaagtttttacccaaaggagaagtaaaaaaaaaaattttctagaagcttggatgtgccattatcttttttcatgcaaagcagagccatttacagtgtagtcacggttgttttggggccctaaatattcatactactgttttccagtcaacggaaggaaaatatttaccttctcttcttgcagcatttgggtggtctcagttttcttatatggaaggatagttgggttatctcaagtattctctctatctgtgaaacctcctgagttgaaggcgtggagttcccatcatgcagctggattgtagatgggcaggaatgcctgtgtatctcatgtacagaattaattcattgaggctgggcacggtggctcatgcctgtaatcccagcactttgggaggccgaggcaggcggatcacctgaggtcaggagttggagaccggcctagccaatatggcgaaaccccgtctctactaaaaatacaaaaattagctgggcatggtggccggtgcctgtaatcccagctacctgggaggctgaggcacgagaatcacttgaacctgggaggcagagttgcagtgagctgagatcacgccactgcactccagcctgggcaacagaaactctgtctcaaaaaaaaaaaaaagaagaatcaattcattgagctggactcaggcaggcatttcccgcaggcagagtttttgcttgccctgtattccagcacaggctggtactcgagacacatctgtcctgtgtttgttttccattatttgctggtaataatggctgtcattagaaagtggagaattgccagtagcccttcggatgtgttgtttaatgagctttctcttgagcggttctcccagcttcagtggaaatgagaaatgtgaggaaaggtcacaggcaggaggccccagtagcaggaagcaaggtttgagaccaaagattgaaagaggaagttgggaggaaacctattactgcagaaagaggctgagcttgtagccaaagagaaaaggaaataaaaatctagaacactgaatcggtctctgggtttgccactcccaacctgtgtgaccttggagaagccacttaacttctgagcctccatttcctcatgggtaaaatggccatggtaatccctgccccacctgcctcaccaggctatcatcaggatcaaatgagagtctttggaaactgcaaaccaccgtgagttatggtgcgtcatcgtcatcctcatcagtcttatgatataataactggctttggaagaattccttgggaaagtctttcctaaccaatggagccagtccaaggaccgcacccagcaggcctgaatgtgtaagccgagcccctgcaggaaggatgcagagtttttcaggattcgctggcatctctgtgatgttacaggggaaggaggcagagaaaaggggcaagccaaggcaggctgtctcacccccaacccctgagctagccacataaaatgtgggtgagaccacaggctacagctccagtacctctgcaagggggtgactggacacgacagctctgaatcagggagccaacccgaggtaaaagggactgataggtcccttttgttatggagggcaagtgggtatttgggggattcatttcctgacaaagaatattgaactaacctggaaaccttctggttgtagctgaaggaaatctgactcaaatttgtttaagaaaaaaagagaattctagtttcctataactgggaagtctcgctgtgagttgacttctgtatctagggattcatctgtctcttactagttcagtcagctcctttcctgtgtgttggcttcattcataggccatctctcctcttacagtggcagggacggcccctgcagccctaggctgacccctccccttatagccagcgatctctgtgcaaagagcaggccttgctccccatggacctgtgatggtcttggagagggctgtgattggcttacttgggttatgtgcccatcctgaaccaatcacgatggacaagatgggtgacttgggatgcccctggatcccatgcctggattacgcattggtacccctggagctggagtggggattcagccccacttccaacctcataggtgaaaaatgggagggtagttatctaaagagatgctggacatcccaggaaagtttatcagttatacttgttgtccttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnncactttgggaggccgaggtgggcggatcacaaggtcaagagatcgagaccatcctggccaaaatggtgaaactccgtctctactaaaaaatacaaaaattagttgggcgtggtggtgcatgcctgtagacccagctactcgggaggctgaggcaggagaattgcttgaacccgggagttggaggttgcagtgaaccaagattgcgccattgcactccagcccgggcaacagtgtgagactccatctcaaaaaaacaaacaaacaaaaacatgaaataaataaatgtttaggtgaacattaaaacagcaaattaattaagtaaaatattaaaataaaaagtaccgatcatttcatctcagtgtagtatttgcttttgtgccccttttccccctatgcacaagtggtttatagttgtttatcagactgagctttcactgtcttcattagagaatgaagcaaaataaaaccaaagctggccgggcgccgtggctcacgcctgtaatcccagcactttgggaggccaaggcaggcggatcacgaggtcaggagatcgagaccatcctggctaacacagtgaaaccccgtctctactaaaaaaaaaaaaaaaaaattagctgggcgtggtggcgggcacctgtagtcccagctacttgggaggctgaggcaggagaatgatgtgaacctgggaggtggagcttgcagtgagccaagatcacgccactgcactccagcctgggcgacagagcgagactccgtctcaaaattaaataaataaataaataaataaataaataaataaaaccaaagctaggccaggcacggtggctcacgcctataatcccagcactttgggaggccagggcagtcggatcatctgaggtcaggagtttgagaccaacctggccaaggtggtgaaacctcgtctctactaaaaatacaaaaaatgagctgggcgtggtggtgggtggctgtaatcccagctactggggaggctgaggcaagagaatcgcttgaaccccggaggcggaggttgcagtgagccgagatcgcgccattgccgtccagcctgggcaacaagagtgagactccgtctcaaaaacaaaaacaaaaacaaaaaaaacaaaacaaaaaaacccaaagctataaggaatcatggaagttgaagagccccagaaaagaagtgtagccattcctgatgtgctgaagtctctctctggcccccacttttccttggggatccttgtccctgagttctgtccaggaggcagttttcatggttatacattatggcttcggattcaaatgctgactctgccacttactggttgtgcgtttgggcaagttatctaacccctctttacctttacttgctcatctgtagaatgggcatcctgacagtactgacttcatagggttgtgaagattgaaaataaaaggatacgtataagcacttagtgattggtacagaaagactcagtgaatgttagctgatggatggtcaaataaaatgtttctgatattctagtgactcacctgcgaggagctacttcatactgaattcaattttttcagttatttcaatttttttttttttttgagacagagtcttgctctgttgcccaggctggagtgcagtggcatgatctcggctcactacaacctccgcctcctgggttcaagcgattctcctgcctcagcctcctgagtagctgggattacaggcacctaccactacacccagctaatttttgtatttttagtagagacagggtttctccatgttggccaggctggtctcgaactcctgacctcaagtgatccacccgcctcagcctcccaaagttctgggattacaagcatgagccactgcgcccggctgaattcaattttttaacctagtggtggtgtaaagtactgttggagttaggactccaatgggagcccaaagaaaattctatattgatttgaacaatgccacaaagtcggggtcagaatttccaccaaatctatgacacctgcttcccagcattctcccttgttctctctctttcctttggaccacaaataatttaaaaccagtggcttcatgtgatatatacatataatggaatataatcggttcataaaaaggaatgaggtactgatccacgctacagcatggatgagccttgaaaaccttatgccgggtgaaagaagccagacacaaaggacctaatattatacaattccacttatatgaaatgtctggaataggggcatctgtagagcagaaagtacattagtggttgctgggagatagggaggttgggaggaaatggtgaatggttgttaatgggtatggaatttcttttgggatgatgaaaattttctaaaattagatagtggtgatggttgcacaactctgtaaatatgctgaaaaccactgaatttttcactttaaaatgggtaaaaattgtatgctatattattatatctcaataaaactgttattaaaaaaacaaccaaccaatatgtgaaataataagaaatatacatgttggtctctgcccctagtctctagcatttagcttctaaaacccttgtaatttcttgagcaatacaggtgctaggagaatctttgatcctggtcctgactcagagctcctaaatcccttggaatttcttgggtgataggagagtctcttttgttccttggtgggaccctggatagcctcaggatggggggctggttgccagggggaaccaaccatgtgatcagagggttgctgtcagccccaacccccatgccgcctccagggagggagagagcctgaaaatagagcgaataaaccaatggtcgatgatttaatcaatcgcaactgtgtaatggtgcttccacaaaaacctaaaacaggccaggtatgatggctcacgcctgtaatcccagcattttgggaggcccaggtgggtggatcgcttgagcctaagagtttgagactagcttgggcaacatggtaaaaccctgtcactacacaaaatacaaaaaaaagttagccagatgtggtggcacgtgccggtagttccagctactcgggaggttgaggtgggaggatcgcttgggctctggaggttgaggctgcagtaagctgtgatcatgcaactgcactgcactccagcctgggtgacagagtgtgaccctgactcaaagaacaaacaaacaaaaccaaaaaaaaaaaaaaaaagcaaaaagaagaaaacctagaatgactgagttctggtagcttctgtctagctgaacacatggaggttcctgggtggcacatctggagggggcatggaaactcctgccctttctcccatgcccctccctgtgtatctcttccatccagttcttcatctgtatttattgtaatatcctttatagtaaatatgtaaatgtaagtgaagtgttttttctgggtctgtgagctgccgtagcaaactaatgcaacccaaggagggggttgtaggaaccccgatttatagtgatcagccagaagcacaggccacaacctgtgcttgtgactggtgtctgaagttggagggagggcagcctcgtgtgaacgagccctcgacctgtgggatatgatgctatctccaggtagctagtgaaataattgaattgaattagagagcatggagctggtgttcactggagaattcactgcagaattacttgcttggtgtgtggggaaaaacccacatgcatccagggtcacaggtgtgttctgtgttgtggtgagtagagaaaaggaaaaacatactctggtttttcctctgtgtgtgtctcacatgatggcgtaactgctttgtgcttaataaacagcaagcaggggtgctgtattagtccgttttcatactgttaaaaagaactgcctaagactgggtaatttataaaggaaagaagtttagttgactcacagttcagcatggctggggaggcctcaggaaacttacaatcatggtggaaggagaaaaggcatcttcctcacaaagcggcaggaaggagaagtgctgagcgaagggggaagagctccttataaaaccataaggtctcatgagaacccactcactatcacgagaacagcatggggggaaccacctccatgattcagttacctccacctggtctctttcttgatatgtgggcattgtgggggttacaactcaagatgagatttgggtggggacacaaagcctaaccatatcaggtgccttgaatgaatgaatggaccaccagtccctgtgaccaggcagctaatgagcatttgctgagctgtcctgggtgccaaggacagagaatcccaagttgtggtctttccctcaaggaacttgagaacgaagataggaacaggctgggcgcagtggctcatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtttttggtagagacaggggctcgccatgttgcccaggttggtctcaaactcctgagctcaagcgatccacctgcctcagcctcccaaagtgctgggattacaggcatgagccaccgcacctggccactgtatgatttcattgatatgaaatgtccagaagaggtaaatctatagcaacagaaaatagattagtggttgcctagggctggagaaggatgaggggcttgggaggtgatagttaaagggtatagggtttctttttgaaataatgaaaatgttataaaattggctgtgctgatggttgcataactccgaatatactaaaaaccattgaattgtatactttaaatgggtgaattatatggtatgtgaattaaatttcaataatgctgttacataagatataatgataaagatctttccctgcctaggaaaatgatatgccccaaagcagtctagtatttactgccataggattgagagcttggtggatcatgtgctgtggaaggcaggggtggccgtcacccctggcgtggtagatattaggacagtggggatgtcaccttagcatcacgagtgaaacatatcttaactgatttttctgggagcatcgtgaggataactaatgagatgaagggtagagaatgtttggctgtggcttaatggttggaactttgcccatggccgcctgcctttgctgtccgatggtctcagcctacagtcctgctctgccccctgaggcccaccccagtgctgcacatgtcactcccgagggaggtaaccatagcagaccagtactttggccactggtacttttatgtgaccaagagggacttctgttaaaagcatcctctgggtggaaacaacccaagggtccatcaacagatgaaaggataaacaaaatgtagtggatccatacaatggaatattattcagtcttaaaaaggaatgaggctgggcacggtgactcacgcctgtaatcccagcaccctgggaggccaaagcgggtagatcacctgaggtcaggagtttgagaccagcctggccgacatagtgaagccctgtctctactaaaaataaaaaaaattagccaggcatgctggcggatgcctgtaatcccagctactcgggaagctgaggcaggagaatcacttgaacctgggaggccaaggttgcagtgagctgagattatgcctctgcattccagcctgggcaacaagagcgaagctctgtctcaaaaaaaaaaaaaaaaaaaaggatgaaattctattgggggcagggtggctcatacctgcctatagtcccagttacttgagaggctgaagtgagaggatcttgggagcccaggagcttgagactgcagtgagctttgatcacaccactgtactctagcccaggtgacagagcaagaccctgtctctattaattaaaaaaaaaaagagtaaaattctgaaaatatggatgaaccttgaaaacgttatgctaagaggaataagccggtcacaaaaggacaaataactgtgtgattcttcttgtatgaaatatccagaataggcaagttcatagagacagagagtagaatcgtggatgctggggactgagggtgaggggaaatggaaattattgcttaatggttatagagtttgtgttggggtgatgaaaaagttttgaaaatagtggtgatggttgcacaacattgtgaatgtacttaatgctactgaattgtacgcctgaaaatggttgcagtggtaaattttatgctatgtgtatgttaccacaataataaaacacaaccctgaggagtaagcagaaccctggaataattgatgtcagagctgacatgcagagacccagggcaggcactgggtggacctcagatgtagggctttgtctgagttgaaatgcggtgtgattttttatttctgcatagcagtgctgtttttgaaataggttaagaaactagagaaacatggggtgggaatttgtacttaattcagtacttccattcccctatagtcagaagtaagagactgggattgcttgaagctatttctgtctaaggactctggggtaggatagggtttcttttgcctactctgcgtatatggcagtggttggatgaagtttgcatgattgctgctttctggctgataacagcatgtggcagggggaggcagacagggcctacgccctgccaggaagcgggcatggtatgtggcttccccttaacatttgaatctcatgtgatacctgttgtctccctaaacagaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccaggtgggtccctgctccctccgggtcaccccgtcgggccagcatccccttggttacctccaggaaccaggcctcaaagcactggcatcccaagcccctggaagagggttgctggaaagagtccctcatagatgcatatgtaaaaggactcctgggcagaggatgtgacagcctgcatgggggccctgcttaaacagaggctctccgtctgggcaaactggtgtagtggaagtgggctgcttggactagcagagtctgggtttgaggagggaggctccgcagctctgttgggtaaatgcactcattccctgtggatcctggggtcggttccccagtgcaggtttagcagagccctgggtgaaaatgcccttttctcctggtcattggcctcacccacttactggaggccccggccttgtagggtatggctgtggccttgtcgggcaggaatgaggtctcacagctctgggctatttgggggcttcttgttacctgatttagaataccattgcacaagcccttggcacagaaagcagaggaagcagggaaatcacggtcccctccttttacactcctgttggggctccccacgctgggcccccaggaagggctgcccttcctccctgcccaaggggctgtgggcatgcctaggaagggcctgtccacctgccccctcctctctgggtgcggggagtggtgggtctgtagctcactgaggaccctgtgatcagggctcaggcagcccactgcaggttttcagtcatttctgggtccctaagcccgtcgtggggcaaggtgcactcctcctctctcctgtagacattctggctcctccagtctggctcgcctcctgagttgtggctgctgtccagcatatgtactcagagctggccaaatgtttgctttaaggagggtgtgctcaccgcaaggttcatgactaagatttccagggaactctggttctggggtggacttcgagatgagacccaggagccttctcttgactctactgtgctcttaagttcttgtgggtgggacctggagcaagccaccaagccttttctttgtccaagagacaagggctaatcctggctaacctgctccctgggatttgggttcagagcccttcagattatgtcacagtgagtgtcacaggtgacactgtcactagagcaggtgagccactttatagtaggccaccaaagctgggtgcatcactactggatggccctgcccaagggctcccctgctactcccattactggggctgcagagactggcccatccatctggcgcctgcacaaaggctgccagctggtaggtctcttgaccatgcccagttggctgctgcattgcttctccttgcaggtggccagcagcccatggtttggcatcctgcactttctgtttggaacacacactggcctatcactctgtttcccaaggtccttgggttgagctacctaagcctggcgcattcaacactgagactcaccctgtgctgcaaacattccctgtgtgttttacaaacattccctgtgtgttttggcttgaccttttaggagcaaggtttgttaattaagggagtaccctcaccttcttaccactgccctcttcgtctctcccagcctctatccccatcgtcccctcttctcagtcctagaatcactttatttcctactgtctctgtttcttcctctcctccttttaagcagcctgaaaagaggatgatgacgataatcatgataatgtagtaccattatagcaaattcttttttttcttcttttttttaagacggagttttactcttgttgcccaggctggagtgcagtggcgcgatctcagctcaccacaacctccgcctcccgggttcaagtgattctcctgcctcagcctcccaaatagctggaattacaggcatgcgccaccacacctgactaattttgtattgttcgtagagatggggtttctccatgttggtcaggctggtctggaactgcctg

SEQ ID NO: 15096 - DNA, 93778 bp, Human
  misc_feature (1)...(93778): n = A,T,C or G
tgctcaatttagagaaaactggtgagataaatcagtcatcaatcaattaaccaatcaatcaatactaatgaactattttaaagcacccaacataatttctgggaggtagagtggggaatagataaatataaaaggcagtgccttcccaaaaggagtttaccagtagttgaggagacaagcctaacatgggcaaacaatgctaaaaagtacctaggtctagtttaaaataatgttgcacaccatacatgctacagatgctttaaaaagttgcctatcagtaggagctttaaataaaactttcctgagaaatagaactttcatgggacattaagaaggaaagacagatatggagaatgattgaatgaagtattcagcaagtataaatgcagcctaagaagtggaaattagcatcgtatcgtttttttccaaataagaatgaagagatgaacttagtgaggacaattttgtgaggagttagggagttggggagctggttgcaagctcaggtaagcctgatgatgctttgttccttaccctgagagacattttaccaaaaacactgacagacattcctgatagattaaccaataccaaacgtttttgaatcctattcttatttgccacacacgtttagtcaggatctcaaggattcatcagtagcagcagaaactttaatgtagggttaatatatttgagaggtcattcttaagaaaagtctaggcaataggccctcaggtagtgaattattctgtaggattcattgttttttgtttcattttgttttgttttgttcttttttcatttttctatttttctccataggattcttgataggtttcaatcacacaccttcccatgggtatttccatgggcaacccaccccttctcttcagcagtaaactaacaactacataccagtgaacatcacaggtataaaccacctttcttcttttaaggaattagtatgcaaactttagtactcttttcctagtaacaaataactgctgtatcagattgtgtcacaaggcagctgctttgacttattgctctgtagctggggtcagcctcttcagaacattgttaatgagagaaaggaagtgctttgggcagtgtctggcccatcaggccctctgtaaatgtttgctattaatgcaatgctgagatcccagtgaacagaatctggcttagaagaagtgggtatccacggtgcccgagcctaatcttacatcttggatttgtaagtggcatttattgagttgaacatgagcttgagcacgcggtcacacattctttcagcaaacactggttaggcaccagctgctacgtgcaagcactgccctacatgctgggacgcagctgtagtaggaatgaaataacgccagcattcctgcatgcgggcagtgcgggccctgtacagaaaggtacacgagataggcatcctcacatccattgtcctgggaggaaactgaggctttgagaaacggagaacttgccgggccatttgactctacgtcatcccctcccccatcaatgccctgaacagcctcctgtacacccttaaggaacttactttgtaatgattattaagaactcagcgagaccccgagcatcacctcggcatatcgcatcctttctctagagaacccctaatgttggaagggatcagagcgcacctcctccgctcctgggagcacccccttcctaataataccttggggatgggtcggaaggaaaggaaaggagacgcgagaggtgtagtcgatgtgcctgcgaagcccaggctcctctggagatccttccgtccgtccctacaggagaaggctggcccgggctgctccactccccggagctgcagactgagtcgccaggtttctgtgccttcaaagccctgcgcgacggccacaccaaacacccaaaccttgggcagggaccaaacggtcacttccccgccctccgggctcaatatgcaaatccgagcaccaggaagtagctgggacctctcggccgagcccagagacagccagttcctctcccgccgcgccgggccgcgctgccgctcgctccccggccgtggcgcctccgggccagacgcgctgcagcctccagcccgcggcaagcggggcggccgcgccacccccggccccgcgccagcagcccctcgccgcgcgtccagcgttcccggccagcagcctccccatacgcaggtcctgctgggccgccccgtcgcgccccccactctgaactcaagtcaccgtggagctccgccgccccgaaactttcaccgcgagcgggtgagtcctctgcgcgagcccaagggtgggcgcgggcacgcgggcagtgggtgcaggggccgcggctgtgccaccagccggagtcccgggcgcagggtagactcggggccgggggcatcggcgcggcccgcggcggcttcctggccgcaccgcctctgggccccggcggcgaaggctcttagatgtcttcagccgacgggtgaccgggcccgggggagccagggcgcggggactgaggctccgcaggtgtccgccgcggagccgcgcaggggagcggtgggaggtgcgggcgcgggggcgggctcaccgcgtgtccttcccggtgagggcccgagggccggctgctgtccctgctccggccgcttctcgcacacagtggggaagccgctgcccttgcggagcgggcgcgcggcggggatactggagaggactcctcggattgtgcaatctgatctcccctctggaccctgggtctcctggcagtgggagatggggctcggccggcgccctctcgaggcccgcggacagttgccctccctggtggccccgggcaggagcgtgacgtcgaggggctgcagcggaggctggaactcaccctcccgctgcggcgcctctcggcctgccgaggagcagtccggtgcttttgccggctgagaggaagcgagagttattttaagaattcaggggttgcctttccttcgccttgggggaagggcgtaagagtcagttcccactttcctgcattctctgggcccatggtggcatcttttgcttgcggtgcattcgtaactttccaacagcctgcctgtcatgtggattagcggttgtgtttttgtatatccgagtgtgttaattatcccaaattcgcccttcttcgccagctcagaatctaggccttgcacttttctggctgtatatttaggggaccgattattgaaattcgcctgtttgagtttcttcatctttgagagagcatatatacctcaggggctgtttagtacacacaaagcccctagtacgtaccaagcatttcataaacgatgttactgttatttattgcagtgaattctattcatataaatgaggcttcttggttctttgcagcttggtgatgttgaagctaagactaccatgtcagatttagccatctgaccttattagtaaatctgcttaataaatacatgagggatttgctgtcccaaagcagggcccagtagtctgactttccctaaagaactagccaataaactggtgggctacagggatgttttctctgtacagccaacacctaaagccatgccctggggaataggcactgcaagaacccaggccttactaagcccttctctgtaagagtaagctttgttgggaaagggtgggatccagttagtccctccattctcatttggaggtaagcaggtaagcgctttgaggcctgaataaatttcactggatcatagagtctttggtgactgggcctctttggatgtaaatgtgtggcccttttgctgagtgaaggatagagggcagcagatgtaaggggagagaaagtaggagccaggaaccttgagttttggcctcttccatcatttaatatgctgtgatttgggataagccacttgggccatttattcagccaagatttcctttatagcagcagccagagttatattgatttgtctgcaggttgatagtctgtattaaccattacagtggaagctccatgaaaactgcttcatctgtcttgtccaaaatgatagccccagtgcctggtacatagtaggtgctcagttcgagattacttggaagaaggaatgaaggcctcctgtgagcttgccctatgcaaaactgaggacatagggagatgaagaaatagagctggtccctaaggtgtttgaagcctactggccctttctgttgtggtttctaaaacggggatttgagaggctttgttgactgtaaagttacccagcactgagttacccacatttagtgtgggtaactaaatgagagtctccactcagcaccgctcttctctacttattactggaagagaggtcctgatgtggggtggttaagatgtttcctgcaaaggtagttggcccaatccagaagacctacattattttagagtcattggtgttacaaaggtaggtcgaaactttgtaatcccgcccctgccctccaatagctttcttttagcagaaaagtggtccagcactgttcaatgactttgaaagccttttacttctatctgcaatatttgtttttagataaatcaccaaaaacatctgagattccagttggttcacatgactatgtggagttgtaacttaacaaaattaaatcatattattcatgtacaaacccatactaactttataaataaggacaccatgtatacatgcccacagcagggaacattgttataagctcactcctactgatgatctcagtgatgcatggatgagtgttaacattgaaaggccaccacaatcattagtcaggacattgatcaatgtcacattgatagcagagatagcctcagacctttactggctcttcctagtgatgatggtgaaggtgttagcacctttcatttgttcagggctctgaagtcttcctgaactctaatttcatttgaacctcttgtggctcctataggatggagagggacagatacagaaaaagattcagggggttgtctaaggtcacaggcttggttaagcggtaccattaggagtagtaggtatgttttttggctctttctacttgtctacctttggacttgtagtgtgtgctcaattacaaatgcctctcaacttatgatgaggctgtgtcccaataaacccaatcgtaagttgaaaatactgaaagtagaagatgcatttaatacacttaacctactaaacattatagattagcctaacctaccttaaacatggtcgaaacactcacattagcctactgttggacaaaatcatctgacacaaagcccatttgataataaagtgttgaatagctcatgtaatttattgaatactgtattaaaagtgaaaaatgaaatggttgtatgggtacttgaagtacagtttttattgaatgcctaatgcttttgcaccatcgtaaagttgaaaaatcattaagttgcagaccatctgtgcttaaaagcaaataaataggtcatttaacaaacattttaaaagtgaaatcatgagttaattttcttttatcacttggtaattgtctgaactaagtggctaactgctcaggacatagcagatgcaccatcaagctgggcacttcaagctgtcttctagaaatgaatttctgtgctttttagcactgctttttgcttgggggtgggaaagggtggtctccagtaactgctaagatgacacctatactggctgctgtccgagcagccctagtgactgtcttgggggcaatcagttgcttaatggttaatacagaagtacctgagtaatactttgcaaaaggactttccccgacctgtgctgggagtgtctccctgtaaactttgccaacctcctggttgttttatcagtgagagcatcatttaagtgaaaatataaattaaggagacagggctcataggacgcacattaaaacacctgatcattttgagcacctgctgtgtgcaaggcactgttctaggccaacagtatagatatacattgcctcccatcttttaaggctgataatgaagagaagaacatggaagaggaagttgttgggttttttttttccagtcagaaatactgaaagatttcttacagctgtctggtttcctgatacttaaattgtgaaactttaagttcactccattatcatttctaaaatttattttgaataagttccctttcgggggagatacccatgtgtagagaatggtatggaaatctgccaatggagggattagaaattttgtcagtttaaagacttggaccttttgagatttttgttgttgttgttttgtttgttcttcttttctgagatgaaggctcactctgtggcccagcctggagtgcagtggtgcaatctcagctcactgcaatctccgcctcctgggttcaagcaatcctccctgcctcagccttctgagtagttgggattacttacaagcatgtgccaccacacccagctaatttttgtatttcctgtagaaatggggtttcatcatgttggccaggctggtcttgaactcctgaccccaagtgatctgcccgtctcgtcctcacaaaatgctgggattacaggtgtgagccactgcgcctggcctttctggggtatatttggcttaagttagttggaagggctctctttattttttattctgcctcccactgaagagacagagttcgctcttgtcacccaggctggagtgctttggcgtgatcccagttcactgcacctccatctcctggattcaagtgattctcctgcctcagcctccctagtagctgtgattacaggcgcccgccaccatgcctggctaatttttgtatttttagtagagatgggtttcaccatgttggccagggtggtcttgaactcctgaccttaggtgagcccgcctcggcctcccaaaatgctgggattacaggtgtgagccaccgtgcctggccctgtcttgtaatttagaagagcaagtttaaatacttgggatgatgtattaaaaagcctcatccatgctgacaagagcagggcctgtagtagcctttgttgtttatcctcttcatcctgttctgtacttcgttttctctcattactgaattagctggcagcattccttatttgccacagagctatttcttaaaagctgtacttacactcaggatacagttttccttggtatagaactcttccatggcattgctctttcactgagctttattaaccctcaggcttccagtaccccttcttctgctctccccacttcattccctatcatcttacaaaggcttcttcaaccaggaattggcatgagctgaccgtgtatgggaagagattgtcagttaacctcattattgtaaatgctcagtgttcagaatgctgctacttaaatgacatcctatagaactgcatgaatcgggatacatttaaataatccagttaagtggctgtttcttgatggttgaggctctgcttttgggttgtagaacactgggaagaagtcttcacagctcagatagttttttagttggtctcatttcctttctacagtccatgcttcaggcaaagttacatattgcctgcctgcccacacctttctgtgagcatctgaaatcttgctcactcctctttattgacaccagaccatactggttggaagcttctttccagtccccgctttcctccctccattggtaaaacatctggtggggaggtcttcgtgtggtctttgggcctacccttgggcgctggtacagtgagactggagagatgggtgtgtattcattctgcctcccactgaagcaatgacgtcttcttggtgtttgggtctctgggtgcccccactcttcctgtaaatgttaacccccacggaggtgaggggaatggagaagcttatctcagagaggctctctggagagggaggaccacttctgctttccagggggaagctgtgtcacggagagcagaactgtagcccgatgctggagagaaaaggccccagaggaggcaggcaaggaagtgatacttcctccaccccaggcccctgggtcatttgcctgcagccccaccttccttaccacccaatgctgcgttttcctcggggttctttctaccctctgctgccctctgcattttcggtttgcccttaagtgaggggtggggcggggtgggagagaggagcagtctagagtcttaagggcagagcctgctttgcgaagcccaccctggccatgcctgactttttcagcaacggaaaaatgtacattttgaaattccccgtcatggaaagtgttatgaaactcttgggtagacgtttcgaaatcttttaatgttcaggctacataataatttttaaatactaactataataattcaggactattttaaaaattgttaaattccttgttaaattcttgggatagaacagtggctgtcaaacatcttttttttttttttttttgagatggagtctcgctctgtcgcccaggctgtagtacaatggtgtgatctccactcactgcaacccctcctcccaggttcaagcgattctgctgcctcagcctcccgagtagctgggattacaggcatgcaccaatgcgccaccatgcccggctaatttttgtatttttagtagagacagggtttcatcatgttggccagcctggtctcgaacacctgacctcaggtgatctgcctgcctcggcctcccaaagtgctgggattacaggcatgagccacgcgcccagcctgtcaaacttatttgaccacaacccatagcaagaaacattttaccttgtgctcaaatacacatatctgtaggcaaaacaaaatagaaaaaggaaaatacaatctggtggaacagcccctccccttaacttgcaggggaatgtggcctggagcagcttttctgaggtaggattggccagctccatcagagtttgtttgttctgatgcataatagatatacatagtttcagggcacatgtgataatttaatacatcatataatttgtaaagattaaatcagtatttgcgatagccatcaccttaaatatttgttttctttttaaatgctgaatcttttgaattcttctagctgttttgaaatgcacaatagttaatggtgaactctagtcaccctaccaggtcttatttcttctatcaaacagtatatttgtatccattaatcaacatattttcatccccccttccaacgtacagagatgggcagtccaatagggaggtttattaaacaaacacaaattaagtcacattcatataatgggatactttgtaaatatcttaaaagataaaacattcaattacagttactaatatgaaaaattttttttcaaaagctgaacacggccaggcggccaggcgcagtggcccttgcctgtaatcccagcactctgggagcatgaggcaggaggattgcttgagctcaggagctcgaaatcagcctgtgcaatttgtctcaaacaaacaaacaatagcaaaagagctgaacacaaactagtagatgacatgataccatttctgaaataaaatattcatatatggacacatcatctataaactgcatttcaaacaatttttatactaagatcttaatagtgattatttctgggtgacagttgagtgctgtttttacttctgtacgtctttatatttaaaagaatgagcatcccatatatacataaatatatatataaatcccacatataaatatatacataaatcccatataaaaatataaatatatatatatatatatacacacacacacacacacacacacacacatatatatatattttttttttcctgagacagagtcttgctctgtcacccaggctggactgtgatggtgtgatctcggctcactgcaacctccacctcccgggttcaagtgattcctgtgcttcagcctcctgagtagctggaattacaggcacacaccaccatgcccagctactttttgtatttttagtacagacagggctttgctgtgttggccaggctggtctcgaacttctggcctcaagttatccggctgcctcagcctcccgaaatccggggattacaggcataagtcattgcgcctggctccttatatgattttaaaacggcaggatataaggagcaatggaatgaagccagtgggactgcagaaggcaggtggaagcagacagggaactttggagctagagtgacttgaaggacgcttgatggatataattgtaagagtcctgtctcaggagagctgatgcgctgtaaatgttgtaaatagaacattttcttaaagaaccttccactgctatgtttagtattcagtttagcaaacttttcctgggtagctactgggagtcccgcacagtgttaggagttggggtacacacctgccatgttggtggaaatcctgaagggagtgggccacacaccctggaagaaggggctttcctgaggaaggacagcctgactatgcaggggtcattccacattaccagagcttgttccagagaggcagtgggaggctccacaggcaggcttggagggtgcttggccctaatactaaatgttggacttcatggcattaacgaaggggaatcactggagccttttagtatgaagctaatttttttgtccatcacaggcaacttcttgcctacactcttttacaatatggcatttatgacatagccaagagcgaagacacgttgaacactgacttaatgctttgagtaggtggagagttgaatgactcaaggctacttctctagagattaatttgaagctagaaagtaacatttatttctgttttctgtgacagcaataggcttcagcttgtaatcgtcatctgcaagtaggtacttgacacctcccctaagtgacctggagagtgacagatacagtaatgggcacaatccttggttttttgttttgttttgtttttgagacagagtctcactctgtcatccaggctggagtgcagtggtacgatctcactcaccagggatttggccaccacgcctggccgaatccctggttttaagcaaaattttaatatggagtttatggttgttggtataatgaaatgcggcaccatagcagttgatttttgtctttcagaaccacactggctttttgtattatttcaaatttgatagatgcccaatgtatgtaacaaaaattttccctcacgtgtatttctttctttatttatttgtatgttttgagatggggtctcactctgtcgcccaggctgaagtgcagtggtgctatctcggctcactgcaacctccacctcccaggcccaagccatcctctcacctcagtactgggtagctaggattacaggccccgccaccaggcctgcgtaatttttttgttttttgggaggccaaggcaggaggataatttgagctcaggagtttgagaccaggctgtaaccccaggcaggagtacagtggtgcagtcatagctcactgcacccttgacctcctgggctcaagccatcttcccacttcagcctccaagtagctgggactacaggtgtgtgccactatgcctggcttattttttgtagagatggggtttggccatgttggccagcctggtgtcaaactcctaagctcaagggatccacctgcctcagcctcccaaagtgctgtgctgggattacaggcgtgagccaccacacccagcccaagtatatttatcgagtgctgtatgtcatgatagtgggtggtttgggggaataccaacataaataagtgggaggtttctatcctagaggagtttattgtgctctgttctctctggattgttcacaaaccagaatgccgatcaaagactttgctagggttgtgggtgggcgacttgctcaggagatccctggcacccaaatgagtgcccagaaatcactctgaatggtcaaaagtaaggcagggcagggcggtagagcacagggtgtcgaattaatttcatgtgggggctgaaatcccaggtctgtcccttcctaactgtgggctgctgctggcaaggtgctggccttgctagcctcagagtcctcatgtttaaacctcagcagtttgttgtgagtgttctaggttacagtggattccaaactagccacaagtgaagcacatggctaaatggtagtcattggtattgttatcaaaagcaagttgcttagctgggtgaagtggctcatgcctataatcccagcactttgggagcctgagacaggtggattgcttgaagccaggagttcaaggccagcctgggcaataaagtgagaacctgcctctatagacaaaaaaaaaaaaaaaaaaaaaagaataaataaaaacaaataaaaattactcagagtgcagtgatgtaatcctatagtctcaactactcaggagactgaggcaggaggattgcttgagcccaggagattgaggctgcagtgagcaatgattacaccaccacactccatcctgggtgacagagcgacagcctgtctgtaaaataataataacaataataaaaagaaagttgcttaggatggctactataaaaaatgagaaatcatgatgaaatcatgtcatgttaaaaaagaacacaacaacaaaaatcagaaaataataagtggtgccaaggatgtggagaaattggaatcctgtgctttgttggtgggagtgtaaaatgctacagctatgatggaaaatcatatggtagttcctcaaaaaattagacatagaattgccatatgatgcagcaatgctgcttctgggtatataccccaaataactgaatgtggggtctcagagatatttgtacacttgtgttcatagtagcattattcacaatagccaagaattagaagtaactcatgttcatcaatggatgaaataaaatgtggtttatatgtacattggaattttttttttttttttgaaacagggttttactctgtcacccgggctggagtgtggtggcaccattacagctcactatagacttgacttcctgggctcaggtgatcctcccacctcagcctcttgagtagctgagactacaggtgcatgccaccatgcctggctagttttttgtattttttgtagagataaggttttgccatgttgtccaggctaatcttgaactcctgggctcaagcaatctacctgctgcggcctcccaaagtgctgggattgcaggcatgaaccaccgtgcccagccatacaatggaatgttattcagcctttaaaaaaaggaaatgctggctgggtgcggtggctcatgcctgtaatcccagcactttgggaggccaaggtgggcggatcacctgaggtcggcagtttgacaccagcctgaccaacatggagaaaccccatctctactaaaaatacaaaattagtcgaacatggtggtgcatgcctgtaatcctggctacttgggaggctgaggcagaagaatcacttgaacccgggaggcagaggttgcagtgagtcgagatcccgccactgcactccagccagggcaacaagagcaaaactccggctcaaaaaaaaaaaaaaggaaatgctgacacatgatacaacaaggacaaaacttgaggacatcatgctaagtgaaataagccagacacaaaaagacaaatactgtatgagtccactaatgtgaggttcctcaaatagtcaaattcatagagacagaaaatagaatggtgtcttccaggggcttgatgggggagggaatgggaagttactgcttaatgggtacagagtttcagttttgcaagatgaaaagagttctggagatggatggtgtgatggttatataagaatatgaatgtacttaatgccactgagttatatacttaaaatagttacgatacaagttttatattgtgtttattttaccacaactttaaagaatgaaaaaaaagttgcttgatgagcagatacgtgtacaaatagacagaggtgtccttgaggatatttcattaagtttgataaattgcccttcttctggctgggtatttacctaccaagcagacgggtgttcacttttttggcagagagaggacaggatctttactcttcgtcatttaatacatggccacgtggattgctggctgacagtatattgaaatggctgtgatgtgggagagggaatgataatggagaaatttacaaaggcagagattgtggattacaaagtaaggagaaacttctaaccatcaaagctgcctgcatgggtcctggagaagggtccttctccatcattaaatgtttgtcagcaaaggctaagagattcttacaagaccttttagaaaaggttgcattaaggccagggcgcagtggcgcacacctgtaatcccagcattttagaaggccgaggcagatggatcacgaggtcaggagttcaagaccagcctggtcaacaaagtgaaaccccatctcttctaaaaatccaaaaatagccaggtgtggtggcacacacctgtagtcccagctacttgggaggctgaggcaggagaatcacttgaacctaggaggtggagtttgcattgagctgagaccacgccgttggactcctgcctgggcgacagagcaagactccatcttaaaaaaataaataaataaaaaagttgcattagatggctgtaaaaggtgcttcctgatttgatgatacagttatattaatatttctagccatgcactcattaactccaaattacataataagaaagtatctttcttttttttgaggcagggtcttgctctgtcacccaagatggagtgcagtgataccatcatagttcattgcagccttgaactcctgggctcaaatgatcctcccatctcgagatcccaaagtcctgggattacgagcatgagccattgtgccttgccaaagaaagaatatttctgacacagttctttctaacaggattcgagggaattttttaaaaagttttcccaatgcaggagtgtgtgtgtatgtgtgtgtatgtgtgtttaaaatttaagtataacacttacatagaaaagtgcagaaaacagaagaatctagctgaatgcaaagccttgtgtaaccacccccatgatcaaaaagcagaatgatgttgaccctcccccaagcagtactcccccgaaaggcatctgccattctacttctagtttttgtttagtttccagtgtaggcttctaaacaataaagtgtagggaattgaaaagcagtacaaagccatttggtttggcaaataaacagattttcaagctgtgggtttggctaccaccggcatctctctgtgtgtggaatttacttgcaattcaactggagagcaagacctcgtcctgttttaccctggcgattcagttgctaaaattctcacacatgagtttgatctgagccttatttaaatacctttttattcatccattaattagtaaaattagctggcataagctatatatagctggtttttctgcacagccaagtcaatttataaatgcaaatatgtgggtgtgataagggtggtttccactgacccacatgtaatcaaacatcctgttatatgacacagtgccagtctgtgcataggcatttgaaagtactaactgggtttgtgaattcagtgatgctgttcttcaataaaataaagactcatttttctgatgttaaggaacacagcacctttgttactgactgttatttcaacttctgtttcatgtagttttgatatttatttttgttgggggtgacagagagaggcataattgacctgtggcatttgttaatccatgaagtcatgcttcacttatgcatcattcagaaaacacttcttggatactcactactcatgaatatgcatgcatatgacttgcagtcaaagccatgagttctcaatagcaaaactgttccagatatactcagagagttaaaatgtttaaaaaacttttttttaaagaaaattttccttttatttttgttgttttgttttgttttttttttagaagcaagatctcactatgttgcccaggctagagtgcactggccattcacaggcacgattatcactcacacactatggtcctgagatcctgggctgaagtgatcctcctgcctcagcttctcgagtagctgggactagaggcatgtgccactgcacctggcttagagtataaatttttgtgtcacacaagatatgaagaacatgcacaggcactggacccatctgtgggttcatctttctgtgggacccactaagggacccatctttctgtgaaaaagtcacaagtgaagtcctggccatgcaaggaataaccataccccaagagatcatgctgagcctgtagtttgcctgtctgcatcccccaacccccccagcttatttttattttattttttactttttattattttagacagggtcttgttctgttgctgaggctggagtgcagtggcatggtcatggctcctgcagcctccacctcctgggcttaagtgatcctccctcctcagcctcctgagtagctgggactagaggtgcatgccactgtgccagattaactttcttaatttttttttttttttgagacagtggtcactttgtcacccaaacttaagtgcagtggctcaatcttggctcactgcagcctcaacctcctgggctccagggatcctcccaccttagcctcccaagtagctgagactacaggcatgtgccactacacctggctaatttttttttttttttgacggagtcttgttctgttgcccaggctggagttcattggcgctatcttggctcactgcaacctctgcctcgtgggttcaagctattctccttcttcagcctcctgtgtagctattattacaggcacctgccaccatacccagctaatttttttgtatttttagtagagacggggttttgccgtgttggccaggctggtctcaaactcctgatctcaggtgatccacccgcctcagcctcccaaagttctgggattacaggcatgagccaccatgcctggcctgcctggctaatttttgtattttttgtagagatggggttttgccatgttgcccaggctggtttcaatctcctgtgctcaagtgatccatccatgtgcttcagccttccaaagtgctgggattacaggtgtgagccacagtgccaagcctaaaattttttgtatagttggggatctcactatgttgcccaggctggtcttgaactcctggtctcaagcgatcttcccacctgcttcagcctcccaaagtgctgggattacagacgtgaaccactgcagccagccccaaaacctccagtttatttcctccagccacagttcctgatgcttggcatctctgcgttttaactgcttgtctctgttagcaactgctggatgctacagaggatttgaacaaagagtgaatcctgagaatggagggaatattggactaaggagactgaccagagcagaacagtttccaagtgaagaagtgagtcccttagttggaaataaagtaggaagagatggggaaataacttggctggattccttactaatcttggtgaataatataggtatggattagtaacactgtagtagctaatgaaaaatattccaggttgtgaactttggggtgtctgagagcagcatgatgtcgtagtcataaactgagagtcatgaattggtttctgggctgggtgtggtggctcacacctgtagtcacagcacttggggaggccaaggcaggaggatcacttgaggccaggaattcaagaccaggctgggcatcatagtgagacctcatccctacaattttttttttaaaggaattggcttctagtcaatgctttgtcaaataccagtcttgggacattagatgaagttccttcatctaatgtttttctaatacataaaacagtaataacagatttttgtttggtatctcatccagttgttgcaaggattaaacggggtaatgtacctgggagttccttgaagagtctaattttctacccagttttggctgttgttttggattaaactgtactaccccgagccttttcttgattttggaggatccctacccactccctactcatggtacccctggcctgttctggtagattcactcatgcatcatcaccagtcctgtggggaagtggaaatttggtgtacataccaggtgcactttcattcttctcaaaatgttatgacaaatagcaaagagaacaccttttcttttatcattagctcatccttaagcatctcgttaggggtaaagcaatttaaaaaaaaaaacaagttttagctagacgtggtggcatgcccctgtcatcctagctgctctggaggctgaagtgagagggtcccttgagtccaggagttggaggctgcagtgagctatgattatgccactgcactccagcctgggtagcagagcaagactctcatctctgaaaaaaaaagaaaagaaaaagaaacaacaacatcaaacaaagaaacaaaagcaagtttataaataaagaaacagaatagcagggacatggatgcagctggaaaccatcattctcagcaaactaacataagaacagaaaaccaaacacggcatgttcttactcataagtgggagctgaacaatgagaacacatggacacagggaggggaacatcacacaccggggcctgtcggggggtggggggcctaagggagagatggcattaggagaaatacctaatgtagatgacgggatggtgggtacagcaaaccaccatggctcatgtatacctatgtaacaaacctgcatgttcggcacacgtatcttagaaattagagtataataaaaaaattttaaaaaaaagaaacatagaataaaaaccatacctaatttagtaagagaggcattccccccaagctcctcacgtttatttatttatttatttagagacagagcctcgctctgttaaccaggttggagtgcagtggcgtgatctcggctccccgcaacctctgccttccgggttcaagcaattctccctacctcagcctcctgagttgctgggactacaggtgcccgccatcacccccagctaatttttgtatttttagtagagacggggttttgccatgttggccaggttgatttcaaactcctgaccttaggtgatccgcctgccttggcctcccaaagtgctggaattacaggcatgagccactgcacccggcctaaacttcatttaaatgatgaggaaataactgcaatggaatgagctggttggagaacgatgttactcacccgaacgctggctttatgcagtttcaacatccacaggtatcttctgattgatcgcattacagtcttgacctaatttctcctgataaggagctgaaaatcaagcaacagtacattagaactttgattcatgtgacgcctatcatgccatataaatgaaaattcagagtttagattaagaacagtaaagctttctctgttgtaccttaaaaggtacttccctcctcctcataataataagctacatgcttctggaagttttaccaagacttgagatcaggagggagcattctgacgctgagcacacctctgactttgcacatggtggtttcgaggggttgacagcagaagatctccagagtctagtaacagttctgtcttactgttcaaatttgccttttctacctcaatttctcctccattttaacagaaaacctactactactacttcatatgtatctaaaatatttcaaaatctttagtaatgggatataagcactcttagccatcagaataacttttaaggtcaggtgcagttgctcacacctgtaatgctagcactttgggaggccgaggcaggaagatcacttgagcgcagaagtttgagaccatcctaggcaacatagtgagacctcatctctataggaaattaaaaaaattagccaagagtggtggcatgggcctgtattcccagctactcaggaggctgagttgggaggattgcttgagcctgagaggtggaggctgcagtgagtcgagatcgcgccactgtactccagcctgcgtgacagtgaggccctgtctcacaaacaacaacaacaacaacaaaaacttttaaagattagtaagcaatttttttctttggaaaaaattaaaatgaaaatagacgattttaagaaaactttttatgttttttaaatcaactttaaaattttgctatatagctctatgaattttaatacatgtgcagattcactgaattattttcataatgagaatacagaaaagttctgtgacaccctccccccaaaaaaaaactttcttgtgccacccccagcccaatgcctggcaactgctgacctgttgtctgtccccattgttttgtgttttctgtaatgtcatataaatagattcatactgtatgtgatcgttttattgttttttataataacagctttatttttacttttaattttgttttgagacagagtctccctctgtcacccaggctggagtgcagtggcacactcttggctcactgcaacctccgccttccgtgttcaagcaatcctcccatctcagcctcccaagtagctgagaccacaggcacgtgcaaccatgcctggctaatttttgtatttttggtagagacaaagtctcaccatgttgcccaggctggtcttgaactcctggactcaagtgattcacctgccttggcctcccatagtgttgagattacaggtgtgagccacccacacccagctgaataatagttttattgagatataattcacatattgtataattcactcaaagtatacaattcagtgatttttagtatgttcacagagttgtgcaatcatcaccacaatcaattttagaacatttttattacacaaaaagaaattctgtatcctttagccctcactactctcttccccttgtcctaggcagtcactaatctatttctagctctataataaattttaggaaactggttttaatgatttcctttttttaaatagacagtttcttgctctgatgcctggagtgcagtggcacaatcacgatcactgtagcctctgatcttctgggctcacgcaatcctcctgcctcagcctcctgtgtagctgggaccacagttgtacaccactgtgctgggctaattttttttattttttgtaaggatgaggtctccatatattgcccaaagtgttgggattacaggcatgagacactgtacccagctaagtttctttcttagttggaagagttttacaatgatgccagcacagttactacctgttttacttttgtatcaggcaataattacctttcacagaaaatatagtaagaatagcaatcctttattaaatatttgtcctctgttaggtagtcaattccttaaaaggtgtaatattgatattcttgttattgataaggaaacagatgcttggggataataaatattatgctcacttaactactaagtaaatggaacccaagtcagccggacccctaaactgatgtgtttgttttatttaactttgaaaggttattttttaaaaaatcacagttgtaatatgtggaacataatgtccttgactttagtttatcaagcagactttatacattaacataaatgtaaacgcaggaataagaccacttctgggaaatgtataataaatataatgcagagaacatttattgagtgcacacggtatgtcattcgttcttctaaacactcgtcaagattgtattcaaccaatccttataacaagtgtgtgaagttggtacagttatcatcccttttcttttcttttcttttttcttttcttttttgagatggggtcttacacagttacccaggctggagtgcaatggcacgatctcagttcactgcaacctctgcctcctgggttcaagtgattctcctgtctcagcttcccaagtagctgggattgcaggcacacgccaccatgcccagataattttttgtattttagtagagatggggtttcaccgtgttgcctaggctggtctgagctcaggcaatccacccgcctcggcctcccaaagtgctaggattacaggcatgagccaccgtgcccagccttatcatcccttttctgcagataagtaaagatgaattaccttgccaatgtcatgtcactgtacgaggtggagctgaacttgggcctaggatgtttagctcaagcttaactactgctccaggaatctaatgcgctgccactcgaacttcaggaagacaagagctcagacactgaaaaccagtcagcaaggccaaaacaagagagcccccagttctgccaacttggtgcaatttttactataaccatagctgggaaaaatgaagaagaaaaaaattcactggagttgcaatgaatatttaaacattgcgtcaagtttaaagcatgatgagtgtcaagccagttgagttttctgcattaacttcagctgacaactcagtttatatctattataaatgtcactatttgttgggggaaaaataatcttcctcttttttatttttaattttttttagggataggatttcattgtgttgcccaggctgaagtacagtgatgtgatcattgctctctgcagccttgaactccttggctcaagtggtcctcctgcctcagcttcctgagtagctgagacttcagagtcacatcaccatgcccagctaatttttttttttttttttttttggtggagataggaccttactatggtgcccaggctagtctcaaactcgtggcctcaaatggtcctccagtcttggcctcccaaagtattgggattataagtgtgagccattgtgcccagtttaattttcttcttttgccaaagcaaagctaataatttttttatagctaagatttaattatgtttggattaaaccttctcttcagtatgtatctcatacttttcttttgctaaatacttatctagcttgcatttttttccacattaaggagaatagctcttggaaatcttatattctcctaactctttatcttaaaatgctgccacaaaatcttagacattgaaaagttattaaggttctagttgagagtttactaacaacaaaaagaaggataattggcaaagaagacgtggattgagtgagccacatagcccctttcctgttctggtttcttggtggcatttgcagcagtgcctctatgatgcctgagcaaaactggtttattgggaagtgatgtaaaccatactgccagtgcttttgctcagcacttgggcacttcgtggccgtgtgtctcatatgatgttcataatgcttttttttccctctccttccccccgtaatactttatgaatagatgtttccacttctgaatagttctccgattagaatagcagttacaaaatgggtaagacttcacctcgtcctttaaaacaggaaaattgatagaattcctccacctcctttcattactgaggctgtcagatgattctttaagcaaaaccccagtgttctcttgtctgatgaagtcagtgtaagtgatggtatttttacattgactttaatatgaaaggaactgtttaattgaacggtttcatctcaaggccaggctttagactccttcttgggctcatgcatgggatccttcttttgcacacctgtggcctccctggaactacttctggtggtttccctggacttagtatcccccaaacctggcagcccagggcctagtgacaggcagaggaatgtattgctcttgctctgtggggtcaggtagggccgggggaggtcctgcatgaatattttcagtgctgattcagaaagagcattgggcatacacttcaggaaaccctacctggaagctacagcagcactgctctatcctagactgaccacttcagatatttccaacgcggagctggatgtggctaggaaccggctcccagctgaatagcttgtgctgagtcattatcaagttgcatttcctggctcaaccaaagataagcagggaagaacctaaatcaaaaatgactttcagactgtgatttgggttagtataccacctcagggcagcaatggagtcatgactgcacagacacgggaaaggatctggttgcagaaaccaagtgagtcagtgatgatgtatcatcattctaaaaaacgtacctgtactttcttttttttttgagacgagtttcactcttattgcccagactggactgcaatggtgcgatcttggcttaccacaacctccgtctcctgggttcaagcaattctcccacctcagcctcccgagtagctgggattgcaggcatgtgccaccactgcttggctaattttgtatttttagtagagacagggtttctacatgttggtcaggctggtctcgaactcccaacctcaggtgatctgcccatttttgcctcccaaagtgctgggatgataggcgtgagccattgcgcctggccgtaacagtgtactttctttctttcttttttttttttttgagatggaatttcgctctgtagcccagattggagtgcagtggcgtgaattcagctcactgcaacttccgcctcccaggttcaagcaattctcctgcctcagcctcctgagtagctggaattacaggtgcgctccacaacgcccagctaattttttttttctagaagttgaattgtacaaagtacacttatattttgacacctgatccaaaacacagtcatgtaccacattacaatgtttcaatcaatatatagcatacaaaaaaaaaacaacaacaacagtagtcctatgagataagagctgaaaattccttattacttaaatgttattttgaaagtcaacatttttcttctacatattttactcataagcatggcaaaatgttacaggtctcattgtcaccactgcaatatgcatactgtgatggaagcataacctatctcaatttagccacattaactatttttggacaccttgatcaacagtgcccattctcatctagcatgaggctttttttttttggagacggagtctctctttgttgcccaggctggagtgcagcggcgcaatctccactcactgcaacctccgcctcttgggttccagcgattctcctgcctcagcctcccgagtagctgggactacaggtgtgtgccaccacacccagctaattttgtattttttagtacagacagggtttcaccatatcggccaggctggtctcgaactcctgacttcgcgatccgcccacttcagcctcccacagtgctgggattacatgcgtgagccactgcgcccggcctacgcccagctaatttttatatatttggtagagacgggatttcaccatgttggccaggctggtctcgaactcctcacctcaagtgattcgcccacctcagcctcccaaagtgctgggattacaggcgtgagccaccgtgctgggccttgtactttcttgaatgggaagttgtcttcatggtgagcagctcttctttgaggtgtttatttgaagtattcaaaagaacagagagattccagtagggaacaatgaaaatattaaggcttctatatcatgccctgtgagggaaagtagacaaagatgaaataaacttcaacaagagactaaaaaactacttgagtgtttttgattaccaacttttcatgagctgaatagtttgaaaatttgctgcttttctaagttttccctttaagatcagggataaatcatttcctggaaggatatttttcactgtaagctctttctgtttctatgttgataatctaatctgaataattaagttttattgagaccttccttttgaaagtaacttgttacctatgtatgattaacctggctattattctaaatgtagaatttaaagtgttttatccatggtagctcacacctgtaatcccagcactatgggaggccaaggtaggaggattacttgagcccaggagtttgacaccagcctgggcaacatagagagaccctatctttacagaaaataaaaagaaattagtcaggcatggtggcatggccctgtagtcccagctagctacttgggaggctgagatgggaggatctgcttgagcctcggaggttgcagctgcactgggctgtgattgtgccattacaacagagtaagacagagtctcaaaaaaaaaagtgttttatcatttatgtagagcttggagtttcaaacataaagtagaattactttatcacttgtaaaaaatgtgttctctgaaagttgataaacaatgaggtagaatgactcctgaaattaaaaaaaataatagcaggactttaatagataaatctgaaataagtacgatgaacaattttttaaataaaatataccctgaagctaatactttgtaaataccaacattttctttatggctatagtgtaaccaaattcaggagtaagtaactcaattatttggctgtcgggttgatggaatgaaaataaatttcttagaatatgatatgaaatatgatatgaaattcaactttactaaactttactgaacaccagcaaatgtatttacaatcctgggttctatttgtcaatcacagaccacccttttttctgagcattttttctgttctgagttcacatatggggttaggttggcggtggataaattccagtccccaccctttaatagggcatggaattatgatgccacacaagataatttctgtatgtgttaccctgcagatcatgcacctataaaagataaagaaatggccaggtgcggtggctcatgcctgtaatcccagctactcgggaggctgaggcaggagaattgcttgagcccgggaggtggagtttgcagtgagccgagattgcaccactgctctccagccttgtaacagagcgagactccatctcaaaaaagaaaaaaaagaagataaacataaaaggtttccattgctatgatttcaattctagggtggagctcagggtttggcaaggttccctacattattagactgcgcattttaccctttttcaaaagcaggtaaggttgtagtgtagagtgtggctagtgattctcaaccctggctgctcattagaatcaatggggagcatttaaacctccccatgcccaagctgttccctaaccaatgaaatgggaatggtgggggcctaagcatcagtattttttagagttccccaggtgattctgcttgtgtaccaaggatgagaatcattttactagattcagctatgtgggaatctttcggctattttagaaaacatggtgacctggctgggtgtggtggctcgtgcctgtcatcccagcactttgggaggctgaggcaggcggatcacctgaggtcaggagttcaaggccagcctggccaacatggtgaaaccacatctctactaaaaatacaaaaaattagccaggcgtggtggcaggcacctgtgattccagctactccggaggctgagcaggagaattacttcaacccgggaggtggagattgcagtgagccgatagtgccattgcactccagcctgggcaacaagagtgaaactccgtctcaaaaaaaaagaaagaaagaaagaaagaaagaaagacaaaagaaaacatggtggtcagtgaattaaggtggcccagttaatatccagtcagttcccacctgaatgtcagatgtcctggagtgctgagatgtgtccagaattgctagctacccagctagaaaagctaccgcaaggtcatctcgggaaaagggaaccacaaatgtcccagttaagaggatggatagtttcccagggttggagtcctttcttttcctagtcacccccaaacacttaagaggcctatgggatgggcaggggagcagggagagcctcactcctctcccatctgttgggagagcctcactcaccaaaacagcgttgccttgtctgtgtcatatgcatcatgtgagtgcatgaagtcccttgctccagggacttcccattaggcctggagtgtctcccatgcaaagagcccgctcctctgttcctgggacacacctctggcagtcccagaggttgcccattcatcttgacttctggaaagaagcctatagtgagaaaggagcatgtagtcagaaaccaccaagtgcagcatagttctacataactcacagcattcagtagttttgtgttgttgcttttctttctttttccatacagtagttcatctgatatgtgcagttacgcagcacctgttaagtcagagggctgggatggtgaggtcgccctgtaaactctgggcaaattactccatttctgagccatcttttgccatctgttagaatttctgatcaggatttaatcggggttggttgtgaaagagtatatgaacatgctttgataaagaagaaaataagtgggccaggcacagtggctcatgcctgtaataccagtactttgggaggctgaggtgggaggattgcttgaggccaagaattcgttttttttgttttgttttgttttgttttgttttgtttttgacagagtttcaatctgtcgcccagactggagtgaaatcacacccagcaatggcgtgatttcggttcactgcaacttccacctcctggcttcaagtgattcaccttcagcctcccaagtagctgggattacatgtgcccaccaccacgcccagctaatttttgtatttttagtagagacagagtttcaccatgttgcccaggctagtcttgaactcctcacctcaggtaatccacctgtctcggcctcccaaagtactgggattacaggcgtgagccatcacgcctggccgaggtcaagaatttgagatcagcttgggcaacgtagcaagacccagtctctaccaaaaaaaagaaaaagaaaaaaaaaagagagagagaggagagagagagagaaataaatgaaatgtatcccagttgaacaacagttgagctgaggtgtaagcctccagatgaaggaagaaggagcagccctcctgtaagctgagagccctgtccttaataaccctgtcctattgagaatgatttttcctcttcctggatcatgaatgcttgctcagtgagccattgccatcccttgcaaaacagactgaccaaatgctggcaaggatcagggagacgagtataaacaggtatagccacttgcaggaaaccctttggtcatttcttagaaaatctacatacatctacctcatgaccaaggaattccacttctagatattaatccaagagaaagaaaaacataggtccacaaaaagacatgtccagttctatatatggcagctttattcataatattatgcaaccctggaaatatctcagatgttcattatcagaagagtggttcaaaacattttgatatattcataaaatggggtattactcaaccaaaaaaatgagacactgatatattcaacactgattgaatctcaaaaacttttttttcacctataacgtattctatgataaacattattttcaataaaataagtcaaacagataagaatatgcacttcatttctgtgaagttcaggaacagggtcatgagaggggatgccttagaaaggagcaccatgggcctgtgaggtggcaaggaagctctgtgtctggttttggaaggtggttacgtgggcacatacatctaccagaactgatgtcagcacagttaggatctttacctttcattgtaggtgctttttttttggtggaaaatcaaacttagttgggcatagtggctcacgcctgtaatcccaggactttgagagacccacgtggaaggattgcttgagcccaggagttcaagaccagcctaggcaacatagggagaccctgtttctacaaaaataaaaaaattaacaggacgtggtggtgcacgcctgtggtcccagctactagggaggctgaggtgggaggattgcttgggcctgggaggtcgaggctgcagtgagctgtaatagggccactgcactccagcctgggtgacagagtgagaccctgtttcacataaataagtaagtagtttaaataaataaataaatacaaatttttaaaaatgtatatctaaataagagacagggcttaattactattgcaaacattttattaccttagcagattgtaagggttgaaaccaaaacttcaagttttacttgtttagaaactccaacagttctaatgaataaagaggattataaaatcctgggaaggattagcatatgctgcttgaggtcacactgctcgttagccataccatggatgatttgcaggcaacccgttttttcctcctaagcttgaaagctaaaaatagaattaaaggtgataagggcatcaattcccagacagctaagctgtttaaaccatttatttatttatttatttatttatttatttatttatttgagacagagtctcactgtgtcacccaggctggagtgcagtggtgcaatctcgactcactgcaacctctgcctcccaggttcgagtgattctcctgctgtggcctcccaagtagctgggattacaggcaccccccaccgcgacctgctaatttttgtatttttagtagagacagggtttcaccatgttgaccaggctggtctcgaactcctaatctcaggtgatccgcccacctcagcctcccaaagtgttgggattccaggcctgagccaccgtgccaaggctgtttaaaccttttataattgcacattcctttttagatataattttctttcttttttacttatacaatattaagaggtgcaagtgcagttttgttacacggatatattgcagagtggtgaagtctgggcttttagtgtaaccatcatctgagtagcacacattgtacccactaagtaatttctctctcacccctttcccatcctcttaccctccaaagtctccattgcctgtcattccacattctgtgtccatgtgtgcagattatttagctcccacttataagtgagaacatgcagtatttgactttataaattgttttacttaagataatggcctcctcttccatctatgttgctgcaaaatacataattttattcttttttatggctgcaaaatacataattttattcttttttgtggctgaatggtattccattgtgtatgtatatatatatatatatatatacacacacacacacacacacacacacacacacacacacacaccccacattttctttacttttatttcttcatttatttttatttcaaacactagtgtcaagggctttcagtagatcatggcgaatttgcttctctgctaagtaggaaaccctgacccagaagcaggtgggtctaggacccagaatccaggttccccatgaatgtgtgccacgtgatgggccagggtgcgactgcatttccagctgcaccctgtttcccaggaggagggcctctctgcactggaccccagtcctggcattggggagagtagtcctctagtggggacagtggggaccagccatccagggccaacaaggcccatggaggctctgtggcactgccataggttccacccgagtgggattctgacttggacatgttcagtcataatcccacagatggcagattcgccccattggctcctcagcacattttctttatctagtcatccgctgatggacatttaggttggttgcatatctttgctattctgaatagtgctccaataaacatacaagcacttgttctttttaatgtaatgatatcttttcttttgagtagatacccagcagtgagattgctgcatcaatggtagttccagttttcattatttgagaaatctccatactgttttccacagtagttgtactaatttgtattcccaccaatagtgtataagcattgccttttgtctgcaacctcaccaatatctattgacttcttgtttttccacttttgaataatagccattctgagtggtgtaagatgaagtctcattgtggttttaatttgcatttttctgatgattggtgttaatgattagtgatgttgaggatttttttcatatgcttgctggctatttgtatgtattttttttgaaaaatatgtattcatgttctttgcccactttttaatggggttgtttgtgtgtgtgtgtgtcttttttttttttttgagttgtttgagtttcttgtaaattctgcatattagtcctctgtcgaaggcatagtttgcatatactttctcccattctgcaggttgtcggttcattcctgttgagtatttcttttgctgtgcaaagctttttagtttaagtaagtctcatttgtctactagtgtttttgttgcctgtgcttttgaggtcttagtcatgaattctttgcctagaccaatgtccagaagtgttttccctagattttcttctagtatttttatgctttcatgtcatacatttaagtctttaattcatcttgagttgatttttgtatatggtaagagatatggagtccagtttcattcttctgcatatggcaaccagtttttgtagcaccatttattgaaaagggtatccttttcccagtgtatgtttttgttgactttgtcaaagatcagttggccgtagatttatagctttatttctgggttctctgttctgtcccattgatctgtgtatctatttttatgccagtaccatgctgttttggtgactatatccttgcagaataatttgaagtcaagtaatatgatgcctctagctttgctccttctggacaggattgctttggtatttgtgctttcttttggttccatatgaattttggggttgttagacataatttctaagatatattcaggtttcacttttgttctttaattttatgtattttcttcccaataaggctataagcttaagtcaaaaattgttttgcttatagctgaagagtccctgctttcagcctgccttgtgattttcatcttgttgcagttgaattaggtttgtggcacctctgctctttgtagttttcgtatcaacaccttggtttttggctttttactaattttgtttttttttttttttgagacagagtctcgctctgacgcccaggctggagtgcagtggtgcagtcttggctcactgcaacctccgcttcccgggttcaagcgattctcctgcctcagcctaccaggtagctgggcctacaggcgcccacctccatgcctggctaatttatatatatatatacgtatatagatatatacacatatatatacacacatatatatatacacgtgtatatatatacatatacatatatatgtgtatatatatatacacgtgtatatatatatacatatacatatatatatacgtgtgtgtgtgtgtatatatatatatatatatatatatatttttttttttttagtagagacagggtttcaccatgctggtcaggctgctcttgaactcctggcctcaagtgatctgcccaccttgacctcccaaagtgttgggattacgggcgtgagccaccgcacccaaccggttttttactaaattttaaaaattacaaggttaaaatacaatgaaatactcaaggaattgcgtcaaccatctcttttgtacagactgagatgactctcctggtgaccctgaactcgtaggggcagcaggtggaaatgtacattcactacttggtggaaagaagtctgaattggggaagtatttatacatatgtgaaattccattgtactagggtgtcctgtattttatctggtaaccctgggggcagtcctatgagctggggcacctgccctggagactgaggcagggagtcaaagcgacatgagattggggataggttttgcatgtccgtggaaagggcttgctgatgaatttgatttgaagattgagaaacagaggaatcaagggcgacttcttggttttaaacttcagcacctggtgccctttactgagatggagaagatgggaggggagtgggtttcaagtgtgttgtgatatggacaggtcttattgatggggtgtggtgggcgtccaaatggagatgtggaagtttgattctgagtgagctcaatatcgtcgtggtgtgttctaccacatcccttctagccctttccgcgctttctcccatctagtgtttccctgctcaaatggaaggagagaggaacaacttagagcacagtgtgactggggcaagctaccttagagataatcatttaaacaccagctagactgctgcaagaaaagaaatgatggtaaaaataaatgtactccaaaggaatttgactaaagaatatttcaccgtgtaacagatttctgtgtgccccttttgcaatgtatcattaaggatgcattgctaggcataatgaaacaaaatgtttttcgtaatgaagtggttattttgcaatgaaagccagtcaaggaaagaaatcaggcttgaatactcctagtcacaacctttataaaatctaacgttatggttagactataccatgcctgcgcttaagtagtttttgaaattttaacccaaataagaaattcttggctgggcatggtggcttatgcctgtaatcccgcactttgggaggtcgaggcaagcggatcacctgaggtccaggagttcgagaccagcctggccaacgtggcgaaaccccgtagctactaaaaatacaaaaaattaactgggcatcgtggcacatgcctgtaatcccagctactcaggaggctgaggcaggagactctcttgaacctgggaggcagaggttgcagtgagccgagattatgccactgcattccagtctgggtgacagagtgagactccatctgaaaaaaaaaaaaaaacaaaacaaaacagagaagaaattccttcattataaggaaaaaagaaatgcacataagcacagttacaatattatatttcctgactaaaaatatgtcttcttttaatggactacaaatattataatttttcttaaaatggcccgtgtgtaaaaagtttattcccctttactttacttttatatagtaatgaaatttcataattaaatctatattttgtattatcaatatttaaccactagaagaattgatgatgctacttattgaaaatgacaagtgatgtaatagagttagtgggatgtctgcctgttgaaaccattttactaggtaagtatttttattacaaaggggttggatataaactggcctcatatccaaaaacctttttgcaaaaatcaaaactggatatatcctgtgttcgcttccttttccctgggcccctctgttaaaatcttttagcaaaaagattttaccaaataattcacattgaaatataaatagttttaaagtttgctatgttgctttctttccaaaggtattcagattttagtaggggacaaaagtgtcccctaagtcaagtgagtataagaattacctatattgtttgctacaaatgcaaatatccacagcctccttgtaaagtctcattcaggggctgcctactgcagggcccaagaatctatatttttaacaaatactctggtcattcttgggactggcaaatctagaaaacaccaacttgaataaaacgattaaagttgtgcttgctgaatttcaactacattaaaggtaccagtgctggaggagatttttgaggggttgaggagaaataattacacataaattattttattaatgaaatgattcagcaaagtgtaaacgcccgtaatgggcttggcagtgtcctggggctgaaggtactgagtagaataggacgtgagacaagtgctctacttgaaataagcacagacgtggaagaagggatgtgtagttttgtctggggattcggcacagtttttatggaggatgtggtctgtgaaatggctgatttgaaacatgaaggaggctgcttatgggatgggttattctgggaagcaagcaagtgcgagggcaccagaaggtatgaagggccttggagtactgggctttcttatggctgcgagagaggatgagttggaatgagatgagcagcttatgaaaccaggaagacaggttattgtggaggagtgacttgctaagctctatcagatgagcaatgagcagtgaggaaacaggggagagatgaaatcatggctgcttttggaaagataagtggactagcatgcagcatggagaatggagaggtggagggttgttgttggtgtgtgtgtgtgtgtgcacgtatgacagagagagaaagaagagggaatatgaatggcatgggaaataagagaaaggcaggccaggtcagagggtttttaggatggcctgtgaggtgtaggagggtctggaggtcggccgtggagtggagaagagattgaggactcaggcactaatctaaggggaagggggacactgtattctaagggggccagtcctgctgctccctgtaagcactttatgtatttgacatgaaatatactgagatggcccccatactttagggtgcaaatgctcccctaaagtgagagtggaagaagaaaaaaggagaaggcacttatttgctcatgtgagccgtgtacagttccttcagagctcagagaggcactatgcagtgaatcaagccaggtcagctgctgggactaggggcctgggtaggtcacagccctgccggccatccacatgccttccaggaacaccccaatctctggaacctttcctgaggcctccattttcaggaattttgttaggaatccagataacagaatggccatagtggtgattatgttccttctacctccttttcatcagcctcgctcaccttacccttccagacatgagaaaacagtttcactacaatatccagtagatttacctaattggtaaaataagaaaggccaaggaagttgctcttctcttcactcccacccctcctgttcattttgtttgtaacaatagagccaagtttcaaacaaatgtagaaaaggtgagcaatgctaatgatgtgtttcagatgggattcagggacaactcaacttgaaattgtctcttagccatctgtttgtgtgcctggggtttcacctgctttgaattagggtaatttaataattgtgaattagactgggagagtacaaatggttttgttaattagattaaaacgttacattttataatacttactgtattaaccatgggctgatgacgctgcttgtaccctgtgttaaagccttatctattatctgctctttcttttgaaaatctcttttatttcagtttccatcgctgtgttgcagctgtccaacctctctggcattctagaatggatgctgcctgccttccatattccaacgcataaggttctttgcctgatgtcttgtgaacatacacaccgcaattccagataccattaagcctctgctatccaggtttatttatattaactatagtttgtttaaatatattttattaaactctttaaaaaaatacttctgtgaaaccagaaccaaacaaagaagtatttgaggtcctggatctttaaattttgtgatcttgggcctggctcatgcctgtaatcccaacactttcggaagccaaggcaggcggatcacctgaggtcaggagtttgagaccagcctggtcaacatggtgaaaccccgtctctactaaaaatacaaaaaattagctgggcatggtggcggatgcctgtaatcccagctactttggaggctgaggcaggagaatctcttgaacccaggaggcggaggttgcagtgagctgagattgtgccattgcactccagcctgggcgagaagagcaagactccgtctcaaaaaataataaaaaattaagaaaaataagtaaattctccttacatataaaacatatgaagcagtgctgccaaagagagagagagaaagagaaggaaagagagagagaagagagaaagagagcgagcgagcgagagacatcgaggataagagagaacaaagatgatgatttctgaaaaaaaggaatggatattcaataagcctgtacttactatcaccataagctctaagatatgacatgagtatgtttctattttaatacctctaaactcacaattaatggcatcttaatattttaaagggtagccattgttttaaaagcatataaaataatggtataaaaattagagctatcttaagttcagtaaatatagaactttgagtaagtcaatttgataattcccctttatggtaaattatctcatgatagtttcatgtttaactaaatcttcagaaaaaatttttattgagatgatcattggctaaaaaaaatggtggtatttgattggttttaaagagacacttattttgttttttgaggggaaagtgaatattgagaaaaaatagtgactgtgttcaatgttacgcttttaacatcagtaaactgcaactgacaaggctgtttcctattacctactgttaaatggccctgttttctaacttaaaaatggtgcttctaaggctaaaccttcaatttcttctggactttgtcaggttactttgggtgattttgaaagatttccatacataatactgctctggaagggtgcgtgcgaatatggttcacaaaagcagtgaagacatgtatctacaccgaggacagcatgtgagctacactgcaacaactgttttagatggccagcctgtgtttgacgatgatccctgagtgccagatgtgaaggaaaatataaatccctcaccatgtcctgaattccacaatgcctctccctcctcccctgggagtggagccaggctgacctctctctggctccatactggaaatgtgtgtggcaatggcagcattgccctttaccccatgcccaatactgcaatggcaccttaggctgtgtgtgtgtcagacagaaaaataaaacatcagatttttgttaattttgggtgatgagtgaggtcagggatagttattattttgagactgctatttttttttctcttttttaaaaacagatggggctgggcacaatggctcatacctgtaatcccagcactttgggaggctgagggaggtggattatttgaggccaggagttcaagaccaccctggccaacacggtgaaaccccgtctctactaaaaatacaaaaattagccaggcgccgtggtgcatgccagtaatcccagctactcaggaggctgaggcacaagaatcacctgaacccaggagacgaggctgcagtgagccaagatcacactattgcacatcagcctgggtgatagagtgagattctgtctaaaaaaaaaaaaaaagagagagagagagaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagaccaatatagggaaaagaaatcaaaactcactatctgctccatgcctttccgagcctagtaatccaagtgcaattatatcgcaaaactgacagggcttgagggagggtggacctaatgagtaaaatgtgaagcgaaagtgacaggatgactgagggtttgagcctcgggtgactggaatggtgagaaaaaacaattttcagtaaggaagatggaaattcaatagaattgtctgtcatactatttaagtaatttaaaaattttttgaaacgaattgggggtggcctctaaggtactgatcctttctgagagtcagtagtttctcctaatggcagtgcgggcaatgtgagagataaagcaggtgggtcccggtgccaggagaactgcttccccttcccagcacatctgctcagtttccgcctctctgtcaagctacacctgctctgtcctaacctgccatccactgcttcccacttccaaaaatttcttgcttacagattcccaaatatgcttgcttcacagcattctgagtgtctataattttttcaaggcaacccgacagcagaaaaaatacaggagagtttcagttagtgaatatttaggtcaaacaacttttttttttgagacagggtcttgctctgtccccacaggctggagtcagtggcacaatctcagctcactgcaacctccgcctcctgggttcaagcgattctcctgcctcggcctcttgagtagctgggattacaggcgcctgctgccatacccacctgatttttgtatttttagtagagatgaggtttcaccatgttggccaggctggtctcgaactcctgacctcaagtgatttgcctacctcggcctcccaattgttgggattagaggcgtgagccaccgcgcccggccaagatcaaacaacttaataaatgtttgttataatgacttagtgccatttgaaaaaaaaaaatacacatacattgaaagaaaaatatgtttttatattattcttaaatgaccacagttattctcaaatgggatgtgtacaccctgccgcacaacttctccaaccttagaatcatattggacacccacattctcactttctggtggtacttgttttttctttttctttcttttttttttttattatagcaaccacagaaaacccagttttacaaatatatgctgctgttgaaaggaagatagcatgatctaatgttgaaacagcactaccttgagtgagtacctctcacgatgtgtgagagatgtcattgtgtttcccttgaaaatttgaaatatcccagggcacctctgtgacttcaccatggcaccgggagggcctcaaaacacagtttgggaatcatggtacaggcctgttctataccatctgttttccttctcaattttatggcacttcttggcatcctcatttttttttttctttttttgagatggagtcttgctctatgatccaggctggagtgcaatggtgtaatcttgactcactgcaacctccatctcctgggttcaagtaattctcctgcctcagcctccctagtggctgggattacaggcgtccacccaccatgcccggcttatttttgtatttttagtagaaacggggtttcaccatgttggccaggctggtcttgaactcctgacctcacgtaatccaccccccttggcctcccaaagtgctgagattacacgcatgagccaccgcgcccagctgcatcctcatttttaagaaaataactggatccagccatgaccttccatttcctctttttcacctttaaactcctagagtgagtttacagtgactctccagttcacttctagtatcatatactgcagatatgtcacttggtaagtcactgctttggcttcaagcttagtccaaagaatggtttcccttttgtttgttttgagatggagtctctctgttgcccaggctgcagtgcggtggtgcgatcgtggctcactgcagcctccgcctcccaggttcaagcgattttcctgcctcagcctcccaagtagctgggattatagacacccaccaccacacctggctaatttttatatttttagtagagatgggatttcaccatgttggccaaactggggtgatccgcttgcttcagccttccaaagtgttgggattacaggcgtgagccaccgtgcccggcctctttttttgtttgttttgagacaggttcttactctgttgcccaggctagggtgcagtggtgcaatcaccgttcactgccccctcaaactcctgggctcaggcaatcctcccacatcagcctctggagtagctgggaccacaggcgtacaccaccatgcctggctaatttttaaattttcttttgtagagacgagtctcattatgttgcccaggctggtctcgtactcctggctcaagcagtcctcccgcctcacctctgaaagtgctgggattacaggtccgagccactgcgctccaccagaatgttttccaattctcattccaccatatttcttttgcgtttaaaatccttggctaggttcaaattattgcctggcttttgaccttcatactttaccacaagctcatgaatatgccaggccttaagggagaagggctttctatgtctttgtcttctgtgaacccatttaaactccaccacagccatgcggggatgggcgttattattacctttttcatgggtgaggaagcaggccgcccgtgacaccaaggcatcagaatggaacggaaacaccatctagaggtgctgcctgtccacagttatggccaggttcctgaggacaccctggacgctggtgactggtataaataagtgtcttgctgtgtttgatttttaatttttacaactatatttttataaaagtaaatcattatagctcattgtggacactttagcaatgaagaaaaagaaaaaccaactcaccacagaagcatacaagtgtttatgtaaaaatttttgattcagtttaatttgattttaatattgcttccaaacatttttattatgtaatcataatgtatataaaactttttatcttgttttataaaaattaaattataagcattttttatttaattacacaattattttagccatccttaagaaatctttatcactttcaaggtgattcttgcacataatttaaaaaccaaataactacaaagctttaacataaaacagcagattcctgccctaccttcctgaagcctctcccacgtagatttaccccccagatccaaccacttccttatcttcaactcagtggctctattatatccattgaatggcatcatgcagtttgtgtacctgctgcccatcctgtgtttacttaattgagttactgaatggttgattgagagcaatggttctgcaggattagtaaacgctgataaaggcctgttgactatgcatgtatagatgtgtaagttcagagctacattatcagatgtactttgccttgccattttataagcctaatttaactgtgcatttcttttatcataaatggctatgggcgtattaggagtgatgactttattattaaacattaatagatctcccagctcttatcagttattttctgaacctaaaattgaagaagtttgggaattaagccaagaagatctaatgaaattctattgtattttaaaccataattattaagacacagcaggtaacggcctgcccttgataattgtaaagactattgggtgttaagaagaagcacattatgtggatacatgcaacttcttgtagaaatattttcaggcagccctctttttaaaaatggaggatcccttttcagaaatactgattcccaagcatgtgggctggtgtctgtgctgccacaatatacttttaaaaaaattaatagactttattttttagagcagttttacatttgtctgttttttactgctccttgtggagcccggctaactcctaggcagtgcgcccagagctgcagttttagattcagataaattaggcagaaattacagataattgccatctagccatcactgacttcccaccctcaaccagcttattattaacatataattaactcctgtaatgaacatgttacattagtgtggtacatttgttatcactgataagccaatgttgatacattaattaaaatctacagttttcattaggattcactcttggtgtagtacatttcatggattttgacaagtgtataatgacatgtattcaccattacagtcatatagaatagtttcactgccttaaaaatcccccattcttcacatgtttattcctctattcccgaaacctctggcaaccactgatctttttagtgtctccatagttttaccttttccagagtgtcatacggttggaatcacacagtatgtagccttttcagattggcttctttcacttagtaatatgcatttaaggttcctctatgtcctttcatggttgatagcttatttcttttaagcactgaatagtgttctgttgtctggatataaaatggataaatattttatttatccattcacctaatgaaggtcatctcagtagcttccaagttttgtcaattaggaataaagctgctggccaggtgcggtggttcacgtctgtaatcccagcactttgggaggcagaggcaggcggatcacttgcagtcaggagttcgagaccagcctggccaacatggtgaaaccctgtctctattaaaaatacaaaaattagctgtgtgtggtggcgggtgcctgtaatgcccagctactcaggagactgaggcaggagaattttttgaacctgggaggcagaggttacagtgagccaagatcacaccactgtacccctgcctgggtgacagagcgagactctgtcccaagggggaaaaaaaaaagaaagaaagctgctataaacatctatgtgcaggtttttgtgtgtacatacgttttcaactcacttgggtaaaaatcaaggggcacagttgttgggtcatatggtaagggtattgtttagttttataagaaactgcaagactgtcttccagaatggttgggtcattttatgttccccagcaatgaattggagtatctgttgctctgcctctttgccagcatttggtgtagtcagtgttttagatttttcctgtttaataggtatatagtagtagagtatatctcattgttgcttggtttgttcgttttgtttgagacagaatctcgctctgttgcccaggctggaaagcagtggtgcaatctcagctcactgcaacctccgcctcctgagttcaagtgattctcatgcttcaccctctggagtagctgggactataggcaagcgccaccacgcccggctagtttttgtatttttagtagagatggggtttcaccatgttggccaggctggtctccaactcctgacctcaggtgatccgccgaccttggcctcccaaagtgctgggattacagtcatgagccaccacgcagggcccattgttgctttaatttgcaattcccaggtgacatatgatatggagcatcttttcatgtacttatttgccatctgtagctcttctttggtgaggtgtctattcagatctgttgcccattttaaaaatcaggttgtttgttttcttattattgattttaagagttctttgtctatttcagataccattcctttattagatatatattttgcaaagattttattttaatctgtggcttgtctttttattttcttaagaaagtgtctttcacagagcagaagttttagattttaatgaagttcaatttataattttttctttcatggatcattttttctttcatggatcattttttctttcatgatcatggatcattttgatgttgtatgtaaaatgtcatcaccaaacccaaggtcatctagcttttctcctatgttatctcctaggagttttatagttttttgtttttcctttaggtctgtgattcattttgggttgatttttgtaatagatgtaagatccgggtctagattatttatttacatacttatttatttacttacatgtggatatacagttgttccagtaccacttattgaaaaaaatatcctttcagtgttgaattgtctttgctctttttgaaagatcagttgactatatttgtgtggttctatttctgggctgtttattctattcatatgtactgagtctttttgttactttcagtgaagataaaatctatttgtagctaatcttggtttgtctttgactcttagtttcctcatgagaagcagggatccgtagaatagatccttcttactgtttcttccatctttactgcgtgagattagtgagactaagtgagactaagacttagtgagactaagaatacagtcgggatgatgcttttctcatagaaaatctctggatctgtttcaacagctaccagatctgtgtatgtgtctttgtgtctgtctgtgtgtgtacaggcatagtggcagatgtgatttctggttatgtcctttacattttataacaggatattaaacttaacattcatgaatgagtaagaaagcatattttgccccaatctgtaacagaaaatatcaataattgagttattaccagcaattaaaacatcagatttcctggcatgaagctttcataaggggatatttggcaatgtttgaagacatttttggttgtcacaactggtagctgggaggcctggagaggtgctactggcatccagtgggtagaggccaaggatgctgctaagtatcctacaatacacagaactgtcctctagaacaaataattttctggcttgaaatgtcagtagtgctgaggttgacaaaccctgttgtagagaagcagatttatttatatccatggatatgttttcctctttgccttgtcctctagatcaggcatccccaacccctgggccatggactggtactggtctgtggcctgttaggaactgggccacacagcaggaggtgaacagcagttgagcaagcattactgcctgaactctgtctcctgtcagatcagcgccatagtagattctcataggggcgtgaaccccatcgtgaactgcacatgtgagggatctaagttatgtgctccttgtgaaacagtttcatcctgaaaccaccaccccccacctgaccccgctctgtggaaaaattgccttccatgaaaccagtcacggatgctaaaaaggttggggaccactgctctagctaacctagactcctgatgatttgccatctatagctaataagcagcagaagcttatggtgtgatacaacattccacttcttttaggtgtcttgagctgagtttcacttttttgtaatttcataataatttctattatgttacatgcatttagataagctgacaactcttaaagtgggacataaatacactattatatgtatttctgaatatgggtggctggattgttgatcataaaaatctgaatctggaaacaaagttgatgtttaataactctccttggttggctggatatacataattcagactctgctttgaatgtccccttctggtcctttaaatggtctatttccctaccttacgtaagtttccatgagctcatcttgttttcatagtgttcccttttattgttaagagaaacaaaaccaaaaaaccccacttgtttcagcaatgccctgttgtcttcctctgtgtgaaattgctcaactaagagttatgcaaatggggatgcggcacgtggtggaggcttcttgcagcatgttgatgggggaccaagacctggtcttgcctcttcctcctccccctgctggcttcattccggtcataccagctcctgctgtggccatcagctcatcccaggaccttggcagggcctgtttcttttacctcacactgaagccccaaactcttaggctccagtaatcctcccagcttggacctccagtgcactgggattagagatgtgagcccccatgcatggctactctctaagttcttactcccacggacaattagagtttgaaggaccttacgccatgggttcagattatcttattttgcttcaaaattttaaaaacttttttatttttctgtcatatacatatacgtgtgtgtatatatatataagttatatatatataacttgtatatgttactttttatatataataaaatatattatatttttaaataaaatatattatattttaaaatataatatgtaactcgtacatagcacatattatatgtaatgtatcctatacataaccttatgttgtacataaatatgtatattgtttacctattgtactatatgtacatgtataacttgtctatgtattatgtattataataaaatacattgatacttgtatacataatttgtacacaatggaaaacatttttaaaattttagactaaggggaactgagcacaaaacctaagggcctcgaaactctgattttatacatatataaaattatacatatatgtatataaaatataccttttaaataaggtatatatgatgggaaaattaaaaatttgcaagggcaaaaccaaaaatagctgtagatgaacattgcggtagtttagcctatttcttttcagacttttttctattcatttgtaccttttccctcacaaaatgatatcatgctatatatactgtttttacattttttcacttaaatatattgtgaatatctttttatgtcaataaatatatatgtattaaaatttaatagtcacttagtattcttttgtgttgaagtatcatgttctagatcaattttccaaaagccagttaccagaagggcaatttgatgttttctcaaatgttacaccgtaccagaagacttgtttcttttaactacttgaatattatttttatttaaaaaactttatgcatttttaatgtgcttttgctagttcttcaaatgacatatcaacattgtttctgcaattagaaaaaataaaatttaaatttataagcctcaaaaagaaattgtaagtgaccaaatcatttccaacacatatgacatgcttaaactttagtttctgagaaggtgaaattaggatgtgttaacctggcagctgtttgcaaaaccatttgagttgaaaggatagaaccatcctgaaataaggaaaggaagtgttcctgtgcatagggataccagaaagaagcagaagacttgaatctcaaatgtaataaaagatgacattaaggttgaagaattttttaaaaattaaaattctaaaaatgtaaggagaggtaaagcaagaagtgaattaggaaactacagaaacaaccatatctcacattaaacttaagctactaattactagtgacagattaatatagttctaagaagactcaataatccttagctttctaaaaaatagaacatttgtcaaaatcttttaaaacaattatatatatattttttgtttgtttgtttttgtttttttttagatggagcctcactcttttgcccatcctggagtacagtggtgctatcttggctcacagcaacctccacctctcaagttcaagcaattctcctgcctcagctcctgagtagctgggatcacaagcatgcaccaccacgcctggctaatttttgtatttttagtagagacagggtttcgccatgttggccaggctggtctcgaactcctaacctcaggtgatcctcctgcccgggcctcccaaagtgctgggattacaggcatgagccaccacaccaggcctaaaacaattatatttgataagaattattatactcgcatttatataccagggaatactacacagccataaaaaatgaaatcatgtcctgggcagcaacatggatgcagctggaagccattatcctaagtgaattaatgcaggaacagaaaaccaaattgcaggctctcacttatgaatgggagctaggcattgaatacatatggatgtaaagataggagcaatagacacgggagactactaaagtgggggagggagaaggggagacattcaccaaaaaactatttggtactatgctcactacctggatggtgggatcatctgtaccccaaacctcagcatcttgcaacatacccatgtaacaaacctgcacatgtattcctgaacctaaaataaaagttgaaattatttttaaaaaagaattactatactcttaagctatgaaagcaccacaactaataccaactgttataaacttaagctgttaaaactatcccatctaatatgacattacgtaaatctgaaataattaaaagataccaattttggtgaactgatcatcttgtaagttgaaaaccctcacagaactggctttggtgatgtgaattttgagagctgatctgcatttatttaaccagtgacctataatttgacaaacaagcctatttctatatggtattccaaacagtcccacaataagtattctcttgtatagaactttgtgtagcccccagttattttcttataagtaatttattccaagaagtggtcatgttgggttaagaagtgtgtacattctaacggagtttaatatgtactgtcaagttaaagattgtatcacttatcctctcatgccaagcccagtgatttcattttatggtgaggcaattacagtccagagaaaagagtggttttgtcgataattacaggactgtcaaggctggactccacagacaggcttcctgagttcaacactgtctcattatcctctttgcactcccttccaggcagagccacatttccctttcagtttctctgttctagatgccaatcttccatatacctctttaattgtcttgcaattcttttctggaaacattctagtaaatgcagtgattaaaactgtgcccagtgctgctgccccttcacattgtggataactagatgaccctgggtctacctacggctgtgcttatgtcttgtggcaaataataaagaaggagctttggccaggcgcagtggctcacacctgtaatcccagcactttgggaggccaaggcgggcggatcacaaggtcaggagttcgagaccagcctggccaatatggtgaaaccccatctttactaaaagtacaaaaattagccaggcatggtggcgagcgcctgtagtcccagctactcaggaggctgaggcaggagaatcgcttgaacccaggaggcagaggttgcagtgagccgagattgtgccattgcactccagcctgggcgacagagcgagatccgtctcaaaaaaaaagaaggagcttcaaatcaggtaaacacagcaaacagaagataaaaagaagttggcaaacagcttaagtttgccaacagggtttgaatcttttcaaatgtagtctgtcttccatcattactgtttcttcttcttacccgctactcctttgcaatcttgtgtttaggtaggtacagggttgctgctgtgctgtttggtagaaagaagccataggttctctccatattctgtgtatgccgttcaccggcccgctaagatttgactgggcactgctgattcgagggatgttaaatggacacccaccgtgcaagtgcatgcaactgggaaacttgtggatctcctggaaaccttgacaggcagaatgaggggagccctgggacagcatctggctgttttgtcttgacacccctttcctcagtgctcaaccctgcatgagacatgaagagaagagaagagccaactccttattcagacccagagacatccctcctgtgttgaggggggtgcaccctgtaactagctagctagtcttaaacccacttcccacctcacccccctttcccaattgaccctcaatagtcaaagtgaatggaggctggcaggcaccttggacacaggttctatcccagtctttactctttccaacactccttcagacacctctttctcacttctcctaaatcatatcctcctcccttctagggggagcctgatggctcaccttagtcacagacaggagctgacacctaaccatcgaagcagctctgtggtggaggtgatgcccacaccatggacggaagcagctccacgggccatggtcatagcctagaggtgacgcccacaccatggaggcagctctgtgatctgagggattcccggcaccgaaacagcattgccttaattgcccccaaacactgttcctattacacatgacatttaaaccttagggagttacattcataatgttaggttgcctaaagaaaaaaaacaaaaacaaaagcaaactgaaaaagccttaagtagggccttatgttgcaggctggtcagatagagaaagccgtgctatgcagcttggccagcccgggttaccagctcaccaactgtgcccaccctggctgctgggagattttattgaggaaaaatattggagaatgtttgaaaataatgaccatggtatgtaaggcaaaaaatcttagttgtttaaataaagacggtctggctaggtccttttcagttctctctcttttaaaagtgatttaggtgctgggtgcagtggctcacgcctgtaatcccagcactttgggaggccgaggcgggtgtatcacctgagatcaggagttggagaccagcctggccaacatggtgaaaccctgtctgtactaaaaatacaaaaattagccatgcttggtggcggacgcctgtagtccccactacttgctactcaggaggctgaggcaggagaatcgcttgaacccaggaggcagaggttgcagtgagccgagatcgcaccactgcactccagcctgggcaacagagggagactccatccaaaaaaaaaaaaaaaaaaacaggaatttgggaaaattgatgcaagactgaactgcttgagttgggaattaatggagttggtggtggagcttagtgctagtgccctcaccaagtctctccagcactgttgaggctgccaaccaggctattgtgtccccatgtcactttgataagcagtttggagaaagcattcaactcttctgaagactttgtttctctaatctgagtctcctttccgaaagtaaagtaagaaggacaattaaagggtatctaaaggtttctgtgttggtgggcaaagtaaatctcttgagttatagaactgatactggaatgcaagtgtgtagggaacatacttttagggacgaattcctataaatgatgcttgaaccagtcttggacctaatttgaaactcaagatcacttttgtttcagatagacaccacccacctctatttccccaggcttcctttctcttcctcatgtctttctaagctctctaattcagaaaactcatggatctggagcttcctccacagaaaggcagcaagaccttgcatcagtaaagaagtgcagcttttaggctgggcgtggtggctcattcctataatcccagcactttgggaggctcacgtgggaggatcacctgaggtcaggagttcgagaccagcctggccaatatggtgaaaccctgtctctactaaaaacacaaaagttagccaggtgtggtggtgggcacctgtaatcccagctacctgggaggctgaggcagaagaattgcttgggcccgggaggcagagtttgcagtgagcagagatcgcgccattgcactccagcctgggtgacagagtgagactccatctcaaaaaacaaacaaacaaaaaagaagtgcagcttttagatagaaggaatagattctaggttctacagcactgtagggtgactataattaaagacaatgtattgtatattccaaatagccggaagagcaaattttgaatgttcccaacacaaagaaataatacattaaaaataataaaagcaacaaaaaaagaaaaagtacagctttgaagccagaccaagttccggttgtacctgagacctttgattacctagcacaggttcatctctgggttttactttcctcatacacaaagtaccagggacaaagtaggcacatacgtgtttatcccttttctaccccccacgtcttttgtctctgaccctcatagacatttatagctactctgtttgctttaggtgggtgaccagttgatattgcaaagtcaggcaatagacccagcagttgacttcagcaatccaactccatagtccttacttcagaatatgttgtgaattgtatagtgtcttctttaggaatttcaatacaaaatttctatacaggatcttttacctcacaagtggactttagaacctaaccaacaaggtggtggatgtcctcttagatttttttcctgtggacattaaatatatatacatatatatggattgtgtacatatattaggttggtgcaaaagtaattggcaaaaaccgcaattacttttgcaacagcctaatttaaatatgtatatataattttttcaatcagcaattcttgattgtttgattaagaatgtccaaatatacaaatctctctttttaacccactcataatgtgtcactttgttctaacttaaagaactaacccctaatgaggacatctagattgtctctactataagtcatgctagcgggaacatccttatgcccctgtgcagtgtatttaaagaacaaatttcaagaagtggaattccaatgcaagattgcatctttgttgaacagctggataatggtaaggcattgctagattttatgaaaccaaaaccctactgcctctggtaagagtgagttttgttttgttttgttttgtttttttgatggagtcttgctctgtcacccaggctggagtgcagtggcacaacaatcttggcttactgcaacctctgcctcccaggctcaagggattctcctgcctcaggctcctgagaagctgggactacagacgggtgccaccacacccggctaatttttgtgttttttagtagagacagagtttcatcatgttggccaggccagtctcgaacccctgacctcagatgatccacccgcctcggcctcccaaagttctgggattacacttgtgagccaccacacctggccaaggtaagagtgatttttaaaaaccaaaaaattatcccagagtctgggaataaaataaaagagggattaaaatcactcttctaatattctaaggctcttgaatgaggatgagccacccctaatggatattcattccaatgaaagaaagactttatagaaagagaaatctccagcctcacattttctggatgggtcagtgggtgttgctttgtaatcaaaaggctgcctggccgtttgtgtctctttagaccatattgtaaaacttttgcaatgaacagactagagttgtatttgcatgtcaaagcctcagttactatcttgttttaaccaaattctctacgcataaaatatgtctttatttactgttcaaaaaatggttttgaaggcactgctgactacatcatccacagcacttgatataaagtgcattataagcaaacttggaattcctgttggggacacacattcccatcaggaacctggtctgcttcctctctcctgctgtgactcatgacgtccctggcccttcttgccagaaaacctagggcaaatgtgcaggtcagttacagcagacctgttccctacaatgttaccacattcgcatttttctcattgccttggctctggttttctggttttattttattaacttcattattgactcttttgtggtaaaacattttaaagctttttttctctgagaaagaggtagcctataaaaataatctctttgtttggcattgttaataaatagatgaaacatgcatttcaaaatacccattgtatggcaaagtggtaagagcccaggctgtagacttagcttatgacttagacttgagagcgcactcctgtgtgagtgagtcttagcctcacccctcccagctatgctgtgcgcgagtcttttaacctttctgagcctcagttttctcctctgtaaagtcatctggccgtatggtttcttcaaggattaaatgagatgctcaatatattataaatgtgtaatagaagaatactaaggtggaaatcattgtaaagtgtagctcatatcacttggaacatgtaaccactctcagtttttgtcaggagtatattgtattttctacatttctggtactttcatacagcataaggaattgcaagacctgttctgagtttgggttgctcatccccatgtcacatggaggacctctgttgaggtttctggtgggagagtgtctgaatgggggaccccaaacactttgtgagcagagatcagctgtgcctgagcagtgaggccatgctaattctccacgtggctttaattttttcatttacagtgcatacattcgatgttaaattatccatgacaatggtggaaagaaattaagcataaataaatggccatctatcgatcttcctgtcttggatgtcaccaccccacccacatccacctgctttttgtttccgtccttccttttcccaagagaagagagagagagagagagagagagaacgctggagcgagcagcgagggcaggggaactgcaggaacgcagtgggggggggacaggggattccctgtgccctggttgtggcacagctcagtcagggctcggtccgtgctgggagggagctggatcgagcggcccggtgcgctgtgggttggccgcacccatgcagggctcctgccccggagctcgcggcgtgcgcagggtcctcgtgctgctattaacgtatttgcccatttgtaaagcacgattttaagggatggtgagttaaacaccgctttttcggggagggtgacggggcgtgggagggatgagactggtgaaaaaagaactcccatgcttacttagagatcaactctaaacccatggccatttcagaaactttagcgtattaaaaaatgtgctgttttgaatcaaagaagtacttgcttcccctttattttgggaactgcagctcgctagtttcagaaagaggtgtggctgctctttagaggcttcatacctcaagtaatgaaatgataaacaagttgaagttcctagaccaattggaagcctgcaggaaaaaacgcaggcctggacgcgtggcagcgatgccggagagggccgagttcccagaagagctcttgaggtttcttagtacaattcctcccccacgagatattgcctagtcacaccacctctcccccttccccaaactcctgtcatctctccttcctctagacttaactctaagccctaggcaccagatttggcagtgcttcagaattacacatcacatggggagcagcatgctcccactgtgccccagaagagtttcccggacagtgtccagagaatctgttcggtgagaaccaacttctaatgaagtttgtgagattttatttttttattatttattattattatttttttgagacggagtcttgctgtcgcccaggctggagtgcagtggcgcgatctcggctcactgcaccctccccgggccgggttcaagcgattctcctgcctcagcctcccgagtagctgggactacaggcgtgtgccaccacgcccagctaatttttgtatatttagtagagatggggtttcaccatgttggccaggatggtctccatctcttgacctcgtgatccgccttccttggcttcacaaagtgctgggattacaggcctgagccaccgcgcccggctgttttgtttttaatgcatagatttgacccaatactgtaagacaagaactgtgtctgattcaaatgttcaaaatcacctttgcagtccccagagtgcgtgtgtagtgctcagccgtcctgcgttaatggaatcactggatgacagagttcatgtttagatgtgcaccgtgtgttgttctgccctggtcaggcaccagcccccttcttgccatggtggctttcctccactgtcctagcatggcttgcggagaccgtcattttgcttttacctgcgctagtactcctggtttcctgactcaagtagcttactcagtagccctactggatttgatcatctgaatgttttcataagtatcttctctcccataagtgtgtttcctcaattcatttccagtcttgatgaaagccaggccatcttcctaggcccctacctatgtttagctggagccaggttctgcagattctagctcttcatcacctgcccttgaagtctcaaggccccccaccccactccaccttgcacactgcagattggatgtgtcatttgtcttcagggtaaaaaatcaaccactcagcttcacatccagcatgtgcctccctctctggccctgactcctgaccttccctacctgctccttgactgcagtgtttagtgttgtagatagagctcattttctgaagagattaggttgatctagctctctgaaggggccatgttatcttgagctcatggtggttgcatatgaagtttcttcttcctggaatctctttgctgactttgcaaactggctgccatcccgcccatttcaactcacagagcatttcctttaggaagctttccctgaccacctccttttcctcttgcctgagttacatgtcctttcttagatcctgtgggtcctctgtcatcgagtctttacacatctttgccacaagaatacgagcagagttagagctggattttgtctgggtgatggaaaattaatgctcaataaatatttgttgagtgaatcaatggacaggcaaacctatttgggaacagtattcactttgagtttattaatctatatatgataaagaataaaagtatattttttctactcttttttattggagacattttgatggcttgaagcagttctggaatggtaaaacaatgtcattacttttatgtttcaacaggaaatatgggatgtataaaatcaaaagggaaagacagcttgagtgacgatggagtagatttgaagactcaaccagtacgtaatactgaaagaactatttatgtgagagatccaacgtccaataaacagcaaaggccagtaagtagatagtctcaggggagaattcccacagcaagatcaaagcatggctacataatttaaacaccagtctgtaatatgtgcatgcaaaaaaattccattgattacttggtcctcaaataatttttgatatgctttgtaactttatcctttgaagaatgtataaatattttagggataactaggccactcattgtgcaattaaaagggcctttggtcacattcttttgtgtgaagaaagccatctttcatattactggtgcaaagaccccactatatatatatacacacacatatatatgtgtgtgtgtatatatgtgtatatatgtatatatatgtgtatatatatatgtgtatatatatgtgtatatatatgtgtatatatatgtgtatatatatatgtgtatatatgtgtatatatatgtgtgtatatatatatatgtgtgtgtgtgtatatatatatatatacacacatacatacataggcttgtgtgactcaagatagtagtgagaggctgggcgcggtggctcacgcttgtaatcccagcactttgggaggctgaggtgggcagatcactaggtcaggagctcgagaccagcctggccaacatagtgaaaccccatctctactaaaaatacaaaaattagctgggcacagtggcgggcgcctgtaatcccagctactcaggaggctgaggcaggagaatcgcttgaacctgggaagcagaggttgcagtgagccaagattgcaccactgccctccagcctgggtgacagaacaagactctgtctcaaaaaaaaaaaaaaaaaaagatgtagtgagattagctcagtggtttagaagcaaaaggaaatgtgggatgcaagtcagaaactaaaataggtgctaatgtgtcttttgttgtatcatactttatcctgtcctgtcatttcttcaattaattcaaaatagtacagatcctgaagttgtcatctgttattttagtgaattaaaatattaaggaaaaacacctctaattctgtcccctaaccttagagaaatagctggactagaaatattttatgagtgatgtgctatttggtgtatttcggaaatacttggcaaagaaagaactaacatcacattttatggaaaggaagaacagagctttgaacaattataacctgaaatctacttcatttccgagcttatatcctttgcatatatgtattctctcactgtatacatgtataccacccatagcctgctttctatggaattctgcagcatttaagctggaaacagtttattccagattagcccaaatcccattattaagaattttcaggctgggcatggtggttcatgcctgtactttgggaggtcacaaggtcaggagtttgagaccagcctggccaacatggtgaaacctcagctctactaaaagtacaaaaattagccgggtgtggtggtgcgtgcctgtagtcccagctacttgggaggctgaggaagaagaattgcttgaacccagagggtggaggttgcagtgagccgagattgcgctactgcactccagcctgggtgacagagcgagactctgtctcaaaaaaaaaaaaaaaaaaaggcatttttatagtttctctagtctgacatgtttttaaatgctcaggtgttttagaaatatattcccattatcaaacctttctgcctgccctcccctcaatatgtccccattaccctgaaggtaggaaatatctgccatgtatcaaagtcacatgtcatcattgagacaaagaaatcaacatcggtcttcttaagaagtggagataggccaggcacggtggctcatgcctgtaatcccagcactttgggaggccgaggcaggtgcatcacctgaggtcaggagttcaagaccagcctggccaacatggtgaaaccccatctctactaaaaatacaaaaattagctgggcatggtggcacatgcctgtaatcccagctacttgggaggctgaggcaggagaattgtttgaaccaggacccgggagggagaggttgcagtgagccgagatcacgccactgcactccagcctgggttacagagcgagagtctccaaaaaaaaaggaagtggagataaagagtggatatatcatgctattaagttatcatacatgatgtttcttgataaattaacattgtaattttatatatagaaaatatatgtacttaaaatgtataggaatattaatagatttaattgtgtgattataaatataaaatttaaaaacctattacaggcagtgaaagaaacattacataagtatgtacagatatagaaccatatcatatataaatatgattaatagaaaataaaataagagaaattagagtcacaaatagttttcttatagacatcagagttctcaaaaaaagatctgatttttctcataccatatgctatagattttgtaggttttaaaacacaagttttttcgttttgcacttatttattcatttatttattttgaggtggagatttgctcttgttgcccaggctggagtgcaatggcaccatctcagctcactgcaacctcctcctcctgagttcaagcgattctcctgcctcagcctcccgagtacctgggattacaggcatgcaccaccatgcctggctaatttttgtatttttagtagagatggggttttgccatgttggccaggcttgtcttgaactccttacctcaggtgattcacccacctcggcctctcaaagtgttgggaatacaggcgtgagccaccacacccagcctgttttttgtttttaaatgatgaataaagatgtcctttattcagaaaagtcaaggagaatagtgtgcaaacccacacaccgctttttcctcttgttcaaaataaaggggattaaaaatcaagttagaaagcagaagtagtaaacacgcttgaagtctttcaattccctcctgtataccattttttgccccttctgtggtcacagatgccctccactcatgagccagttagcctggccttattccatggccataaccaacactctcagccctggccagatatgacaaaatgcacgctatggattgattaaaaggggaatttgatgagaaggtgaggtagggttgatgcaaattcaacaacattctagaaaaagccattttaaggaaaaatctagagcaatagtatatgtgtggcatacatgtgtttcggtcttataaaaagcatattaaaatgtttgtaagttaagggctttttgaaatttgaaaaatcagcttgctgcttttaaaatgatgtaattagtttctagtcttctagttatttcctctaaatcacataaaatagatcatatatccaaattatgcaaatctgaatgactaaaaaatcaacataaaacttcctgacataaacatttgaaggatagtatgcagccatgggtttttctggtactacaatgtagtaattttccctgtctcactgaaatggagattttatgggctttcatcagaaatttaaatttcagtacaaactgttttggtcccattctgtgaagccactttaatcaaagagagacagaaaagttacatgacttgtggtataggcctctgacagcatctatcttacaagaggcccagaggcctcacacagcctcatgtggcactgtgaagaaaagaatttgattttaaaggtaattgaggtggtcttctgtgccaccaaatccttcccaataactcacccccccactgaaataacaggggatgccatctgtccctgtgatggagtcagggtcagcccaagaaaacctggatgggatgggacttgctctcagcctccagggacagagccctgaccatgcaattttatacaattggggaagcctcagatgggcagtcccaggctgggacggcaactccacgaaatcaccagggtcccacctcttccgtctccatcctgctgccgctggtgtttgctttctatgtgaagactccagccttcacttgtttctagggagagagaaagaggcaagggaaaaggggagctgacagcaaagccctgcacaaccgatctgcggaccaaaactccctctgccctctgcccggggctagagagtttggaagcacactcattgagctgggcaaactgccaccccaaataatattagggctctgtcaccaaagaagaggaggagctaggatgaggtgagcacctggcacctgcccagaacctcgctcccttcctgccacccacagcaagtgataaagagccctgtcactggccaagcagggcaggatgcacctctacaggtttttccctctgtgctcctgttctttctgacttaataaatgagcccatcctaacatctgctactgttacaaaaatcatatatacaacacgaatgtgagtaagaaaagctaaacagaatttttttttctaacaaatattctctcgtaggttccagaatctcagcttttacctggacagaggtttcaaactaaaggtatgttttcatagcaacatagttaaaattttttttctttactattagagcttctataaagtgattgtcctaaatgtttttatttttttttattgtgggacatatataacataaaaatttaccctcttaactatttttaagtatacatttcagcagcattaggtacattcacattgttgtacaaccaataccgccctccatctccagaatgcatcttctcaaactccatacccattaaacaataagtccccattgcctcctcccccagccgctggcaacctccgctctttctgtctttatgaatttcactactctaggtacctcctagaagtggaatcatacagtaattgtccttttgtgtttggattatttcacttagcctgatgtcctcaaggttcatccatgctgtagaaagtgttagaatttatttccttctaatagtgaataatatttccttgtaagtatatgccctggccgggtgcagtggctcacacctgtaatcccagcactttgggaggccaagttaggtagatcacctgtggtcaggagttcgagaccagcctggtcaacatggtgaaaccccgtctctactaaaaacacaaaaaattagccaggcgtggtggtgggcgcctgtaatcccagctactggggaggctgaggcaggagaatagcttgaacccaggaggtggaggttgcagtgagccgagattgcactattgcactccagtctgggcgacaagagcgagactccgtctcaaaagagaaaaaccaaaatgctacatgatgtttatccattcctccatcaatagatgtttgcattatttccacatcttggctattttgaataatcctgctgtgaacatgggtgtataatttcttaaatatagagttgtatttatagttttagttttaagtgatttgcaagaacaaatactggacacagtgtatacagcaaggtactctctgtgggccgtgcagaccctgagcccactaggcaggaagcacatgtccttcttccagttgccccctcttagtgcttcctctcatcctttgtgccccatgaggtttgttaaaacgcttctgctgatggattcttacaggtgttctcttgtgttcatctttagatccagaggaacaaggagacattgtggtagccttgtacccctatgatggcatccacccggacgacttgtctttcaagaaaggagagaagatgaaagtcctggaggagtaagtgctctcaagcacgccacggctgctcgtttcctcaggccactgagtcctgcaggctgtccccttgtcttgcttctggtgctacagccatagcccggcccctttcttgtaatgggtatgaggcctccttgctacccacagggagtgggcagtggaaggaatagagccaaagggattttccttttaagtcggtctgtgagcacacttcagggggtttccctttgaagacagacagtggtttttctttaaaacaatttttttttttgagatgggatctctctctgtcatccaggctagaatgcagtggcatgatcatagctcactgcagccttgaactcctaggctaaagcaatcctctcacctcagcctcctgagaagctaggactacaggcatgtgccaccaggcctggctaatttttaaaatttttgtagagatgggatcttgttatgttgcccaggctggtcttgaactcctgctgtcaagcaattctcctgccttggcctcccaaagtgctgggattacaggtgtgagccaccacacccagcctggtttctttctttatccactcttgccaccttaagaaatttgggtctgtgtggcccatgcatgatacttgaaatgtcacttttcttttgttatattactcatgtttagactgggttcatgggcccagcctagcttgagttctaagggtactgagctacagcagctgtgttgggaaattctcaactcagcagctgccatgcttttgtgaggacgcctgagtgtcgtcatctcctcaaccccctcttgctgactcagacatgtggcagtgtcagaccataggcatgcaggacagtgctcagaataagaaactccagttgctttaattctagcttgcttttcttactaatcttgcattaaatgtcactgtgacctgccaaatagggtttgagggggagactcccttattaaggacaaggtgttccgtggttgagagcaatgttgcatatgggttgaacagggacttaagcctgatcctggccctgccacttgatagctgtatgaccttgacaagacccttaaactttataccttggtttctttacttataaaatgggaatgacagtacctagatcatggggttgatgtgagcatgatgcatgtgtttaaacatgacataagcaaagaggatgcagagcttagtattagttctagttgccttcatgccttacagacaaggatcctgtctgtgtgtggaatttatagaggaatgcagttaaggctcaaagggacccattccttcccccattaccagcttacctgcttgcttcttccagtgctcatccctgcctcctccctggctccatgcctgcctttctgctgaggactcgagcatggtgctgaagctcacttgcttggaattgtcttatggttttcttcttttcatagtgtccatctctatgataactagatgtttgaacaaaggagtttataatgcatgaactgtggaccagtattcccttgactctcatttctataaggatttgaaagcatttcttagctatcctggggcaagttacaaaccttttgtttctgtgagatgggagccatttgtaccaactcttctttgtgcacccctgatcgcagtgatgcgtgctttagttgtaaggctgttttcctttgcttctgtctctaaacatattttaattccatcacggagagtgaattttcccactggattctggggttccagagatgttctccacccgccttcaccatcctaaacaaacatcttgagacaattgctattgtagctgttgagtcttggatataaacacttttttccttttatttttagttgacatggaataattatatgcagtcatgggatacagagcgatattttgatacatgtatgcagtgtgtacggatcaagtcagcgtaattagcatatccatcatctggaacatttattctttctttgtgttgtgaacattcaaaaccctcactcctggcttcttttctttgtctctctctctctctttttaatagctttattgagaattcacaataccatacaatccatctacttaaagtgtacaattcagtgatttttttagtatagtcacagaattgtgcaatcatcaccacaatccattttagaacattttaaataccccaaaaggaaaccctgcaccccttagctgtcacctcaactctcccattctctgcagccctaggaaaccacgaatctactttttatctctgaagactgacctattctggatatttcacataaatggaatcatacaatatgtggtcctttttgactgccttcttttatttagcataatgttttcaaagttcatccctgttgtagcatctctcagcactccattcctttcactgctgagtaatactccactggatggatattccagattttgtccattcatcagttgataggcattttggttgtttctactttttgcttttacaaataaggatgctttgaacattcatgtacaagtttttgtgtggacattatggtttcatctttcttgggtatatgtcaaggagtatagttgctgggtcctgtggtaagtctatgttttctttatttttaattttttaattgatatgtaatatctgtacataaatacatatttatgggatatctgtgatattttgatacatgcatggagtatgtaatcttttagcttctttttgatgtgtatttctattctaggcatggagaatggtggaaagcaaagtcccttttaacaaaaaaagaaggcttcatccccagcaactatgtggccaaactcaacaccttagaaacagaagagtgagtcctcatgtgttgtcatcttggtggctttatttgccacattggatttcttgttaatattcttcacctttttcttgccgtggaacataatatgcaggaaatgttgaaatgtcttcacaggtggtttttcaaggatataaccaggaaggacgcagaaaggcagcttttggcaccaggaaatagcgctggagctttccttattagagaaagtgaaacattaaaaggtaggaaattgttcaaagcctcttttaaaacactatttaggaaattatttttagaaactattctagagctactcaaggggaaaaaagggcatatagtatgctctggtagtaaaagttttatggtttgataacaaataacaaacctcagtgattagttgtgctactaaaagtaatatagttgagtgtggtggctcacacctgtaatcctaacactttgggaggccgaggcgagaggatcacttgagtccagcagttagagaccagcctgggcaacacagcaagaccccatctctacaagaaatacaaaacttagccaggcctggcagcacatgcctatagtcccagctactctggaggctgaggtaggaagatcacctgaacccagggaagggaggctgcagtgagccgtgatcacgccactgcactctaactagcctgagtgacagagtgaggcactgtctcaaaaaaaaaagagaaaagaaaagaaaagtactgtagaaagcacacatgattgtggccagttcttaccaggctttgtttgctgagccttttgcattattatttgaataaatcctgaagttttaagacaaagaaaattaggctgggcgtggtggctcaggcctgtaatcccaatgctttgggaggccgagactgagaatcacttgaacccagcagtttgataccagcctgggcaacatagcaagagcctgtttctataagaaattaaaaaattagccagctgtggtggtgcatgatcgtagtctcagctacttgagaggttggggtagaaagatcgtttgagcccaagaggtggaggctgcagttagctatgattgtgccactctactctagcctgggtgacagagcaacaacctatttcaaaaaaaaaaaaaagaaaatcaaagtaacttaaaaaaatttaaatgtagctaaataataattttaaaaaaattatcatgaagaaagaaaatggtatgttggcaagctacacagcaaacaaaatgccagcttcatttgtcaagtagaatttttataggacttttaaaattatgcattttatacaaatttcataaatatatgtattttgcatatttgtatcacaaaatgtgtactgcagttgttgtataatgcagatcttatttgtgagatataaacatttacttacacttttccccccataggaagcttctctctgtctgtcagagactttgaccctgtgcatggtgatgttattaagcactacaaaattagaagtctggataatgggggctattacatctctccacgaatcacttttccctgtatcagcgacatgattaaacattaccaaagtaagtaaaaactgaaggttcaacaagacaagatatatttgttatgatatgtataagacgtcaaacgctatttttatattaaaactttttatgcatcgtatttctcttagatacagttgcaggtcatattctataagtggttctaaattaatctatagttaggccaggcacagtggctcacgcctgtaatcccagcactttgggaggccaaggcaggtggatcacttgaggtcaggagttcgagaccagcctggccaacctggtgataccccatctctactagaaaaaaaaaaaattagccaggcatagtggtgcgtgcctgtagtcccagctactcgggaggctgaggcaggagaatcacttgaacacaggaggcggagattgcagtgagctgagatcgcgccactgcactccagcctgggtgacagagcaagactctgtctcaaaaaacaaatactaaaataaaagcaattaattaatctacagttaaatacacaaagtaagatttgatccttgtgaataattctcccagtccttcccacctagtacatgctgtttgacattcagtgttccacaattaccaagagaaaaatatatattgtctttgcatatatttttacaatgcatctgaatatctggaataggaatgcagatttgcagatctgtgtttgtgtgtgtgtgtgtaaaagtaatgtatattcttggtaaagtcaaacggatataacactaccactgaaatatttagaagtggcaggtcaatgtccctgtctccagtgccactttgcagtcctgagaagcctgggcctgagactctgggtccctttcctgtgtaattggagtcagttgagtggttgttgccccggctcctttctatgacctgctcgaaggggatgcacattataggtttgcttgagtcccaaaacacggagagagcaacgtgcttccgattttgtagattcttgccttcctccgccctcccattcctgtgtgcatccggcacatgctgagggcttgtggtactctggctgtgttctggggcctggggtccagtggtgacatgaccgagtccccactatggtgccctgtgaagcttaatgtgggattagtaatctgaaaccacattttattaagtgtgacaatctggcagcctgtggttgtctgttggctttgttgtttttgttcatgtatgttagcagtgctgaagaatacaatcaagtatgttttaaatggtttttcttatataaatttcaggccgggcttggtggctcacacctgtaatccagcattttgggaggccgaggcgggtggatcacttgaggtcaggagtttgtgaccagcctggccaacgtagtaaaattctgtctctactaaaaaatataaaaactagctgggcatagtggtgggcacctgtaatcccagttactttggaggctgaggcagaagaatttcttgaacccaggaggcggaggttgcagtgagccaagatcgcccattgcactccagcctgggcaataggagtgaaacttcatctcaaaaaaaagaaaaacaaaaaaaacccacaaatttcaaaagtcacaattatgtcaaggatgcattttagttcacagactgcggcaggttggacactataaggctagtgttcaacttttctttatagacacaggtaaagtacaaagtattgcatttcttaaccttcatttttccctttcaaattagagcaggcagatggcttgtgcagaagattggagaaggcttgtattagtcccaagccacagaagccatgggataaagatgcctgggagatcccccgggagtccatcaagttggtgaaaaggcttggcgctgggcagtttggggaagtctggatgggtaagtgtgcggctcggggatctatgtccttctagagatggtgacaggagaagtaaaggctcaagccaatttcgatcagcttctgagccagacactaaattatgtcagaagcatcatttattttgttttcctctgtccattggggctgagaactggcctgcaaaatctatttacttcagctcttgctctttcttgcgacttagtaattctcttaatgtttgtaaggaggggagtaatgggtatttatcttgatcatctgcctatttcttcatgattccctcatcgccagattctctggatgcacggctcaagtgcaagaaatttgcttccatctctgggaaaggttatcttagggctggaacccattggcttaatagaaagcctcaatgtattacaatttgagggtcaccaagaaagtttctaaggttctcaaagtcacgtcatgaagaaatcatttcttaacattaagtattgccttctcaggctggcaagaagtgcagcaagattatagcagtggctttttccaggggattcttttcatctacctactttaaaaaaaagtttttatagtgagctgagcacagtggctcatgcctgtaatcccagcactttgggaggctgaagcaggaagattgcttgatcctaggaggctgagaacagcctgagcaacatagcagaccctgtctctacaaataaagaaattagccaggtgccatggtatgtgcctgtagttccagctacttgggaggctgaggtgggaggatcacttaagccaaggaggtcgaggctgcagtgggccgagatggcactcctgcactccagcctgggtgacacagtgagaccctgcctcaaaataaataaataaataaataaataaataaataaataaaagttttcatagtgaatgtgaacttctttggtgataagagttttttagaacaaaaatgctaaagcataacattcttttaatggttctaatggaatgtgcggttatttctggaaagagtaacatgttaggtcacacacatctgactgggtcactttttctgtgtcagctttgttgagtgaaagcaaatgtgatttctaaatggaaggggcagatggcttttaaacactctccagccccggcagaacagaagctgcagccacgtggacacgtcacctctgcatccaggttttccctctacagtcttggcccctgggatcatagccttgctcactttctcctgttggcccctcttgagcagaagtgacttttaaacacggcacatactgagccagcctatcattaattaattcttactgcactgtaagtctttctgcacatatttgcagaattcaggtaaactgtaattacatgacttcacattctccgtgtggatcggcatgtgtcagaactggctggcagtgcaaatcaggtcctcagtttctgttccactcagcagattcatgggtgtgagtgctcactctgaatgttgtctcttcccatgcacactctgttgtcttcctcctcatttctctgtgtgctctttttttaattaacatgaaattcacctgacataaattaatcatttaaaaggaacaatccactggcatttagtacattcacaatattgtgtagccaccacctccatctactttcaaaatgtttttatcatcccgaaaggaaacaatgtacccaataaacaatcactcttcattcgccccaccctcagcccctggcaaccaccattctttctgtctctatgaatttaaccactctaggtacctcatataagtggaatcatttatttgcccttttgtgtctggcttatttcacctagcataatgttttcaaggttcatccatgttgtagaatgtattagaattttcttgttttatggctgagtaatattccattgcatgactataacagagtttgtttatctacttatccattggtggacctttcagttgtttttaccttttgactgttatgaataatgctgtatgaatgttcacatacaaattattatgtggacacattttcatttctcttgtgtataaacctaggagttcagttgctggggcatgtgataagcctctgttgaactttttcaagaaccacaaaactattatatgctcattaaaaaaagaatgacttggcttcttttttcctcctttgatgtttatatttatttttttccaaatctacagaatggggcaggaatagtataatgaatattgtatacccttcacatagattcaccagttgttaatattgtcctaattttcttgttcttttatatacgtacacatacatacatgttattattgccgttgaccacctgagattaagtgcagacgtgacttgctgagttttgtgaagagtgtttaagcacctaagcagtactgtgttctcagggcacctgtcaggaggcatagtattagccggtcctattcttaatgatgttctatttgattttatctacagtaatccaccatcacttttatttaaagtgatccaaaagtttaaatggatcatttaaatttagtttctccgtggcaactttttactcccttttgtagtaaataaatactctgtgggaagtttaagattatgtaaatagaactttctccaaatggtttcagcacgatctgtgaattctcttccctcttagaagccgtcacttctctataaagctccagtcctttctgtcctcctcccttgctccttgaacatgtctattccaaccccactggctcacgtcaagatccagggacttctgcgttctcttcccggcttctccgtctgttcactgagagtattggcaggaaaaccaggatcgcaatcacacttaattgtgctcttagtccatctgagtacttactgtgactttgtgtggggagaaggaggagaagacaggaggaagggagaaaagagtgtacaggctctacgggccctgctctaagtgtgtttgcattgacattctcacttactcattgctgtagcactgtgaatgagaggcattactgtgatcattcgataaacaacatcactgagaatcagataagcaacttattcaaggtcattcaaggcagtgagagagccaggctgctctggcatctgggaaccctggactcaattatttgctacactatttctaagctaatttgacttccctagcctcagtttccacatcagtgaagtggacaaactccaatctttcagttgttcaaaggaagaatgagattatgcacctgggatgtttcccagagtctgactccatgtgccctatttttattattgtcacttttttgttttttattctagttattggaagctatattttggtgtattttccccaattttaatcataaaacagagccataaataatccaattagactttcctatggatatttgctggcaaaggaattaacgtgtctgtcatgaaaagaaatgtagagggaggttaatcaggatgtactggttcatcctaaatcagtagccctgcatataaagtgatggcttggaatcttgttctagcctctcctgttcagctgtgaagccaggataaagcatcaaattgcatgctatttgctcctgagagacaagtaaagtgaacaaagtaattcaaatccaactgcttgagtgaattatttcttagtaacactgtttttaaagatgcagttgttggcagggcacggtggctcacacctgtaatcctggcacttcgggaggccgaggcaggtagatcacttgagctcagaagttcaagactagtctggacaacatggtgaaaccctgtctctatcaaaaatacaaaaaaaaattagttgagcatggtggtgttgcacctgtgtttccatctacttaggaggttgaggtgggaggatcgcttgagcctaggaggcagaggttgcagtgagctgagattgcgccgctgtcaccaaactgggtgacagagtgagaccccatctcaaaaaataaataaataaatatgcagttgctgccagcctggatgcctggcatcaaaagtgctgctgtcagctgtggtgtcagtgcgtcctgcagggggtgcctggcgaggttgggagcaggaagtcaggagctaggcagcctggagcacacacctcagcagacctgcttacaccccctgttctgtcgtaaggtgtaagtctgcactaaaattgtacacctggagcttaagaacattggtcctttctgggattgggaaaaccgccttgcttctaattccagatacactgaatcctccaatttctcttctttcctgcacacagcttaattttagagaacttttgcttaacatatattcaggtggtgcctaggagaaacaagtttagaagagaagagaatggagtgttggaaagtatctgattgttttatacaaatttttactttttatttagactgaaacaggataaaaatcttgagaaaatacatcacttgaatagatttgctcattccgtttttaaaaattgtggttaaatacacgtgacataaaatttgtgttttagcgatgtttaggtgtacagttcagtagtgttaaatgcatctacactgttatgcaaccaatctccagactctcttttcatctgataaaactgagagactgtgtactctttaacaccaactccctgatcccctctctggcaaccaccatgctactttctgtctctatgaatttgactaccttaggtacctcaaataattagaatcatacagtatttgtctttttgtctctggcttacttcacttagcatgatgtctccaaggtttatctatgtcgtagcatgtgtcagaatttctttgctttttaaggcttaatgatattcctttatatgcatacataaccttttgtttattcatctattgatggacaattaggttgtttctaccttttggctattgtgaatttgccactgtgaacatgggtgcacagatacctctctgagaccttattttccattcctttgagtataaatccagaagtggaatggctggatcctgtaattcttctatctctaaaatttggaggaactgccgtactgttttctacttcggctgcaccattttacattcccattgaccgtgtgtaagtgttccctttctccacagcctcaccaacagttgttattttctgttttggggattttttttgttgttggctggttggcttttgtgatagttgtcattttaatagatgtgagatggtatcttactgtggttttgatttgtgttttcctaataattagtgaccaagcatcttttcatgtccttcctggtcatttctacatcttctttggagaaacgtatgttcaagtccctttctcactttttaaattgtgttctttacttgatttactaataacgttttaaatgacagaggcagtagagcctcatctaaaatggggtttaatggaacctatctcagagggattacataacaattgaaagaaattgtgcaggtaagttcaattgacagcattcaaagcactgttattaaataatatctttagtaagaaaatatgtcacactagtgcaaaggctatacagtagaggaaagaaattgcccagggtttcccactaaatagaagttgtttgtatttttgctttttaattttttttattttgagataattgtggatttacatgccattgtgagaaataatacaaaaaggataacatatgtccacgcaaaaacctgtacatgagtgttcatagtagcattatttgtaatagccaaaaagtacaaacaactgaaatgtccatcagatgatgaatgggtcaataaaatgtggtgtattcatacaatggagtatttggcaataaaaaaaaaaaatgacctggcatacttcaacatggatgccatgctgttttatggatgacttataataacactatgttaagtgaaagaaatcaggcccaaaggagcacatattatactgttccatttatatgaaatgtccagaataggcaaatctagagttagaaagtagatgactggttgcctagggctggggggcctgggagtatggtaggagtgactgctaatgagcatgggatttctttttggagtcatgacaacattctaaagctaattgtggtgatgattgtacaattctgaatatgcaaataactgatgaactatatactttaaatgggtaaatgacatggtatatgaattatatttcaataaagctggcaaatatataaaagaaatgatacagagagatcccatgtaccatttacccagtttcctccagtggtaacatcttgtaaaactatagtacaacatcactaccaggatattggcattgatcaccgttcattttttaattgtgcttttcttccagtcttatattgaatggaggaaggaaggaaaagaagggaaggggaggaaaagaaaatagaagagaaaaaaatagaaaattttgacttgggatcttttgcttgtagggactgagtttgcctgtcagtcagcgagctccttcttcactcctgaaataatttaaatatgttgaatacacatagcagaggaatattgggaatacaaccaaaagagttgtgattggtgattttatgttacaaatagactgaaggatactccctctcccaattttgagctgctagaatttagttttctcttaccctttttagtttctcaaaggataagcaggccagcttttctcattgatagaaaaaatacaattaaaattctatcactgttaacccagtaagttaatatttttgttaaacataaggaattgttcatggacaacccatttcattttatggtctgcatttttttggcttgaaatgcagtgaacaaatactaggaagtgacctgttctttgggggaaggggctgggtggggataaaagaaagaggtgtctctgcttcaagctgtttcctcttgtttgtgtgatccttgtgacatctgacttgggtgacatgcttcctctgtggattgtcctattcccagggaatcaactgggcagtgaggctaaggacgatgtttcctctgactgcttggtctatgaagagaccctgaggaaggaaggaaacttattttacattgaattttgcttgataaattctcatttgagccaactgccttgagattaatcaccaacccacttccaaaatcaactgcatgcattttttaaaaaccactctcccttttgtggtacgtgggcactttttagcaagccagtcacagccggaattagagtgctctcaaggtgccacatcagctttctttaactgtggcaaagtgtcactccacaagacgctttttactagctcaaaaagttttttttaacataatttttcatctgtattgacaacccaaatctccatgactaggttaatttgaaccttcaaactaccagagagtatcttagaaacctatgatttgatccttagcactgaataaaaatcatgcctttaacagagggatgaaaaccaccctattgtttcaatatcacagccctaagagatcatctgggagctgccgccattcttgggccatgtttgacacagctgctttatctaccactcacctcaaactccttatcagtatttaaaatatatgcagctgcaatatttcctgatgacttcccccctaaccttggaaagcgttttttttccttcgtcctttactcatacttttctatttataagtctccatgagcttcattgtttttatgatggcaaaagggaaatggttttgtttctttaacttttattgctatgtaatgtaacaagcagacagaaaatgcaaacacaaatatctaatttcacaaataattacaaagcaaaaactggtgtgtcgacctctgagaggaaacttgctagccccagaagcccccaccgtccacccatcccctcccacccacaccctacctgtcccccagagacaacagctattccgaccttcctgatggttttctgacttcttcttaattttgccacttttgtatatggggatgtatgcatccccccaaaatatagctcagttttgctgtttttgtactttgtatgaacgaattataccaaatgtgctcttttacgtcttgcctcttttactcaacgggttggtgagaggcatccatgcttttgggtgtggctacagttcattcatcttcattccatgtggtgttggtaagatacatgtggcttttgggtatggctacaattcattcatcttcattccatatggtgttggtgaaatgcatccatgcttttgggtgtggctacggttcattcatcttcatcctatgttgtgttggtgagatgcatccatgcttttgggtgtggctattgtttattcatcttcatgccatatggtgttggtgagatgcatctgtgcttttgcgtgtggctacaattcattcatcttcagtccctatgatgttggtgagatgcatccgtgcttttgggtgtgactacagttcattcatcttcatctcatgtcgtgtttgtgagatgcactcgtgcttctgggtgtggctatggttcattcgtcttcatcccatgtcgtgttggtgagatgcatctgtggctacggttcattcatcttcattccatatggtattggtgagatgcattcatgcttttgggtgtggctatggtttattcatcttcatgccatattgtgctgtgctgcatgtgttttcaagatatacgatcatttatccatttatttcaccatttactgatgaaattggagttcatgttagtccattttgctttgctaaaggaatacccgagactgggtaacttataaagaaaatgtttatttgctttacggttcttcagattttataagaagcatggcacctgtctctgcttctggtgaagcctcaggaagcttccattcaaaaaggaaggcaaaagggagtgagcatgtcacacagtgagagcaagagagtgaccagaagaggtgccatgcttttagacaaccagctctcttgtgaactaatagagcgagaactcactctttaccacggggatggccccaagccattcatgagggattcattcccatgacccaaatacctccctctagtccccacctccaacactggggatcaaatttcaacatgagatttggagaggacaaacatccaaactatatcagagtttttcccagtttgggctgctatgaacaatgcgctgcacatttttgtgcctcatttttgtgctgatgcaagcatgcatgagctctagggtgagtgggagtggatttgctggatcgtaaggtgtatgaatcttcagctcttctaagttattgccaacttattttgcaaagtgctggtcccagcttaagattctcaccagcaatatgccagtccccacgtcccctttcctgactagcagagctgtacttagagagatgtgggccccaaggcagcacaggcagtgggtggttatccggaaggaagtgtgcactcagcatccttcatggacaccttggatgttgtcacagaagctctgcaattgaatttcagtgatgctcagcaaagaacacagaatgaggcctagggcagctgctccagagtccctcccaaggggcaggtgctcatcagcacttgatattaccagactttaaaaatttttgctgagctcggcagtggtttctcatgactttatttgcatttctctggttactaataagattgagtacttttcacgtgtttattactcatatgaatttcttcttttgaaatgcccttccaagcctttgcctatttcttctgatttttcttattgatttgtaagaattctttctatatcctggatgcaagttccttgcagttatatgtatcatatagtttatgtattttcatctattttatatcatgtattttcctgctgtgatttgctatggatatgctcatgtaacttagggttagagttagggctggggttaaggttagggtttataaacgttaaaaaatttataataaaacctttttgatttaaatgtaatattaaaaggcttttgttggtggaatgtactttacaataactcttaagatctacagaaaaggccatattgcttgtaattatgcatttagatgtcagaacaatttaatatattcataattccattattttaggtaggtggtagctttttaaaaggacctaggatggtttttttttgtcagctttatgttactatcttctccatatgttctaacacttatcttgtactgcatttttctttttcttttctttttttgttttgttttagagaagggggtctcactatattgcccaggttagtcttgaactcctgggctcaagcgatcctcctgcctctcaaagtgctgggattacaggcatgaaccaccttgtctagcctcatttttctatagagcactgcaagctcctaagtattaaccaaagtggaatacaaaataaaacattttaatagaggaatcagtcttaatgaccaaaagaaacatcattggataggttgactgctagctataaataaactttttattatttgtttgaaggcttggaaatagatgtataatacatttctttattatttaaaaaaatcattttttaaaaagtacatacttggctgggcacagtggctcatgcctacaatcccagcactttggaagaccaaggtgagcagatcagctgaggtcaggagttcaagaccagcctggccaacatggcaaaaccctgtctctcctggaaaaaagaaagagaagagaagagaaaagaaaagagtacatactcattgacaaatccaatcagaatagaaaagaacaagagaaagtagaagtcactccaaattctaccagccagggataatcactgttgttttactcagcaggcttccagtcatctttctatgctattcacatacagatactcttgcaccctaaaaaggggaccgtccactccacgtcacctttccttaggtggatagggcaggtgctatccagcttttgcgcaccaggcagcaggaactgcaggaagatttacagtgacaccagcagctattactcccttctccccattttttttttaacatttccaagagaaagatggaagcagaagagaggacaggaaggaagagtatgattattaatatttctgctttgccaaattactgagaaaaggctttcccaagagaaagtcaggattaaagtgctcaatcccagtcccagaagggtggtgcctcgggggaactatactaaggagtcagtattgcccagagcgtgttccatgcggtgtaagaggctacttgaacaagtgttctgaggtcaagaaattgtgggaaacgctggggtgaacaaatgcaggcttttcccctgaaggcctcccagggcacctgctgcatctcctgggtgggggaggagtggagggagtggctccctgtccttttagtgggggatcctttttcactaacagtcacccaagtccagttgtctgcaaattttgggaagtgcttgtttgactctagcatattgtactttaaagttagtatatataagtaatttttataaagaacaccttttttaaagaaaatgtggtaaatagttaaagatatggtgaacaaaattaaaatcgctcgtaatcacaccattggaaataaccagcatttgatatattttggtgtcttttcttccagactgttgtttatatgtgtgtgtctgtgtatctataaaatatgtctgtattttaaaatggggattataatgtgagtgtatgcctgtgtgtgtatgtatatgtatgtaagggattatagcatatatagagttttgttttgttttttttggtcttgaataaagaacattttattattagagaaaaatattagtcctcggctgggcacagtggctcatgcttataatcccagcactttgggaggctgaggctggcggatcacttgaggttaggagtttgagactagcctggccaacatggtggaaccacgtctctactaaaaatacaaaaattagccaggtgtggtggtgggcacctgtaaacccagctactcaggaggctcaggcataagaatcgcttgaaaccaggaggtggaggttgcagtgagccaagatcgtgccactacactccagcctgggcgacagagcaagacgtagtctaaaaataaataaataaatattagccctcatggtagagtgccaataaaaacgtttttttgctactatttcatagaaaccttttgatttttgaataatttaaacattttttggtaaagaaagaaaattcctagatacttttcatctagcctcccctaattttatcactacatagtgttttaactcaggctttttctatctgtaattaaattttttgctaactctgcatctacaaagtgaagttttaattttttttttttttaattgagacggagtcgcactctgtcacccaggctggaatgcaatggtgcgatctcagctcactgcaacctccacctcctgggttcaagcaattctcctgtctcagcatcctgagtagctgggattacaggcgcctgccaccacacccagctaatttttgtatttttagtagagatggggtttcactgttttagccaggctggtttcgaactcctgacatcaggtgacccactcacctcgacctcccaaagtgctgggattataggtgtgagccacctcccccggctagattttctgttttataaagcatgcccgccttcttttttcttcctaggttactataacaacagtaccaaggtggctgtgaaaaccctgaagccaggaactatgtctgtgcaagccttcctggaagaagccaacctcatgaagaccctgcagcatgacaagctcgtgaggctctacgctgtggtcaccagggaggagcccatttacatcatcaccgagtacatggccaagggtgagttcctcccactgcccagagcttgcaagggcttcaaactcaaaaagtaaaatgtgtaagtgttcagaggtcactcaactagtttaattatcaaacagtatacccactaccgaaaaatcaggaaatatgggaagacaaagcagtttataaacctaatcaccagaagnnnnnnnnnnnnnnnnnnnnatccatgtcacaggaattgaaatctaatcctcctgttttctctgcatctgcctgcgtgtacctattgccctgagaatagtaccccatatctagtagcccccaataaatatttatcaaatgaattactatgtatttcaaaaaggaatttttgaaatacatatgcttaaaatgtgaagagttcccagaattctaatactacagatttagtacggattgttcagtaccaaattcctctttcatttttttttttttttttttttttttggaaacagagtctcacactgttgcccgggctggagtgcagtggtgcaatctctgctcactgcaacccctgcctcccgggttcaagcgattctcctgcctcggcctccctagtagctgggactacaggcacgtgccaccatgcccagctaattttttgtatttttagtagagatggggtttcgccatgttggccaggctggtctcgaactcctgagctcaggcaatctgcctgcctcagcctctgaaagtgctaggattacaggcatgagcacccagcctctatttgttctttagcgttatctaatattcattttccttttcagcattatctaagtgttcagggtgtcacttttaaatattaatgttttttaaaacttgtggaggttaaagtcctatgtaatcatagaattgctggagaatagacttcaagcaatcaatttttcttctactgtgatcaccttcatatacaagactttgaatcaacatccttcttcctttgttcacctccagttcaggaaacatactaataaactgccaaattattttttacgaagtcctcagaagtaatgaagaaacataagcaatgatccaggattaacaatcatctcatgcacaatggagatgatagtatgatgtcatagctgaatagattcaaaagatgaatattacattttcttatttaatatctgtgagtatttcaaaatatcagtcactcagagtctttccaaacaatggcattgtttgttttaaagcaaacaaaccaattagctcttgtggcttgggttgccatatatagcccagaaaccaggctcagggccagacaccttataggagttcagtaaatattgttgaattaattaacttagagtattcctaatgataggtataaatatgagttttcctatgtaacaatgcctaatatatatatatatttatttttttgagacagagtctcactctatcacccaggctggagtgcagtggcactatcttggatcactgcaacctctgcctcccaggttccagtgattctcctgcctcagcctcccaagtagctgggattacaggtgcctgccaccatgcctggctaatttttgtattttttagtagagacagagtttcaccatgttggccaggctggtcttaaactcccgacctcaggtgatctgcctgccttggcctcccaaagtgctggaattataggtgtgagccaccaagcttggccaacaatgcctaatatttattgagcacttactatatgccagactgctcttggtgctttccatgggtgatctcacttagtcttttcagcagcctgagggctaagtactattgttctgtgtcatagatgagatagcataacgtttactgagcacttgctacctgtcaaccatcatggtatgtgctttggatgcaacctttgattccaaccccccaaaactgtaatatagcctctagtacatgcccattttacagagacctagatgaggtaaacaacttgaccaaggctacccgtaaggctggtacttaaagttctaggggaaaaacaggtcttgctttagagatgaagccataggaggttggagagtttgttcagcagcacactccttcttaggtaggtttccacttttttccaaagcacagttcactcatcaaatattctttgaggctgggcgtggtggctcacacctataatcccagcccttttggaggccaaggtgggaggattgcttgagtccaggaatttgagaccagcctgggcaacatggtgaaatcctatctctacaaaaaaaagaattagctgggtgtgatggcatgtaccctcagctacacaggaggctgaaagtgggaggattgcttgagcttgggaggctgatgctgcagtgagatgtaatcatgccactgcgctccagcctgggtgacagagtaagaccctatctcagaaaacattcattgagcacctacagtaagtgccaagttctgtgctttttgctgaatacagatgggagtgagcctggccaagtgtctgcagagggcaggccttccagtgagctcgctaaagattgggaggtggcagtgagtggatcatggtggcaagtactctgaaatgcatggttctcagacacctgtagtgagaaaagtggtatccacccacattctttctcacctggagcacatgccatgtttcacatcaggtcaaaggtaacagattagaggggactgcgtttgaccaatgccaggaaaaggctttatataaccatacagaattgcaaagccaatcattttgtggggagttcccctgtaatagtaatgatgatgtgaattttgtttggattttttcttgtgtgtttggaatgcactaacttgttctttctttctccataggcagtttgctggatttcctgaagagcgatgaaggtggcaaagtgctgcttccaaagctcattgacttttctgctcaggtaacatattcaaaaagccccgtgtgcacgtgcatttgcaaagacttccctgcgtcaaattcatgaaggagttattgttccagggagaaggaatttctgttgaatgtttcccagcagcagttatgagaaaaagaccttccacaatacaattcttggagatagtaataggacattcacatggattgtgtgtacgtgttgagttttgacctggatatcatcttctataaaccaagtcaacctctttatgttcatttcataagtcatagaaacagtgcagctgaatcaatcactttctcagcatttgggagaggcagttccatgctatgtaagcacagcagcttttaaatgatgcgtatgttttatttaagttacgaatcgaatgtatggatacttttaagtcctctgtattcttgaaaacagaggaactatgtcactttcctgctcctcttctcgctccttcttgttggatgtgccatcaggattctgtgaaatattcatttgtactatttttagtactagcctaggagttgcctgtttatttactttggaatcacatgtttcctgaagtgtatttaagagcagaagcaagttatccagaagccccacaatgtgcccaaaatatcaaggaaatgcacacttgaatgatgccagctgctggcttttactagtttcattgtgtccattagtaatgttcagcagtttgcttgcttgtttctcagtattggcaatcggtggtttcatgaagcccagtgtatgtagcaaaagagatttatagaagttctagggaagactggtccctatagtcttcctttttcactgccacttcttccctcacaccctcttttagttaggaaattgctacggccttcttgggaatacgagatccaaggaatgcatgagtacagaggtgaagcacctcacctaaggtagggctggacacaggttctgtaatagagcatcgtgggctaagctggcattcagcacctggagactggagtttgtgttctggctctgccactcgatagctataccgcttccatttcagaagccctttgcctatttgggctactttattcacctgtaaaacagaatggtaattcctgctttaaggagatgttgttgagagtcacatcagacacagatgttgttgtgtcacatgcttggcacggacacaagcacctcagagcctgctggtggaagctgggaaaacccaagggagggcaatgcccatccttccagtaaaggtgtgtgatgggtgagtcacagtgctcaggcatcctctccacctccgggacttggcaagcctaacaggttcctcatctgagttggaaattcaagtgtgccctgaaatgccaacatctaataagaaagaagcataattgctgtggtggaacagaggggcaaggaaaggacccagcagccctgcctttttagccctgtcctcaaagtctatgctggcccctgggaggctccatgggattccaaggtttccagaactatagtttgaaaaccacctctctgcagtaagaggaataggtggggttgggcacagctctagaacccgtgtagaaaacagatcaggaaatggagaaagcagaagtctgataaacttgggccatacttacacggatcaatgaggccctctactcaggtggtgatttgggtgtccccatgggtcaagagacttgaggagtgtaacaaaggtttgtcacacttgtacagggctatggaacatcgggacacatggcctggagggcctgagtggtcacagccgttccatctgctgggggtctgatctgtacccacagttctttagagtagaagttacacacattgggtatgtactgtacccggagaatgactttattttgtcacatgggtattttgtattgggttttgcatggcttatcttgtaagactttatcttgacatagtcaaagcttttaaggtccaagtcaaagcctctatgctgagtctttaatttagtgaattactaccattacctcg

SEQ ID NO: 15097 - DNA, 59076 bp, Human
  misc_feature (1)...(59076): n = A,T,C or G
tccaaccattaccacagtcaacgttagaacattttcatcactccccttcaaaaaacccatgaatcgctccatatttcccctgaccccctggaagccctaggcagccactaatcattctgtctctatggatttgcctattctgggcatcttatataaatggaatcatatattagtgtgtcttcaagatggattcatgtgccgtacttcattcctttttatggctgaatagtattcccttaaacaaactataccatattcacccattcatcaattgatataccctaggattgcttccactttgggctattatgaataatattactaagaacacacatgtttttgtgtggacatatgctttcatttctcttggctatatatctaaaagggggatttgccgagtgttgtgttaactctaacctttcaggaactgccagcctgttttccatagcgagtgtagcctcttacattcccaccagcaggagagagattcccgtttctccacacccctgctgacgcttgtctttttgattacagccatcgtaggaggtgtgatgtggcatctatttgtagttttgatttgcatctccctaatgcctaataatgttgagcatttttaatttctattttgcccaggctggtctggagttcctggcctctcagcgctggggtcacaggcgtaagcctctaccagttgagctgagcatcttctggtgcttattggccatttgcataatgcactggaaaaatattcatatcctttgtgcatttttcaattgtctttttattgttgagttgtaagtttcctccattctagatacaattcccttatcagatatgtaacttacaaatattttctcccgttctgtgggtggacttttaattttcttgatggtgtcctttaaagcaccgaagtttttgttttgttttgagatggagtctcgctctgtcgccaggccagagttcagtggcacgatctcggctcactgcaacctccgcctcccggcttcaagcgattctcctgcctcagcctcccgagtagctgggattagaagcaggcgccgccaaacccagctaatttttgtatttttagtagagagacggggttttaccatgttggccaggatggtctagatctcctgatctcatgatctgcccacctcggcctcccaaagtgctgggatttcaggcgtgagccaccgcgcccggccgcagtaaagtttttaatctgatgaagtttaatttattcttctgtagtcgctcctgcctttagtgtcactgcctcgcccaaggtctcaaagatctcctgtcggcttccaagtgttttttttttttttttttttttttgagacggagtctcgctctgtcgcctaggctgtagtgcagtggcgcaatctcggctcaccgcaagctccgcctcccgggttcaagcgattttcctgtctcagcctcccgagtagctgggattacaggcgcccgccaccacgcccggctaatttttttttttttttttgtagagacggggtttcaccatgttggccaggatggtctcgaactcctgacctcgtgattcacccgcctcggcctcccaaagtgctgggattacaggcgtgagccaccgcgcccggccttttttttttcttttttctttctttctttcttttttttttttttgatacggggtctcgtcgctctgtcgcccagggtggagtgcaatggcgtgatcttggctcaatgcaacctccgcctcccgggttcaagcgattctcctctaggattacgggcgcctgccaccacgcccggataatttcttctaatttttagtagagatggggtttcactatgttagctaggatggtctcgatctcctgacctcgtgatccgcccgcctcggcctcccaaaatgctgggattacaggcgtgagccaccgcgccccgcccaagtgttatttgtaaaacgaagaaaccaacatcgagagggacgctgactcgaccccgcgcctttcccatccgcaccagcaagagggcccctgtgccccaaacgcgaaccgtacggctccagacagcaccgcggaactcggtggcttccagaaggccccgcgcctgcgcattccgctgcctgcgcctgcgcctgcgcctgcgccgttctcccggccgccgccttagcacctcctccggacggtgtcgccgaagtctcgcgagcccggagcgtggcacgtgggttggtaactgtggcgctgctccctccaccaccacccctgtcctcctcaggccccctccgcctccacccctgccctcctcaggccccctccgcctccacccctgccctactcaggccccctccgcctccacccctgccctcaggccccctgcgtccccgcctcgtcctcctcaggccccctccgcctccggctccgtcctcctcaggccccctccgcctccggctccgtcctcctctggccccctccgcccccggccccggccccacggcgggatgcgggacaacaccagccccatcagcgtgattctggtgagctcggggannnnnnnnnnnnnnnnnnnngcttccagaaggccccgcgcctgcgcattccgctgcctgcgcctgcgcctgcgcctgcgccgttctcccggccgccgccttagcacctcctccggacggtgtcgccgaagtctcgcgagcccggagcgtggcacgtgggttggtaactgtggcgctgctccgcgtccaccaccacccctgtcctcctcaggccccctccgcctccacccctgccctcctcaggccccctccgcctccacccctgccctactcaggccccctccgcctccacccctgccctcctcaggccccctccgcctccacccctgccctcctcaggccccctccgcctccacccctgccctcctcaggccccctccgcctccacccctgccctcctcaggccccctgcgtccccgcctcgtcctcctcaggccccctccgcctccggctccgtcctcctcaggccccctccgcctccggctccgtcctcctctggccccctccgcccccggccccggccccacggcgggatgcgggacaacaccagccccatcagcgtgattctggtgagctcggggagcaggggcaataagctgctgttcaggtaccccttccagagaagccaggagcacccggcgtcccagacaagtaagtgagcgctgggcgggggcctggcgctcgcgggggccgcctcattccggggtcgcctcattccagggccgcctcgcggagcttagcttttgctgggcattcgagatctgctcgttgtagagtatttgaaaagtagaaaaaggaaaaaaaaaattaaaatcatgcattgttcaccacaccaaagcaactactgctgacatttcatcagtctccagcctttaaaaaataaagtaaaataaaataaaatgagtttgggatgtattcatcatgagaaaatacaaaattacacgaacaaggccggtggcggtaatcccagcactttgggaggccgaggcgggtggatcacctgaggtcaggagttcgagaccagcctggccaacatggttgaaactctgtctctactgaaaaaataaaaataaaaaaaaacaaattagccgagcgtggtggtgcgtgcccataatcctagctacttgggaggctgaggcaggagaattgcttgaacccgggaggcggaggtttcagtgaaccgagatcgcgccactggattccagcctgggcaacagagcaagactccgtctcaaaaaaaaaaaaaaaagttacgtgaacatctgaagttgtctttgccacccccagttccagcaagcacagggatcacccctggccgtgttgggagttgtctgccctgtgcatagatgcagatctatccacaggaaaagagaacgtcgcgtgaggtttttcatcgcacgaattgttctgtggcgcccttttcccatagtcggccttggagctccgtctgcctttgcaagcagggatcaacctcacccttggctgcaggctgctgccttcccctgtggacggcatgtaggttacttttgatttttcatcatcatgaatgttcagtttttgtttttattttatttattttttgagacggagtctcactctgtcgcccaggctggagttgagtggcgtgatctcggctcactgcagcctccacctcccgggctcaagggattctcctgcctcagcctcccaagtagctggggctacagggcatgtgccaccacaccctgcaattttttttttttttttttttttttttagtagagatggggttttgccatgttggccaggctgatctcgaactcctggcctcaaatgatctacctgcctcggcctcccaaagtactgggattacaggtgtgagccaccgcacccggactgttcagtttttattttgtattttgttttaaaattatttttaaacttgttgatatggcagaaagttttaaagatacaaaggagtttagattatgaaaagaaagttctttcctactattggcccccagccctcagtttccatcataggggtaactactgttcccatttttctgtgtctttccaggaccttctgtgtcaatacaggcgtatgtatttcttttttctttttttttttttttgagacgagtcttgcagtcttgccaggctggagtgcagtggcgtgatctcggctcaccgcaacctccgaccccctgtcaagcaattctcctgcctcagcctcccgagtagctgggactacaggcatgcgccaccatgcccagctaatttttttttttatttttagtagagatggggtttcaccatgttggccaggctggtctccaactcctgaccttgtgatccgcccgccttggcctcccaaagtgctgggattacaggcgtgagccaccgcgcccagcctgcacttgtgttttttttctaagcacaagcaaagtcacaccatacacactgttctgcccctgttttcgttttcacttcatgtctgcatctttgatgtagatcagaacctgtcgagcacccttgtccttcttaccggccacggtgaattccatgagatgaacatattgtgatttgtttatcgtgtccttttggttgatggacgcaaaattgttttcaatcttttgctaatacgaaaagttcaaacgttctttccaggtattgtcattttgcagaattcttgtaatattaaatccccaaagtagcatggttgggtctaagggataaagagcatatttatttttaataggttagatttttcaatctttgttaatctggtaggtgaaaaattatatctggtagtaattttaatgtttatttgccttttaattgagatagaaagcatattttcctgtttttggagccatttggatttccttttcagtgaatgacttatttataacctttgcctaatgttctcttgggttgtttgattttttttccttatagatttgaaggagttctttatatatttaatgtaaaaataggtcttgggacaaagctatagtcaccctgtttgcttctgtgtagttcttgccagagttttgatttttgtggagttttcagtctaatctcttgtggtttctgagttttgttttaaatggaaaggcgttttgctctccaaaattattaacaacaacaataaaaaactcccttattttcctccagactgtttatgtcttttttttttttttttttttttgagacagagtctcactctgttgcccaggctggagtgcaatggcctgatcttggctcactgcaacctctgcttcccgggttcaagcgattctcctgtcccagcctcccgagtagctgggtttacaggtgcgtgccaccacgcctggctaatttttgtatttttagtagagatggggtttcaccatatcagccaggctggtcttgaactcctgacctcgtgatctgccttcctcggcatcccaaagtatgtcttgtttttaaatgtgtttgtcttggcataaggtgaaggctaatcctaagagctgatattttctgggctcttgtgaagagttgcagatgaactgcatggttgcctttggagccctgtggaactggagttataacaggccacaacgtggccaaatgatgattgattgggccaacataattttcttttccatatggctatctggtcccaacataattttattgaataattcaccttacttccactaattgattctgctgtctttatcgtgctaaattctcacgtttacttggatctattttttgtctttcttatctcctccaatgatctatgtgtaggttccataataattactgtgacttggccgggcgcggtggctcacgcctgtaatcccagcactttgggaggccgaggcgggcggatcacgaggtcaggagatcgagaccatcctggctaacaaggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaataataataataattactgtgactttatgttatactatccgtaaggttagtcacttgtcgttacttttctttttcagcgttatcctggctgtgctttattatttttccctgtaaactttcgcatcaagtgcattaggtcccactcccaagctcttggtgtaggtagctttgaatctgttgattaactgggaagaaaaagcatctttatgttgaatcttcccgttcaggaaaatgatatgtcttcaattcatttttttctcccttattagcttttccattgttttcatgggccttttgcactcttcttagattcatcactaggtttttaaatttttttactccgggaaagtattattgtttgtgtatatgaaggctcttggtgtatgtacatttaaattttttttattttgcctatgctttttccaacctaattgtcatcccacactgtgagggggtgtgtgtgtgtgtgtacatgtgcataggggcctacctcactttattgtgttttctacaaattgaaagttcatggcaaacctgtgtccagcaagtctgtcagcaccatttttccaacagtatatactcactttgtgtctctgggtggtgttttggtaattcttgcagtatttcaaactttttcattattattgtatctgttacggtgatacatgatctttatgttactattgtgattgttttggggtaccaagaaccatgtccacataagatagcaagtttcatcaataattgtgtgtattctggctgttcgcccatctgtttccatctccttggaccaccctgttcccttagacacaacaatattgaaattaagctggttatctacagtggcctctaagggttcaagtgaaataaagaatcacatgtttctcacattaaatcaaaagctagaaatgattaggcttcttgaggaaggcatgttgaaagctgaactaggccaaaagctagtctgcttgcacaaaacagccaaatggtaaatgcaaaggaaaagctcttgaaggaaatgggaagtgttactccaagccaggcctgcacctgtactcccagctacctgggaactgtaggcaggaaaattgcttgagcccaggagtttaaatctagcctgggcaacatagggagaccctgactcttaaaacaaacaaacaaacaacgctaggcacagtggctcatgcctgtaatcctagcactttgggaagccgaggcgggcggatcacgaggtcagaagttcgagaccagcctggacaacatggtgaaaccccatctctgctaaaaaaaaaaatacaaaaattagctgggcgtgttggcccatgcctgtaatccccagctactcgggaggctgagacgggagaattgcttgagcctgggaggcagaggttgcagtgagctgagatccgacattgcactccagcctgggcaacaagagggagactctgtctcaaaacaaagcaaaacagaacagtgaatgcatgataaaaaggtaaatagctttgtttgttgctggtatggaaagttttagtggtctggatagatcaggccagccacaatattctcttaaaccaaagcctaatccagaaaaaggctctaactctctttaattctgagaaggctgagagaggtaaggaagctgcagaagaaaagttggaagctagcagaagttagttcatgagatttaaggaaagaaaccatctctataacgtaaaagtgcaaggtgggccgggtgcggtggctcacgcctgtaatcctagcactttgggaggccgaggtgggcggatcacgaggtcaggagatcaagaccatcctggctaacacagtgaaaccccatgtctactaaaaatacaaaaaattagccgggcatagtggcgggcgcctgtagtcccagctacttgggaggctgaggcaggagaatggcgtgaatccgggaggcggagcttgcagtgagccgagatcccgccactgcactccagcctgggcgacagagcgagactccgtctcaaaaaaaaaaaaaaaaaaaaatacaatttgtaaggctatagctgccatagatagtgattccttggacagatcagggcaaaataaattgaaaaccttctggaaagcatgtgccattatagatgccattaagaacattggtgatcatgtcaaaatatcaacagtaacaggagtttggaaaaagttgattccagctctcatggatgactttgaaggagtcgaaacttcagtggaggaagtaactgcagatatggtggaaatagcaagagatctagaattagaagtagggcctaaagatgtgactgaaatgctgcagtctcacgataaaacttgaacggatgaggacttgattgttatggatgggcaaagaaagcagtttctgggctgagtgtggtgactcacgcctgtaatcccaacacttgggaggctgaggcaggtggatcacttgagcccgggagttcgagaccaacctgtgcaacatgacaaaaattcatctctattaaaaatacaaaaactagccggacatgggtgtcatatgcctgtagtcccagctactcaggggactgaggtaggaggatcacctgagccttgggaggtcaagactgtagtgaacggtgatcacaccaccgcactccagtctggatgacagagtgataccctgtctcaaaaaaaaaaaaaaagaaagaaagaaagtagcttctggaaatggaatgtattcctggtaaagatgttgtaaacattgttaaaatgacaacagagatttcgaatattatataaacttagttgataaagcagtggtacagtttgagagcattgcttccaattctgaaagaagttctgtggtggataaagtgctgtcaacgtcccgtacgacagagaaatctttcatgaaaggaagagtaaattgatagatgtagcagaggtcattgttgtcttattttaagaaattgctacagcaccccagccttcagcaagtaccactctaatcagtcaacagccatcaacattgaggcaatacctttctccagcaaaacgattgttttgctgaaggctgagctgattgttagcgttttttttttttttttttttttgagactgagtctcactctgtcacccaggctcaagtgcagtagcacaatcctcatcctcctgagtagctgggattacaggtgcccaccaccatgcccggctaattttttttttttttttttgagacggagtcttgccgtgtctcccaggctggagtacagtggcgcgatcttggctcactgcaagctctgcttcccgggttcacaccattctcttgcctcaccctccagagtagctgggactacaggcacccaccaccacgcccggctaattttttgtatttttagtagagacggggtttcaccgtgttagccaggatggtcttgatctcctgatttcgtgatccacccgcctcggcctcccaaagtgctgggattacaggcgtgaaccaccgcgctcagccatgcccggctaatttttgtatttttagtagagacggggtttcgccatgttggccaggctggtttcgaactcctgacctcaggtgatccacccaccttggcctcctaaagggttgggattacaggcacgggccaccgtgccttatcactgtttttgaagataacataagatttgtcattttaatgatttgtaagtgtataattaagtggcattaattacattcattatagtgtgcagccattaccgctatctgtttctaaagctttttcagcacgtaaactgaaactctgtaaccactgaccaataactcttcatttcccctgctcccagcctgtgctaacctctaatctactttctgtcttgatgcatttgcctgttctagacatttcatatactgtaagtgcaccatttgttcttttgtctctggcttattcagcatgatgttgtcaaggttcacccatgttcattcctttttatgtctgagtaatattccatggtatggacagagcatgttttggaaaacatggctgttaacggttccataaccctcctgtgtgtggaaggaccctgttttcttagcccttcccctcttttcgccccgactcaggtaagccgcgtagcagatacgctgccagcaacacgggcgaccatgctgatgagcaggacggcgattccaggtaaaggctctgcggccacttcagggcggggcgtgtcctggtcccaggcctgggcaaagccccaccctcctattcacccagatgttttctccctgagaagtctggtgtttgtttttttccgtttagtgggtgctctcaggtagtgtagagtggaggactgcgtagacagtctggggcttgctgaataatttgggcacctgttccagcttcaggcttgtctggtgggtgaagcaggtcagagcacagatgaggccatgtccacgtgagatgtttatctcctatgaaagaaacatagaggaaagcagacccctatgttgttgtctttggatctaattccttgagcatgtacccagaggtcaaatgcaggtgcttgggtttagcacagcctggtcaagtcccttcttggtgtccaggctcaggtggtgatatgggcagtggggcttagagctgggatggtgtgaaccttgatgttctttgatgttcttttaggcacagatgaaaggtggatccggttccttcctgtgtttgtgcccctgctctctctgggaggcactaccagggtagaaactttagaaatgaccacttctgccttctgttcattttgaagcatagtaaatggtaacataggcccaggtgagggagggaagattgtgagttacctgccctgggttcccttaaacacagacaaggcctgtgtggagtaaaggacttggcttccactgtcccgggaaaaaatagctaagatccctatgctgggcctttgctgtgcagtgaggtagtgctgtttctctgcagttctctgacaaggcagcaccacacctgccatggcaatttgcaagtctttttaaaaaaattttattgattgattgtagagatggggtcttgctttgttgcccaggctggtcctgagctcctggcctcaagtgattttccttccttggcctcccaaatttttgggattacgtacataagccaccatgcctgaccacaatttgtggttccaagagtgtgatttttatcatcatttgggaggatgttggggcctctggcatgactgatgactgtctctgagtggagtgggctttggaagggcgatggggcttgctggacaccccattggaccgtcattttgatgtagaggcctgtggttgtcttgccctttaaatgtggtggtggaacaaactctggtttgtcacaggcatatagaatgcttttgcccctgcacagtgggtaggtatttcctgttctccctccacctgtgccacagatcagcttagagcagggctggctgctggccaccccccacattagccttactccaagctgcagtggatgtgaggcccaggctgctgaagactcagaaggaaggctggcagtacctaattcctgcagttaattttcagacttataatgacatgaccatgaggatattttctagggaattaatttaatatttaacgtaatgaagaggtaaaactgtgggaggggcatgcttctctctagaatcttttattgaagaattgcttcattcagtaattttagcacatcatatatctgtaaatctcactggtgccacccatgttttccagatacagggttcatacccttaggggctcagttcccctcctggtttattttgtcacgtaggcccgcaagcccctgctctgccttgtcatagctcagagcatgttcctggagcaaggcagtgaaagtgcatcaaatccactctctgtgtctttgatttttttttttttgagacggagtctcgctctgtcacccaggctggagtgcagtggcgcgatctcagctcactgcaggctccgcctcccgggttcacaccattctcctgcctcagcctccggagtagctgggactacaggcgactgccaccacgcccggctaattttttctatttttagtagagatggggtttcaccgtgttagccaggacggtctcgatctcctgaccttgtgatccaccagcctcggcctcccaaagtgctgggattacaggcgtgagccaccgcgcccggcccgtgtctttgactgttgttcccaaaagtgcttttctttctgaaaccagagcttcagtttaccagactgaaacagtattaacaggctacacagtgacttgtgagtggtcgtggcctgccttagaaaagtgaggacacagccgtgctgctcactattacaaacactggccagtgtggccatttaaattgaagttaactgaaataggccagatgtcgtggcttatgcctgtaatccaagcactttgggagtcccaggcagatggatcacctgaggtcaggagacagcctggccaacatggcaaaaccctacctctactaaaaatacaaaaatttgtcgggcatgggagcacatgcctgtaatcctagctactccggaggctaaggcaggagaatcacttgaacttgggaggcggaggttgcagtgagctgagatcacaccactgcactccagtttgggcaacagaacgagagtctgtctcaaaaaaaaaaaaaaagaagaagaagatggaaattaactgaaataaaaaattcacttgcggccgggcgcagtggctcaagcctgtaatcccagccctttgggaggccaaggcgggcggatcatgaggtcaggagatcgagactcatcctggctaacacggtgaaaccccatctctactaaaaatacaaaaagttatccgggcatggtggcgggcgcctgtagtcccagctacttgggaggctgaggcaggagaatggcgtgaacccgggaggcggagcttgcagtgagccaagattgtgccactgcactccagcctgggcaacagagtgagactccgtctcaaaaaaaaaaaaaaaaaattcacttgctcagttgcactggtcacatttcaggtgctcaatgtctatatggaaatagtgtctaccatattaaatggttcagatttggaatattcccatcacagtagaaagttcttttggggccgggagcggtagctcatgcctgtaatcccaccactttgggtgtccaaggcggggggatcacttgaggccagatgtttgagaacagtctggacagcatgacgaaaccccatctctacaaaaaatacaaaaattagctgggttggtgacctgcgcccttagtcccagccactgcggaggctgagggagcccaggacatggagcttgcagtgagccgagatcatgccgctgtactccagcctgagccttgagtgacagagtgagaccctgtctcaaaaaaaaaaaaaaaaaaaaaaaaattggacagtgctgtcttagagagggggctagttttttgaggtgcatcatcaagatatggttcagggctgggcgcattggcccatgcctgtaatcccagcactttgggagactgaggtaggcagatcgcttgagctccggagttcgagaccagcatgggtaatatgacgaagtcctgtctctaccaaaaatacaaaaaattagcctggcatggtggcacacgcctgtggtctcagctactcaggaggctgaggtgagaggattgcttgagcctgggaggcagagattgccacaagccaagatcacattgctgcactccaacttgggtgacagagtgagacccccctctcagaaacaatttaagatatgattcaggttatagagattaactcttatttattttttataatccttttctataattcaattatgagaaaagaaaatggatattgtccagtgtctctaagacttgaaaccaaggtcagaaaagatgtagtgttccctgggtattaggggccatggtgctcatgtttaaatgtaccgtgtgtccccaccactggtaggggcagaagccatcaagccaggtctgagagatagcctggtgtccctcagaaaggctggtgtgggcatgtccctctctgtgtggacaccgtcttcctgctcccttctttgaaactgcgagcagtgcttaggccactacctcagagaatggggagctagaggtttagagaagaactgatttctttcattttcaaaatgctctgaaatcatattattattattattattattaattattattattattattattttgagacgtagtttcattcttgttgcccaggctggggtgcaatggcgcaatctcggctcactgcaacctctgcctcccaggttcaagcaattctcctgcctcagcctcccaaagtgctgggattacaggcgtgaaccactgcacccggcctaattttttttttttttttaacagagggtttctccatgttggccaggctggtctcgaactcagcttggtcaacatggagaaccctgacctcaggtgattgaactcctgggcttaagtgatcctcccaccttggcctcccaatgttctgggattacacgcatgagccccctcacccagctaccagctctgcctttaattctcaggtgacatcttggggaatcaggtggcactgctactgtcctcaggcttggccacttttgtagcagtgtacccaacttgtggctgcacttgggcctaggccagatggggtccttggccaggcaggcactctctagctcacaacatacaggtcctcccaccaggcacacatgaggctctgccagggcctctcttgttaggtttgcctctattagcttgtgtttttagagccctacactgatgtgttagaaagatgccctctcctttctgtagctgaggttgacacacaagaaagcaggtaggcatttttgtccccaggcttgggcacttccctctgcccagccatcgcatccatgctgcagggcagtgtaaagggacaagtgcaggttcagggttccaagtttgactctcgctttgcagccttcggtgtgtgatcttgggcacattctttagaatgagccttagttccactgttttctgttaagatgcctgagggtggtgagttgccttcacctcttcctcccagatcaggatgttgtaggaccatccttgtctctgagtgttagctgatggccctgcctccctcagaggggcagacgcaagtctgtaaaatgctcctgtcaggaaatggagcattgccggactcagaagccctctgtgcttactccttttcctctggagcaaaggggttgcattgtgacttgtctagttgtaggaggcagagcttacagtcaggcttcagcttcgaggattctgacttcttgggtgatcttgggaaaatccatgaaacatcttaatgctttcatactgtacaacctgaggagcttggcagctgctgaggaaagagatcccttctgtggatctttggcagagctcccacaatgtttccactcctggattcaggtctcctttctctttccagaatacatggaaagcagtgtgtcccagaactcaaatatctgcagaggaaaataaaggtttttttttttttttttttttgagacaaagtttcactctgtcgcccaaggctggagtgcagtggtgtgatctcggcttgctgcaacctcacctctagggttcaagcgattctcctgcctcagcctcccgagtagctgggattacaggcatccaccaccaaggtgagctaattttttctttttaagtagagacagggtttcgccatgttggccaggctggtctcgaactcctgacctcaagcgatccacccacctcggcctcccaaagtgctaggattacaggcgtgagccatcgtgcctagccagaaagtaaactcctaaactgtttctaaaaatctcaactcaggtagtgcaaaagcccagatgttttctgacaaatatatatggatccaccatgaccactttattgctccaggcagaggcttagggaagtcaggtgtgctggcagtcacagtatctcaagaattggagctggtgaaattcatatgacacgctatagttttcagaaggcttttgcctctgggagtcttatgtgatcctcggtaggcgatttcttgtcatgcagatgagaaaacttttaccacaaagattagttttaggctgggtgcagtggctcacgcctgtaatcccagtactttgggaggccgaggcaggaggattgcttgaccccaggagtatgagaccagcttgagtagcattgtgagaccctgtctcttttgaagaaaaaaaagaaaaaaggaaaaaaaaaaagaaaagaaaagatgagatacttctgcacaggcatccggctaatacatatggtgctgggtctgacccagctctgccagccttgtgcttacttctgaaaaatgacttttgttcctgcccagcctgtacttctgtgtgagaatttgacttttagtgagaaaaccccatggtaagcgttgagtgtggggagcgtgtgaccctgtttctcagcgtggggagtgtgtgaccctgtttctcactgttgggagtgtgtgatctgtttctcagcgtggggagtgtgtgatcctgtttctcagcgtggggagtgtgtgatctgtttctcagcgtggggagggtgtgaccctgtttctcagcgtggggagtgtgtgatcctgtttctcagcgtggggagtgtgtgatctgtttctcagcgtggggagtgtgtgaccctgtttctcagcgtggggagggtgtgaccctgtttctcagcgtggggagtgtgtgaccctctttctcagcgtggggagtgtgtgatcctgtttctcagcgtggggagtgtgtgatcctgtttctcagcgtggggagtgtgtgaccctgtttctcagcgtggggagtgtgtgaccctgtttctcagcgtggggagtgtgtgatcctgtttcttgtctggtaagttgcttagtcgtgatggtcaacagttaatgcttaatggtggcacttctgctagacttttgtgcagtttttataaaatagccttgtaacttttcatggtttttaaaaaagtgatatgtttttgtttggtcttgatggtcctgttcccatttcagcgagccatgtcctccaaccgatgagcaattggttgcagggtaagaccgagacctctccaccgtctttctgtcttgattccggctgccttctcttcttgtaattgtgcttaattcctgatttccctccatgttgaagagtgactgatgaggcacacaggcgtggacctcactgccccagttcccccatgaatgcccagacttcccaccaccccggctttttctctacccagtcatttagctatttcacattacctgagaggccaaggcatggctggctggcacccgggagacttctgggaccaggcatgtcacacaaacctcctcttcctccaggtaggcacaagtagtcctgtgagggtggtgggcaagcaggagtggactctgtcatctccctagtccactgccgccctagagagacctgtgactgttgctccttgtttttattttttgaggggttttgtgggggcctctcccaagggttgggcattaagtgtgatgctcaggcctagatgctattgagtgtgcttaatagaggcagaaatgttctcatggaattgatatggtgcttgtccaggagggcacggatgacgggcgactcttccattccccttgacagtgcatctcctctgggccttggaggtacacacagtgtctgtgagcttccagcaaggaggtgggtggggcgagcagagttgagctcccctccaggatgtctttccatccctttaggtgggtggggggagcagaactgagctcccttccaggatgtctttccatccctttttttgtccaagctagagagcaaaccctactccagaatagctcggcagtgatagaaggtcctggcctgttttctggctgggctggttcatcttcctaaatgtgtttttcttgaatttccaagttattccaggaatcttcagtttttgtaacagatgttttattgtgctgcagtacatttattaggcctttcaccatcaaaatgagggaaaaggattttcataaatgttggaagccaataaaacaaaacaacacttgtttatggttcagtttgctgtttataagttttgccccacccccaatctcatgaatataactctgtctttatgtgtattacattaccagacagactatataaagtataaagccagatgggtgcagtggctcatgcctgtcatcccagcactttgggaggccgaggtgggcagatcatgaggtcaggaggtcgagaccagcctggccaacgtggtgaaaccttgtctctactaaaaaatatgaaaaattagccgggcttggtggcacgcgcctgtaatcccagatatttgggaggctgaggcagtagaatcgcttgaacccaagaggcggaggtttcagtgagccgagattgcgccattacactccagcctgggcgacagagcaagactccatctcaagggggaaaagaaaaagccgctcaattgttttgtcatggggccgggcgtggtggctcacgcctgtcatcccagcactttgggaggccgaggcgggcggatcacctgaggtcaggagttcgagaccagcctgaccaacatggtgaaaccccgtctctactaaaaatacaaaaattagctgggcgtggtggcgggtgcctctaatcgcagctactcgggaggctgaggcaggagaattgcttgaactcgggaggcggaggttgcagtgagccgagattacgtcattgcactccagcctgggggacaagagcaagacttcgtctcaaaaagaaaaaaaagcgttttgtcattatatgtttgtaatattaaggtgtggggagtagatttctctgtgggccagatttgctcagataaacaatggctaactaccaccctgctggctgcctcagagggctccatgaacagccactaagtcaatgtgactgtttttttttttgagacggagtttcgctctgtcacccaggctggagtgcagtggcacgatctccgctcactgcaacctctgccgcccaggttcaagcgattctcctgcctcagcctcccgactagctgggactacaggcttcactgcgcccggctaatttttgtatttttagtagagacgggggtttcattatgttggccatgctggtctcgaactcctgacctcgggtgatccacccacttcagcctcccaaagtgctgggatgacaggtgtgagccaccacgcctggcccagtgtgcctttttacttcagctcacagatttccagttggccgtctctgcagaccctggcctctagcagggaaagagccttttatttggctgttgtgagggcgccttgaagtttaggtatttataaacgcgaactgggctaccactgcttgcctctgagaatcccagggaccatctcacagccaaactaaatttggtccctggactggtgcctgagggctgaggctgagacatggctgtgactctttatgacagagcagcagtttttagtggagattttgggctgtcagagcaagggacctttctggagtggtggtggttatttttctgttacctctgtgtcccctgagtcactgggtggcagagtggaggggcactgtttagataggatgtgaggcgttggccctgggtcagttgctagagcagaagtgtttggtggcgttttaatacctcaaaccctccttcaacattaccatgtcccacagatgggagttatagaacagagtgagccatttagggtttttgaagaaagcatattatgcctgtggtgtaaggcacttgaatcctccatctctgcaggagagacctgcagtgggctgctgaggacttggctgtgggtcctgcgtttcccaggataactctaacaagattgatttcagaaggtccaactgcaacctgactgggttgagaggctatttccaaatggcacaaataggtttgaccaaaccctcgtatgtggtttgtttgtgagcctagggtgacttcggatggttagagggtcgtgccagttcaggaggaaggctggaaaacagtctgagccccacagcccatgatagacttggaaagaatcatgtagctacttgccatttgctattacagagctgagctacagtgcagttcaaagcaggccttcctttttcatcacaacatggaggagttatgtcagtctctcccatcccttcaccaagagggcctctggggaagaagcatgaccaggtttgcaccctagaatgtctgtcctcagtggtctcttctaggaccttaggggtctccctgcccaggggcagagtatggccctgcggaggctagagcttccccaagagagtgcaccctcctgacctagatattagatatatttttcctgggtggagagatatgtatgggacttctctctcttctgggtccagatcagaggtagtacatttgtgtttctagagcggaggccctcagagccctggactctgagataagagtcagcaccacccacagcacccctgcaggtgacactcccttatccagatctccccaggcaggaggcatcagcattgccagtaaggagacagaagggcacagatgaccttgaaaaggggaaaagggatgccctccctcccacaccacagctgcacccacttctccgtggcacccagttgtgtgcaacctggtatttctgccatttggaaatagctgtgatcacagtgggcttgcacatcttgcacaaagcttcttccctgataaaaaccggaaagtttaagtgtttgggataagggaacggatgggcagccatgctatgaggaaggaagtcagcgctctgcacgcatccctgtgcactgtccccttgccctccacgcggctctttgggtgaagggccgctctgtgggtgaagggcctgggtcctgggagttgaaggtgcagcacagcaaacctgagtgtaactgggagaggcccctctgcctgtgaactttaaagagcagctccgcagggcagtgccggctccagctgatcctccctttgaaagcaaactgcaactgtttctctcctgaatttaatagagcatgccaaaaaatgacagcatgtgccttcagtctgtgcttctcatgccttttaccttgtaattctggtgatcttacatccataacctctgggattgctacagaagggcaactgttagtagcttccaccagcagtcggggcagagcaactccatgaaggtgcagtttactgagacccttccgctctggggccagcagggcatggtgctgtggtattttgttaacttatttttattctacctctcttaaattttaaggttttcagatgttattctggcaacaattttggcaaccaagtctgaaatgtgtggccaaaaatttgaactgaagattgataatgtgcgatttgttgggcacccaacactgctacagcatgctctggggcaggtatggctctccctgggcaggtggggctctccctgggcagatgtggctctccttgggcaggtgtggctctccttgggcaggtgtggctctccttgggcaggtgtggcttcccctgggcaggtgtggctctccttgggcaggtggggctccccctgggtagatttggcttcccctgggcagatgtggcttcccctgggcaggtacagaccctctgggaaggtgtggctccccctgggcaggtgtggcttcccctgggcagatgcgtctgtccttgggcaggtggggttctccctgggcatgcacagaccctctgggcagatgtggctctccctgggccggcaggcctggtccattctggctctggggggctcagaactgaggctgacaccagctctggtgaaggtactgggcaggagacctgattagacacttggtatgaactgtgcatcttcataaacccagagagtccagtagaaaaagagacaggtgttcttgcccctgaagacaggtgcttcagtccctgtccctagcttttacagtctgcattctaggtctctactgactgtggccctccccttcatatgtaggatgtctgtttccaggggaggccaagatagtgagttaactagcatcgtgaaacccttgaattttctacagtgtggtgcaagcatttcctcttatttattacaagacactctagtagctaatattagtattatttagcacttatttttctgctaaaccctctctatatgttctcttgatgaataggtgtcatagcactgaggaactcatcttgttagcaggatgaagggaacttgtacaccagagcctgccagtcagctctctgcatacaggcaggatcagtgatggcattactaagattctgaagggtcgaacacagtaacgtaggatttagctacatttatacagatccagcaattctgggaggttctgtggtgttattcgtgaacctccatggaaggagtttctgaggcggttgatgagcctggtcccctgtaccgcaccctcccttctcatcacagcctccacagctggggcacagtcccctacctgtaggcaatgaaggggagagttggcagcctgcccgcggtcacaccctgtagacaggagtggcagtcaggggtaggggatgggtgccagggcagcctggggccccaactccccctggtggcagaacttgtagttggctttgaagagttcccccgtgccccttggaatgcttcccttgagcgccctggtccttgtgaagctggctggatgccagaaccgggagcacagaaattaggacttgctggcctgcctcacctgggccctgctcagggcttggctgtccctgaacatcgtcctgtccctcaattgttctgagtatgcgtcatacttagcagatacagcctggtggatgcaggcgggcacgggaaggcagtgggggtgtgggtctgggtcctccacccatttatgcccctctccatctcgtcccctgtgggcattgtcagctcacttctgttagcgggggggcgagggggtcagagcactgaccttcccactcttgtcatagttgtgactttgcccatgcagtaggcacgcctccagagcaaaggcattcattgcttttccaagaccttggtgctgtattctggggacttttgccatgcctgaagtagaatagctctaaacagctttccttagaaagtcgtctcaattaattagaattatgcatcttttacagatctccaaaacagatccttccccgaagagggaagcacctactatgattctttttaatgtggtgtttgcactgagggtgagtgtttatataaatggttaagatcagggagtggggccagtggagaagcagctctttttttccaacgagcgtgtcattgactcggagcttggactgcagcgggctggcccctcctggggtgcaggcagactgcacttcattgtttacccctttttgttttggtaaaatacacataacactatttgtcattttgaagtctatgcttcagtggcatctggtacattcatgttgtataaccatcaccactatctagatccagaacactttcaccaccccagaaggaaaccccatacccattagcagttattctctttttttttttgagacagaatctcgctgtgtcacccaggctggagtgtagtagcgcaatcttggctcaatgcaacccctgcctcccaagctcaagtgagtctcctgcctcagcctcccgagtagctgggattacaggtgtgcgccaccacgcccagctaatttttgtatttttagtagagatcggtgggggggggggggtctcgccatgttggccatgctggtcttgaactcgtgaccttaggtgatccacccaccttggcctcccagactgctgggattacaggcgtgagccactgtgccctgcccctgctaatttttgtattttttgtagagatgagttttcaccttattgccctggctgatcttgaactcctggtctcaaatggtcttccctccttggccacccaaagtgctgggattccaggtgtgagccactatgcccagctggagcttaatttttaagacaggcctgccttgttgataaataaggaactacaaattaaaacaaaatgatttgttaatggctcctggggtacagggttctgggagaagttcttcactttctgcttgatacacttttgtagtatttgcattttcatagcatctttgtatttcttacataattacataatataaagcgccacaaagaaaaatgaattaagtaaaaaaacaagcaaaggagtaaacaaaatccatgacgaatgttgtccacctgtcaacaccgataacccctgtgggacagttgatgaaacgcagccacagccccacccaggatgctgtaggcaggccctcacctcggggaacagtgtttgcaggatgctgtaagcaggccctcacctcggggaatagtgtttccaggatgctgtaggcaggccctcacctcggggagtagtgtttgacagcatagcatatgatgcccttagatctagcagtcccactgttaggagtattatcaagaaaaacaagcaacttttacaactgcgtaaagatttcccccaggcttgttctcagcaagaataaagatttttataacaataattaaactggagataatcatagtgtgtagtagttggggagtgattaaacaatgtggtgattattatacactggcccatcctcttgccatcaagggtgagaaatggagatcagaccagaacctggagaagtatagattgattacggacaggtaaaagcaaccggagccgagcacaatggcttacgcctgtaatcccagcactttgggaggctgaagcgggcggatcacctgagatcaggagtttgagagcaggctgaccagcatggagataccccgtctctactaaaaaatacaaaattagccaggtgtggtggtggacacctgtaattccagctactcaggaggctgaggcagtagaatcggttgaatccgggaggcggaggttgcagtgagcagagatcgcaccattgcactccaatctgggcaacaagagcgaaactccagctcaaaaaaaaaaaaagcaacaggaaacaagatagtctaggacttcagctggccgtgatattgacgagtaggagaaattttgataatgtaaagagtttgtattttttgggtggacaagtctttctttttaaaatatatacttttgtcattttaaatatatattctttctttttaaaatatacacttttgtcattttaaatatatattctttctttttaaaatatacacttttgtccaggcacagtggctcactcctgtattcctagcacttcgggaggccaaggtgggtggatcacttgagcccaggagtttgacaccagcctgggcaacatagcgaaaccccatctctacaaaaaatacaaaaattagccaggcatgatgatgtgcgcctgtagtcccagctacctgggaggctgaggtgggaggatcacctgagcctggaaggtcaaggtggcagtgagcagtgatcatctgctgcactccagcttgggcaagagagtgagaccctatcttaaaaaaaaaaagaaatacacttttttttttttactctgaaaaattttaaaccctgaactagagagagcagactgacaaaccttatatgcctgtctcaggtgcctttaaaccctggctccatatatttccttccctctctctatttcaaggcaagtcccagaccttatgtctgttcatccctacatacttcagaagatatctgtataaaatatgggcacttaattttcggccatgataccctttgtacatctgaaaaaatttgctgtaataagttggcatcacctagtacctggtccattgaagcttctcctgattgctaaagccttttcacagctggactgtctgaaccaggatgcaaacccagcccagctagtgcatgtggtgtctttatgtctctgccaatccagaggtctcccctccctttgttccatcaaatgttccacatttggattaatctcattgtgcagtcagacttgctctctgtccctgtgtttccttcaaactacaagttaactctgaaggcttggttctatttgggtacaagttttggggatgagaaagtctcatgcgtgatgccttaaacttcctgccactttatgtcgtgtatggtgaaaatatggtgtttctaaaagttcccattagtgctggcacaccctaggtgttagctttctcagcatgtccctcactccatgtcaggcctttgcaaaccggacatgctgggacaccccatgagtgcaggtcactgagcgtcactggggactgcaccactttgtatgtctggaaaggtcaagcatatgggccctggacatccaactcatggacactgttgtgcctcagctgaataatcacatatccaggatcattgtcctcctccttgctttgctcgtggaagtatttgtacacagattcttcttctaggtgggtattttgttttgaggcaattgtatacaccccatatgtcagccctctggtcccaaggacactgttgaggcaatgcccttgacatggaggagcaggtctgctgcccagtggtgggcacagcatgggagcaacagtcctttctctggcaagggatgctgccttgttgtaagtccatccaggtgtgagttctgtttgtgaacatgggatctgatgagaatatagagaatttcttcagctccagatgaagaacgtatttactgtctgggtcaggctttgcccctgaagcctggctgtgaacactttgggcatggccttccctctcagataaacaggagggggaggcagcaccagaggttgtaatcagcagtaccattcacccctttcccttgtcccacctccacccccacaggatgactcagcagtcctgttggcctccagaagcactgagtcatggttggcccagttatctgctccctcaagtgttttcacagacccccacagctgcatgcctccacccttggcttgggcagatgtgcttgcctggctgactgtggtccctgataggttccagagggtcgagggcccctcttgttcctgagagcctcctgcactgtcctttgacccagtcatcatggttgcagaaggagctcttgggcagagatatgggcctggagcctgctggttttcttgttaaccagtgtgacttctgctgggaagagcttctcatccttcaggaccaaaagtattcagtgaacaattggcctggtgcctctctttttgtaccgtgcatccctgtagtaacgtggcctgtcgtgactgaattcttacaaattgtagactggttctgcctaccagtagtcagcagtacagtggtgaccacagacactagcagggtctttgctcagggcaggttctgttcttagtttgttacatggctcgctaatttcttccattcagtccttggtgagggaggcaccattgttgttcttccttaagaacaacagtgcctccttagggcacccaggcatttccagagccatctctgttactattcaggcagccactcccaagaatagagcatgggggctgacagcccacatgtctatggatgggccctggaggggactcaggaaatgagcagcagtggcctctgcaaaggagcctgggggaaaggagtagagacgctttctttcatggtttgagtttttgctgtgtacctgtgttagctccatttaaactgtgtccagctgtgtccctgtgcacacgtttgagtctgtgtatggtctctctcctgcaggccaacgcagacccgtcagtgataaactgtctgcataacctgtcccgtcgtatcgccaccgtgctgcagcacgaggagcgccgctgccagtacctcacccgggaggccaagctgatcctggcgctccaggatgaggtgtccgccatggctgatggtgagtgcagcagggcgtgatgggcatgggtctgggctggctggtggcctctctgcagcgcagacctctgtggaggggctgtcattcagtgttaatgatacagatgttggcggggcctcacccaccccaacaccagcagagcagtcaggagcttgcaagcatcggcttttggtgagctgtgcattgaaaatgaagtcctcacaacagcttcgctaggcagtgtccatgatcatccccattttgcagatgtggaaactaaggctcagagaagttacatgatcttcacacggggctgattgtgcctggggggcacaggaagactcccaaggggcacatttgtagatgaattttcctggctggatgtgttgaaatagatttcccgaccagaaatgttctttcttcccacacactgctgcatgatcaccgttcacataggtgaggcagctctgcctagccctggtcctgttggagatgttgaagaaactattactccctggggcaggagagggcgttggaaatatccagctggtgaggtggacagtttccagttctttgctttcagccagattgaaggaggacctaattgggttatcaactaaccaattattaaaaataatttttgcagacagaacattgagtgttttttggcctactgtaaagatttcaaaacataaagagacacttgtaacaaactctccatctccattttctttggccagcacctctataacaaaagagagaattaggaacaaaactaaagtcagacctagttgttgtagcaataagtaaaattagttattgacatgaatgaacaataataaagaacagcctctctgactcaggtgcattttcagtacaaatttacctgtggctggctgcggtggctcatgcctgtaatcccagcacttagggaggctgaggcaggtagattgcttgagctcgggaattcaggatcagtgtgggcaacatggtgaaatcctgcctctaccgaaaaaaacccaaaaattagccgggcatggtcatatgtgcccgtagttccagctactcgggatgctgaggtgggagaatcacctgagccttgggaggtggaggttggggtgagctgagattgcaccactgcactccagcaagggtgacagagtgagaccctgtctcaaaaaaaaaataaataaataaaaataaaataaattttgacaggtaattgtcaaatatataaagtttttcttttgttttttcctctgtcacccaggctggagtgcagtggtgtgatctctgctcactgcaagctccatctcctgggttcacgccattcttctgcctcagcctcccgagtagctgggactacaggcgcccgccaccacgcccggctaattttttgtatttttagtagggacggggttttcaccgtgttagccaggatggtcttgatctcctgaccttgtgatccgcctgcctcggcctcccaaagtgctgggattacaggtgtgagccaccgcgcccggttacctgtcaaaatttataatatgtttctgttttggccaattatatactaattataattgtgataataacaatccaaaagttttgtttttttaaacgttatctttttagagtctgtgactttatcacaggaagtaaaaagaaattttattttaagtctatgtatatatttttagaaatttatgaaaaaggatgaataaaagactttttggctggatgtggtagctcacacctgtaatcccagacaaaaaattttaaaattagcaggtctaggccaggcgtggtggctcatgcttataatcccagcagtttgggaggccaaggtggatggatcacttgaggacaggagttcgagaccagcctggccaacatggtgaatacctgtctctaccaaaaatacaaaaaaattagccagacatggtggcgggcgcctgtaatcccagctacttgggaggctgaggcaggagaatcgcttgaacccgggagctgtaaatcttgtgttgtgattcttgtaggaaatgaaggtcctcagtccccattccatcacatcctgcccaagtgcaagctggccagggacctcaaggaagcttatgacaggtaagacaggtgggtgtgcttattaacctccttcttatgggccagcctgcctgggcctgaggagcagcgtcaacaggtagggctccccggtactgaccactgttctcctggggtgtgagcatcagggttccctgaggttagggccggagaggactgggaagggatggtcatgtggctgctcttgaaagaagtgaccttggtggccgtttttttttgtttattttttatttctatttctatttatttcttttttttgagatggagttttgcttttgttgcccaggctagagtgcagcggcacgatctcggctcacagcaacctctgcctcctgggtttaagagattctcctgcctcagcctcccgagtagctgggattacaggcatgcgccaccacacccggctagttgtgtatttttagtagagacggggtttctgcatgttggtcagggtggtctcccgacttcaggtgatccacccgcctcggcctcccaaagtgttgggattactggcgtgagccaccgcgcccggccagtggctgttttttaaatggtttgctgagtagggtgcactctgctggaacttacatcacaaaagacaaatcactctcctatgtttaaggacttatatttcccaatagaagaatgaacaagggatctgagcagtgagctcacagaaaagacaggtggttcaaacatgtgaagagatgcatcagtgcatcacaataaagctacacagagatcccattccccacctgttatactggttaagatccacaatttcacgagactcgatgttggcaaagctcgggggaagaggcatctcgtgtgttgctggtgggacagaggtacaaacccctgagtacctttgcttttttaaacccctttgctgagtagcatgcactctgctggaaccaccacctccagactcctcttaaaacagaaaacgagcccgaagttatacatgagagtccgaaagtgtttttaaatcaaacagatgcaaaatgccattttactgagcatgacgcaacaccaagtgctgggccaccttcactaggtgggtgtcactgactccagtcactcaagaggaaattgaggctcagtgggtgaggctggggccagctgtctcctctcactctgagagagttggggtttgcgacactgactgtgtgagggcagcaagccttgaggataccatgaaaacctcacagttgttctgattgtattggctgagcatcacctttattaaatgtggacaagcaggccgggcgtggtgactcacgcctgtaatcccagcactttgggaggctgaggggcggatttcttgaggtcagaagtgcaagatcagcctgaacaacaatgtgagatcgcatttctacaaaaaatttttaaaaaatatctgagtgtggtggcacaagtgtagtctcagctactcaggaggctgaggtgggagggtcacttaagcctaggaaatcaagattatggtgagccatggttgtaccattgtactctggccccagcaacagagccagaccgcgtatcaaaaatgaaaaaaaaaaggccgggcgcggtggctcacacctgtgatcccaacactttgccaggctgaggcgggtggagcacgaggtcaggagttcgagaccagcctggctaacatggtgaaacccgctgtctactaaaaatacaaaaaattagccgggcgtggtggtgcatgcctgtagtcccagctactcaggaggctgaggcagaagaatcacttaaatctaggaggcagaggttgcagtgagctgagatggcgccactgcactccagcctgggtgacagaactagatgtcatctcaaaaataataataataataaaaattaaaaaacaaaagtaaaataaaaaataaataaaatttaaaaaatactttttaattctttttttggctgcctagtgagccgcaactgcccccaccattgagtttgttccagccttccagtgctaaccatttacctgtgttattttgtatgtgcgcctctgtatctataagataaattcctaaaggcattactaatagggaaaatggcatttgtaatgttgtgtttccttctcgggggtttgtacctctgtcccaccagcaacacacgagatgcctcttcccccgagctttgccaacatcgagtctcgtgaaattgtggatcttaaccagtataacaagtggggaatgggatctctgtgtagctttattgtgatgcactgatgcatctcttcacatgtttgaaccacctgtcttttctgtgagctcgctgctcagatcccttgttcattcttctatcgggagatataagtccttaaacatgggagagtgatttgtcttttgtgatataagttgcaactagcatttgtttgtctcttggtgaccctggggactgagcctccccaggtgtgagagaacatcagcccttgccaggtgattgctttgttttctggccccttctgtgttgcagaatgggacctttgtggtcatgtagtctgaccctgtctttgattcattgttatcacactaatgttttctctgtgttgagagaattactaccctctggctttgaattgcctggtatccagtctcttccttggacattgttcccttattctgagtgtatgcctcaactcggattagattacaaacaaaaatcaggctaacttggaattaaaataaaaaccaagctggtgcggtggtgtgctcctgtagtcccatctcacaggcgaggccaaggttgggggatcacttgagcccaggagttcgagcttgtagtgctctatgctggtgtctgagtagccactgtactccagccccagcaacatggtgagaccctgtctcttaaaaatttgtttaaataaaaaccaaaccattgactttatatttctttttcttcttctttttttttttttttttgagatggaatatccttctgttgcccaggctggagtgcattcttctgcctcagcctcccgagtagctgggactacaggtgcacatcaccatgcctggctaatttttgtatttttagtagagatggggtttcaccatattggccaggctggtctcgaactcctgaccttgtagatccgcccggctcggcctcccaaaatgctgggatgacaggcgtgagccaccgtgcccggctcgttgactttatatttctaaaggaagaatggactatgatttcttaggtttgaatcgtgctggaaagttgaaaggagacaaaaccttggactgcctgttgtgtgatctgcaggctgcggaggagctcagaacttgaggcaacccagcgccacctagtggatattaaaggaggacaggaatctgagttttgctgaaaaaggctcctaagctgttgttcagcacgtagcattctttcctgacctacgcattctgtttgttagtgcccaggatcacatttcctccatccaaactcccaccctaacagtcttgggtcctggagcttgccccagggatgctggcagctatgtttctctggcaggagtccaggcagtagtaccctccctgtacccatccttgtctggcactggcatggctctgcagccacccaggagcccctctgggctgtggcctctcgtctgtcctcatcccatcaggtccatggttggcctcaagggtctggtctgctgctgctcactcttctgcactgagaggaggagactgagtttccattactgatcaggtgacctaggacagagcgcctttctcctgatggtgactgactgccagatctgggggaatctcagaacagaactgaaagaccagaagctgtgagattaatgaggttggagattggggtgggatttttcaaaggaattgttcctggttctttttttttttttttttttttttttttttaatttaaggcagggtctcactctattgccaggctggagcgcaatcttggctcactgcaacatctgtctcccaggctcaggtgatccttccatctcggcctcccgagtagctgggactataggcacccgcccccacgcctgaatagtttttgtatttttttgtggaaatgggattttgccatgttaccctggctgatcttgaattcctggactcaagcaatctacccaccttagcctcccaaagtgctgggattataggcgtgagccaccatgccctgcccccagttgctattttatttatttatttatttatttgtttgtttgagacggagtcttgcttcgtcacccaggctggagtgcaatggcacaatctcagttcactgcaacctccgtctcccgggcttaagtgattctcctgcctcagcctcctgagcagctgggattacggcgcctgccaccaggcctggctaatttttgtatttttagtagagatggagtttcaccatgttggccagcctggtcttgaactcctgacctcgtgatctgccaacctcgacctcccaaagtgctaggactacaggcgtgagccaccacgtccggtccccagttgctattttaattaaagctagggttatggtgtggctgaatagcctggtggccctgtcctgcaggacctaacatctgtgaatataggctgggaatgtgaatcgctcaggaggccaccccaacacttgtgccagacctagcacttgtgtctccctgtggatcccagtggccctcagtgacagcatgtcactcattcatatgaccattgaattgtgtctcccaggagggcagggatgtctcttcactttctgcaacacagcccctacactcagcctgtggaggagcacagctcatccgctaggggtcgacggaatgtgtgggtgggaataacagcagtgtagattccatggagtgtgaagaagtgatttgctgaatggttctccgagttaacaggacctgtggtggggagtgatgtccagggtctggctgggtaggtggtacttggtgcggagccttgcactgcaaactgtcgagagcagggttggtcccatggaccctctgtgaatatcctgagagttgtagtacccatttccataaaaatgcacctatatataaactttcgtttgaaatttcaaggtaggctgtttggaacccacatagatcttttgggttatgcagcatcccactacttatggtaggaagccaggcccatccgtgggaccagaggatgcagaggtttgcaggatagcttcacaggtcctgtccagttctaaggttaggaatggatgctttctcagatgctaaaagctgaggggactagactaagcttgtgcacatttctgtcttggagatgaacggcgagagtgtgtttgaagccagccattcccttttgcatagtcattgtcaggatgcagggctttggctggggcacctatctcctgtcacagactgggctgggccctcttggctggcccagagctgtgtgaggggctggataagtcttgaggaggacagtgttttcctccagagtgttttcagaccaaaccattaaacaccttgcaaatagaagtgcaagctcggcaggaaacctttcagggcccaaaccctgcttgtgctaagggctcttgtcttaaagctgcagacttaaaaacagtgacaaacctttctctttccccttgttaacagacctcagtgcagctcctggcttaccctcttactgtgggggatttacaggctggaggttgggccggcacctttccagagcagtcatccctctgacatgttcagggaatttgcccaggtctgccatggcctttggggcactcctggtggcagcacttgtcaccgctctagggagctgggttagttcataaagaagcaccagcctcagtgcagagtgctctgagggagaaagcagcaggtgggtgagctgatgcttgggaaaatggagtaaagtccacgtggaagttagaggaaccaacatggcgtgtctctgccagaggagagggccccatgccagtgtacaaaccagaccacatgactgcggctccaaggacagctgacacggtgagggcagcagagatgaccaagctgggaagtcactagaagaaccttcatgtgaccctcctgccctcatttctccatacccatagctggaacttgttcctggctttccatgaggtgtgttccaagcccctgttcctttccctataactctctccagtttctaatgctccatacaatttgattacaattaggtgtctttttttttaaacgttaatttcaattttttttgagacagggtcttgctctgtcacccaggctggagtgcaatggcgcgatctcggctcactgcaacctccgcctcctgggttcaagtgattctcctgcctcagcctaccaagtagctgggattacaggcacctgccaccacacctggctaatttttttttttttttttgagatggagtttcacttttgttgcccaggctggagtgcaatggcacgatctcagctcagtgcaacctccgcctccgcctctacctcccaggttcaagtgattttcctgcctcagccttccaagtagctgggattacaggcatgcaccaccacgcccagctaattttgtacttttaatagagacggggtttctccctgttggtcagtctggtctcaaacttctgacctcaggtgatctgcccatctcagcctcccaaagtgctgggattacaggtgtgagccacggcacccggcctaatatttgtatttttagtagagacagggtttcaccatgttggccaggctggtctcgaactcctgacctcaagtgatcggcctgcctcggcctcccaggttttgggattacaggcgtgagccgccacgcccggccaattatgtgtctgtctagatgccgctgagtgaagcccccagcgtgcagagcagccaagttattttcttccctgctgcactccaagtacctaaactggtgctgggagccacagcacatgtcataaggcctcactgtgctcctagatggagcaaagacagctacatttgaaacaataggagcctccgtattctgattctgtggtgtcccaacagccactttgagctgcatcctaaataggacagaaacagaaaggccttgggtgggtgcggtggctcacgcctgtaatcctagcactttgaaaagccaaggtgggaggatcgcttgagcccaggagtttgagaccagcctaggcaacatagaccctgtctctacaaaaaaaaaaaaaaaaaaaaaaaaaaaaatcacccaggcgtgatgttgcacgtctgtagtcccagttacttgggaggttgtcttgagcccgggagatcaaggctgcagtgagcggagatggcgccactgcactccagcctgagcaacagtgagaccttgtctcagaaaaaagaaaaaaaaaatagaccttttatttccagtggccctcctttctgacccagatggtgacagcacagtgcatggggccacctctcgcttgccctttcttccctgtcgcatacggatgccaagatcctaactattgcttactcaagttgagtaacctggatcccctggacaaatctctcctggtgtgatctttaattccttagcggctgggacatttctcagggtttgatacgagtttttcaccctgcaaagaccctgaccaaagagaggtaaggttctgggagcctctgtctgccccgacatacttggttagcatgcagttctggaagaagctgagactgctgccctcctctgggaccttggggccatggtgttctctgagcaccccgtattgacgtgtcctaagagacgtccgaggggccgtttgtaccttctggcctggggcagccagaagtctggccaagtctcccggacttagccggatgtgggtgtgttggcctgtcccgccaactgggagctgagaatagcagaatagggtcagggggtgatgggaaaagcactagttggctgctctcctgggcagtggggcagtgaacagaggaaacatgatgcggggaggtgctgtagaaatgggcagtttggagaagaacttgtgtgtgttttgctcctattttagaactggtgtcattgtgaggcttcacaggctgcgttccctgtgcaggacacaaggaaggtgccggccactttgagtagccaggccttgacaagagtaggtggagatcccccctgttgcctggagcctccggggatgcggtgaaggccagctgcagacagctttgcttgagcagttgcatctcctctgtgtcatagaacaagtgctgttggctcttacttaaggcaagggcgctttgtggtgagcggtggagttgggtggcgccctggcttctccatcagggagttttagaagctcctggtgaaaacaactccttccttgttttgtgtggttccccgaggggatgacgtgggctgcatccccactgtggagcctgttcttggggcagggcttcctaggaaagacagtgcatgcagggagggcggtgtgttccttggcttcattcaggaaatgcagctccgtgcctatgtgcctgacacgttttacaatgtgtagagagcagagaatgaaacccacaagcccccctcctcaggagtgagttctggttggggagacagcattaggcagcgggtcaggggttggagtgtcaatggggctggggtcaggggtgcttcactgagaatgtgacacttgagtggagaccgatggagtaaaggagccttggggcgtctgcagagagtttgtgggcaagggcaaatgccagggccctgagcacagcgggacctgagtgactgggcacagggagtgaggccacaggaacgtgggtgttgcaggcccatggctgggactgcccaggtgggagtgtggggagcggtagtcagaggggccagtgctctgggtggcttgggcctggtgatgctgaaaaggcctggattttggacatccctgcaggtggagcagatgggatttgctgatggtttaaagtggactgtgaaagaaataaggaaactgggatggtgttgctatgtttggcctgagcaagctttgggacccgaaagaaccaagttacccttactgatagaatgtggagtgaaaggttttccgtcgtagtgaagtgttggggctggctagcacggctggcttgtggtgaccacttggtatccacatgcactgcaactgaggtgctgtgggcatctgcagactgcagggaggtgggcactgtgtgcttctcaccactggaacactctgggggacttggcattccttccctgccctcctcgccctctgagacagccactgttctgcctggacgtgcacctgtgacgggtcttcatgaggtgtgcagggcaggcccattcacagggaggatgtactctgggtgttgggtgtctgccaggggtctggacgggcaggggcctgagttagagtgcctctagtgcactgagtccccaggacagggtacggcttctctcaagccctggcagtctggttggactacagattccagggctagccagaaatatgtttctctttttctttcttcttcttcttcctttttttttttttttttttttttttttttgagacagagtcttgccttgttgcccaggctggagtgcagtggcgtgatgttagctcactgcaacctccacctcctgggttcaagtgattctcctgcctcagcctcccgagtagctgggactacaggcgcacgccaccacacctggctaatttttgtatttttagtagagacggggtttcaccatgttggccaggctggtcttgaactgctgacctcgtgatccacccaccttggcctcccaaagtgctgggattacaggcatgagccaccatgcccggcccccatattttcttttcttaaacataatgtgatcttaagagatgctctcctgcccgggtctccacctgcagtttcccctaagcagcaggggaatcagcaccattgagcagggtgttttctgatctgtgtgcatggttagaaagtttatgtgaacgggtaacagcgcccactctctgcagcctgtgcacgtcgggcgtagttcggcttcacatcaacagctggctggaggtgagcttctgcctgccccacaagatccactatgcggcctccagtctgatccccccagaggccatcgaacggagcctgaaagccatccggtaagtgcccagccccacgtgctcactccctgccagggcccttccctttagcttctgcctgagattttaccacttactttgttccaaaatttctctttttcttcttcccactgcggaagcttgcaggtggggctctgccgtttatagaagttaaaacacataattttgtatccagttgtgtccagaaatgaccaatcccaggtttctcctgggcccttctggcaccaccttaggcttgggcagggcagcctggatgtggggctgagtgtccttggggaggccggagggctggagggacttcatcttaatggtgttgccctaccccagtcttttgcatttcagtcagcactcatgggatctcagttattttctttttcttttttttttctttttcttttttttttttttttttgcgggggtgtgtgtgtgtgtgagagagagacagagttttgatcttatcgcccaggctggatttcagtagtgcgatcccggctcaccactacgtccacctcccaagttcaagtgattctcctgcctcaggctcccgagtagttgggattacaggcgcccactgccatgcctggctaatttttttggtacttttagtagagacagggtttcaccatgttggccagactggtctcgaactcctgacctcaggtgatccactcatcgctcatctcagcctcccaaaatatactttcttaatttaattgacttttttttttttttttgagatgtagtcttgctcggggctcaagtgcagtggcacagtctccactcagtgaagcctctgtctcccgggttcaagcgattctcctgcctcagccccctgagtagctgggattatgggtgcacaccactacacctggctaatttttgtatttttagtagagatggggtttcaccatgttggccaggctcgtcttgaactcctgacctcgtgatccacccgcctcggcctgccaaagtgctgggttacaggtgttagccaccatgccctggcaatttaattgattttctgcaaggaaagaactgagcccagtcttctggcaccacctgttcccaagtcccccaataccttgaacattttttaattataaaaatatatctgggcacattgctgaaaatttggaaatgacagaaagcaaagcgctgcctagttccaccctccccagtccgtgctctttgctttcaatcctagctaagcatattttaatgtactttggtccctagtctgtgaggaggattttgcttttcccatatttgggacaatttccttaggaaagattcattcatgtcttcaatcaacagatgtttgctgggcgtctctgaggtgggatacagagtccagtcttcgagccttccccacttttgtcgtgtttttttccgagggtgacataatccttgcaggttttgtttttgttgtttttgagacagagtctcactctgtcgccaggctggagtgcaatggcgcaatctcggctcactgcaagctccgcctcccaggctcaagtgattctcctgcctcagcctgccgagtagctgggaccccaggtgggtgcaaccacacccggataatttttttatttttagtagagatggggtttcaccatgttggccaggctggcctcgaactcctgacctcacgtgacctgcctgccttggcctcccagagtgccgggattataggcatgagccagtccttggcagattttgtgaaggcctccaaacagaccactgcccttttctcaaatcccgctcttggcccttctctccgcagttaagggccaggaggctccagctgcctgtttgtgtcccaggtgcatacctgatgcacacccggtgcaggacctcgtgcaggacctggtgcatacctggtgcagggttccctgcacttcgtatgttccgtgtgtttgagtcccaggtgcatacctggtgcatacccggtgcatacctggtgcaggacctggtgcatacccggtgcatacctggtgcaggacctggtgcatacctggtgcagggttcctgcacttcgtgtgttccgtgacaggtgattgttttgcagcccctaccatgccctgctgctgctcagtgatgagaagtccttgctgggtgagcttcctattgactgctcccctgccctagtgcgggtgatcaagaccacatctgctgtgaagaacctgcagcagctagcccaagatgcggacctggccttgctgcaggtatagctctggaggcccagatgggtggcatgtggcggtgctggggcatcaggaaaggcaggccgcctgccacagtacatccacaggggctgtgtccagctgagagccgcggcacagcccaccatggggtggggccagtccctgggatggctggaggttttggcatctgagtcagacctgggttcagggctggctttgtgagtgagccacgggactgacttgttcttctgtctcagagaggtaaggcgagtctgtgagagaaaggactggggtgcttgcagtcctggaggttgaggcaccagagctagggggtgggcagggcagcagcgggcagggccatgggggtctcacagtggtgcatgaacaacatacgggaactaagggcaggaagcttggatgcggggccctcccatgtgcagaacagagacctaacctggtggccttacgcccctgtgtgtgcacatgtgttggcctgtgcactctgtacaagatgccacgtccttgctgagccacatgcttatgggcctgtccatgcagagggctgccctttctgattagatggagggcccctcagcctcgtctgcggatctggttggagtgtgggaggaaaagcgcaggcaaggctgggcacggtggctcatgcctgtcatcctagcccaggactttgagaccagcctgagcaacatggcaaaaccccgtctctacaaaaaatacaaaaaaaaaaaaaaaaaaaaatagctgggtgtggtggcgtgcacctgtagtcccagctacttgggggtatgaggtgtgaggatcaattgagcctgggaggcagaggttgcagttagctgagattgtgccactgtactccagcctgggcgactctgtttccaaaaaaaaaaaaagcacggggagaaatcagaagcaggggctgctgatggggtggccaacaggccatgggatcagctgtggctgctagtcatgtgggcgtggcccagagccacgggaccattgaaatactgcctgagggtgggagcaggtggtgcctgtgggtggcgccctcgtctggtggcggtgtgcacagcatggccaccagggggcagcagaggctgccgaggaacacaggcgtgaggtgggcccgcctgggtccctctggctgagcttccatgctcttttggcctgtgaaacaggtctctgcttcttagcacgttaggggaacttgtccaacaaggcctgactctcaggccacttttccccgaaagcagcctttttggattctgtctttgagagtaagtctcccgcctctgtatctcaggaccctttatctatcctctgtgagagcacttaccaaattgtgcccttgtatttcttttttcttttctgagacaggttcttgctctgtctcccaggctggcatgtggtggtgccatcatgatccacccaggctcaagcatcctcccaagtagctgggactacaggtgtgcgcctggctaatattttttttttttttttttttttggtagagacggggtttccctatgttgccctggctggcctcatactcctgggctcaagtgatcatcgcaccttggcctcctaaagggctggtattacaggcatgagccaccatgcccagctgtgcctttggacttcatgggctggacaggactcagtaaagaccatgtcctgcccaccttcatagcattcaggagacagagaattttaaaagaactcaccactccatacaaccctgcagagtgagggaggcagtgaccctccgtgtcctgatgagcaccgaccacatggtaaatgcctgtggctgttcactggtcctgtgttgagcttttgaaaggagctgggcctggctttcctgaggctgtctggcaggagtttgtgctggacactgtgcctctcatccttgctgtcagagtctccttggacaaagctttgatgccctcttctgaggttgtctggcaggagtttgtgtggacagtgtgcctctcacccttgctctcagagtctccttggacaaagctttggtctccttttgatgtccccttcacttccctgccgtggccttgactggggagagggaaggctgtttgtcattgttttcttctgtctgtaccccttccctgctgtccctgctgcaggtcagcagggcgttgctgctggtgtggcggtgcggaagcccctggggcccagccctggtgggtcactctgtttccggagatagccccctggggagcacctgcctcaggtgtgaatgtcaccagatagtttaaagtccctcatgtggctgggtgcagtggctcatgcctgtaatcccagcactttgggaggatgaggcaggaggattgcctaagcccaggaggtcacgaccagcctaggcaacataggaagaccctgtctttacagaaaattaaataattagctgggcatggtggtgtgtgcccatggtcccagctactcaggaggctgaggtgggaggatcacttgagccctggtgttcgaggctgcagtgaattgtgattttacacactgcagtctgggcaacagagcaagacccagtctcaaaaaataaaataaaataaaattcttcatgtttatatcaatccagagagaatctacaagtaaattttgggtgtgtcatgataaaattagtatgttacaagacttcaaacactacacaaattatagacacagaaagttcccacagtcccatatcccacaggtaacctagatccctccaggttttttatctgtatatatacattttattgtgtgtgtgtgtgtgtgtgtgtgtgtgtgtgtgtatatatatatatatatatatatatacacacacaaacattttattttgtattatgaaaattaggatcgtgctgtatattcgttgtgattggctgaataatggcccccacagatatacacatcctaatccccaaaatctatgaatgtgaactcatgtgggactttggagatgttactaagtagaagatcttgagatgggaagatcatcctgttgagctctaaatgtaatctctaaggcccttatcagagggaggcagaggaagatctgataaaaagaggcagcgatgtggccacagagacagagtggagtgacgtgaccgcaagccaagagacactggccgttgaagaggcaggacgaattctcttctggagcttccagagggagcctggtcctgctggcaccttatgcttgcccttaagtactgattttggattttcaatttccagaatggacagcatcttggagaggctgctgcagggagaggcaggaggtggagaccactatgctgagcagagctgggggaaagtgggggtgtctttttgagagagacatgcgagtggcacgtggggtgagggaacagggcggtgatggagctgaaacctgccatgtcggggttggcggagccattgggggcactactcgcacaatcttggctcactgcaacccccacctcccaggtgcaagcaatcctcctgtctcagcctccaagtagctgggactacaggcatgtgccgcagtgcctggctaattaaataaaaatttttggcagagatgagggtctcactatattgcccaggttggtctcgaactccgaggttcaggcgatcctcctgccttgccctcccaaaatgctgggactacaggcatgagccactcactcagtctggaggccctgttttctgagctgaggtataagtgtcctcagcagcagggcagcacggtgtccaggcaggggtgactcacctccacagaggcctacccgccaagagggtggagtggtgtcctgggctgatgcagaggcagaagtgcgagagcttaggatttcacacaccttttcgtgaagtgctggggtgctgtgctctcagacctcaggcctgagctttcctctggaaggggtttgggttgtgtttgtgtttcctgatgttcaagggtccacaagagcaaagctgggaggggggtctctgtgggagtcggggcacatggggcagacctggggcctttgggtatgtaggggtggcatgctgagtgactccacacccatcatcggggcaaggccatgctggagttttagggggtataagagggctgtgcccctgccaggacatccagctaagccccctgcccagctgggccagcactgtgttcccagcaccccagacattcccatgcttgtggcctgagaccaccattcttcagtgggagtcaagacagcataggatgggaaaacagtgccaccaaacagcacagggagcagtgacaaaaaggccattgtggccgggtgcggtggctcatgcctgtaatcccagcactttggaaggccaaggtgggtggatcacgaggtcagatcgagaccatcctggccaacatggtgaaaccctgtctctactaaaaatacaaaaattagctgggcgtggtggcatgtgcctgtaatcccagctactcaggaggctgaggcaggagaatcgcttgaacctgggaggcaagaggttgcagtgagctgagattgtgccactgcactccagcctgggcgacagagcaagactgtctccaaaaaaaaaaaaaaaaaaaccattgctcacagaaagtgctgtgtgctggctgtgccccacatcctagtgagaggttgcgaaggtgctattccacgttagggaggaagtctcgggccatagccaccaggtgtgttctgcatgaggctggggccagcttctccaggctggtaggccatggccacccaggctgagagctgctgacagctcccggtgggccagcctcaggcatggtccttgcagcttcccttttgcctgcaggttttccagcttgcagctcatctggtgtactggggcaaggccatcatcatctacccgctgtgtgagaacaacgtctacatgctgtctcccaatgccagcgtatgtctgtgagtgctgctggctgccagagcctggagccccgagtgggaaggggtgaggctggcagggccctccagatgctgttctctgtgttggccaggcaccaaaggctgtggaagccccaaggccaggctctcacttcagcctaactcctggccactagcatacccaggtcccaattctggtctggctctgtgctctgtggctctcctgtgtcccccatatgcctggccccctcctccaggctggctcttctaatccaccttgagggatcagaggtgagatgcaggatgaactgtgcccatggctcctgctgctgctcaaggggaagtgcccaggctctgtccacctggaggcctgcctggcctcataccgttctgccctcatcgcactgtcctggcccacctgccacactttgcttctctgctgcccactgaggccagtgttgagaacacggtgggggggtctgctgcactcactggcatgctcacctgcctgcaggtactccccgctggccgagcagttctcccaccagttcccatctcatgacctgccgtccgttcttgccaagttctccttgccggtctccttgtcagaatttaggaatcccctggcccccgctgtgcaggaggtgagtcacagaagctcaaggagcccagagtggcaggtgtgtagtggataggcactacctgcctggctgttggttctgatctgagagccctcagcactgccacctgcttctccttggttttgggggcttgccgtgcaagtgctacgtgcccagcaggacccaaaagtcagctgccgggccacctgcagatgcttggccagtgacccaacacttgagcagttgttccctccccatagagcccaccctggctgtggcaggcagtttttagtgttagaaccgagttaagcaggagagtgcttaccttttctgggcctacagacctgccttgtacccctttgggactggggactgcctacagatgagggtgcaaaggcagttttgttctcactgggccaggcctgaccctctgagagttctgcttctgtcttcactccctgccatggttcaggtggccacagggtctgtgggtatgagttctggggtcactggtccccagaatctcctcattcaagagagcctagagaggaccctagtgggcctggatcagggcaacgggcaggcaggttgggagctaggagtggctgggggataggaggcctcctgcaggtctgtgggatgaactggtgcacctgcatctgtggcagggccagtggcttcccctgtgggctgcaggtgtcatagccttgtgctgaggtggctttgccatcctcccctccactgagttctgggcagagactcagagcagggccagataggatacggtgttggagacagacgagctgggtgttctcaagtctttgtctccagaagtatctgagtaagtgccagatctattaggcaaaaccagtccttaaagttaaaccctttccgttctcaaattacgaatgagaacgattctggcttttcagctccgttagacgctaaacctgacagagctctcagtgcggtctttcacagagcccttggtttctgggagctgagccaggttgtaccagctgaataaaaggcactctctgcacccctgctcttggggcagtgcttagggaggagctgctggtgctcccttctcagaggcctcctgtggtctagataacggagtggcttttccaggccatgactgagtggttgctccaggccttgtcaaggggcctaggtcagccaggttctgcctgggctccagtgctgggaagcccctctgttttatttttggtttattgattttatttaattttgattgcacgtcaggctggagtgcaatggcatgatctcggctcactgcaacctttgcctcccgggttcaagcaatctcctgcctcaccctcccgagtagctgggtttacaggtgcccgccaccacgcctggctaattttttgtatttttagtagagacggggtttcaccgtgttgaccagggtggtctctaactcctgacctcaggtgatccacccacctcatcctctcaaagtgctgggattacaggcatgagccactacgcccagctttttttttattgttttgatatagaaacttgctttgttgtccaggctgaagtacagtggcgtgatcttggctcactgcaacctccgcctcccaggttcaagtgattctcctgcctcagcctcccaagtagctgggattacaggtgtgtgccaccacaccaggctaatttttgtatctttagtagagatgaggtttcactgtgttggcaaggctggtctcgaactcctgagctcaagtgatccacccgcgtctgttttatttcttaaattcatgtgaagtctggatatcttgcagtccttttgaccaagtcttcttacttgcctgggatatatcccccattcccatccccagttccccagccccctcccaggaggtgaccctggccagcagctccttgttgaccctcccagagatgagtagacagatgtgtatctgaggacactgatgtgtctcacactccttactgttcaacgcctgagtctgggcagtactttctcatggggactggactctacctggcacaaggctcctcactgctcctcactgccagccccacctgctaacccagagacattggagggcctggccaggacgtgccttctcacggtgggggtgggggtggggtgctccacccccaagcccagggtcactggcctcagctttcttgtggatccactcttgtgctcagggtggactttcaggtagatccaaggagaggactttctgctctcagggtacctgcccacagcctctttttaaacagtgtctgggcttgtgtggaggtggacttgctggctgggtccaactccagggccagtgggccaaagaagagaggaggcagaggggcagctgcagcagcacagggtggggggtttgctcagcgaagcagtcacaggggcctccacgtctcaggtcctgctcctcagccagatgctgggtggccccggtgtgtggtgggagcctgtgcaggtgtgatccagatgttcccctggcccctctcccttcccaggagggtgagcgggccttgcagagctggctggcagctgggggctccctttctgagaagagggcctttctgcctgtgcgtcagcacagggagcgtgctgtggccatgtctagggccatggctccctgatcacccaggaggaagttggagtggggagggggaccagcctcacctgctgccacccgcagacccagctcatccagatggtggtgtggatgctgcagcgccggcttctcatccagctgcacacctatgtctgcctgatggcctcacccagcgaggaggagccccgtccgcgagaggacgacgtccccttcactgcccgggtcggcggtcgcagcctcagcacgcccaacgccctcagctttggctccccaagtaggacccccagggcaccgctgtggtagtcaggggagacgcttgggggtggcatccaggaggctcaacgtgggcggtgctgtgagtgatgaggggcctccacacagctgcacacgcacatgcacgtgcctcgtgtcccccgtggagacacctctcctgtctcctagcaccaccgtgactctgaggtggcagctctgtctccgggctcttcagcaggcttgctagaattaggggcagctcccagcccagcaaatcagtgctggaatctctgccccagcctgggagcagagcaggatctcataccactaccaggacagctgacacctctgcgccccagaagagctgtcatggccagtgtggcttgagggcagcagcctgttgccaggtcccaggtccccggtccccaggcttggggaaggaagggggtggaagactttgaaagtccccccttggctgaggtctggctgtaggcttcatgcttcatgtgaggaccccacctgcccagggtgctttgtcctccatcctgggtgagggacaggatgcccaggcccaccttggggtgtttgtggggcacacatcgcacctctgttcaggtcccttgaggttgcccccagaggggaggctacccgtttcccaagtcagccgtatgaggggcgtgtcacacccaggaggtggggcagcagcgaatgcttgcaggcagatgtaccctaacccttgtaggagttaggggtgtcattggaggctggctgctggctctgccctcgctgttcccctgggtgtcctggaattccacttggtcaccctgacccatgtcccccacagccagcagcgatgacatgaccctcaccagccccagcatggacaactccagcgcagagctacttcccagcggggactcgccactgaaccagaggatgacggagaacctgctggccagcctgtcggagcatgaacgcgcagccatcctcagtgtacccgcagcccagaaccctgaggacctccgcatgtttgccaggtgggtgtaggttgacccgttgggactggggccagttgcagggtcagggcagaaagtggatagggacgtacgcaacagaaccaccaaatccactgagaacagatggggccctgttcgagatggagtctctgcattcaggtgtgtaggggcaggtgccactgcccaggcctgagggttcggcttgtcaccaagacgccgggccatgggcctggcatgcctatttttcggactcttctctctccagtacttcttagatgttccttttcccttgagaggcagtgccaagttctttttttttttttttgagacggagtctcgctctgtcacccaggccggactgcggactgcagtggcgcaatctcggctcactgcaagctccgcttcccgggttcacgccattctcctgcctcagcctcctgagtagctgggactacaggcgcccgccaccacgcccggctaatttaagtgccaagttctcaccctcatgggacttggcaggggtttgcccaggactgtaagccctgcgggcatccagggtcccccatgttaaaggtgatgtggctcagtggtctctgtcagccccaccctgacttgggggacagtgcaggggcatagtttcccgggagtggtcgggttgtcagggactgagtttccggttaagaaccacactcggccctcgagagaaccacttgcaactcttctgagcagctggtccaggtctcacctgcatcctagcctcctctgtgccagcctgagttgcagaaagcaccctaaagcagtgaccttccaaatgatggtgacattaaaaaaaaaaaaaaaaaaagtcaggcgcggtggctcatgcctgtaatcccagcactttgggaggctgaggtgggtggatcacgaggtcaggagatcgagatcatcctggctaacatggtgaaaccccgtctctactaaaaaatacaaaaaattagctgggtgtggtggcgggcgcctgtagtcccagctactggggaggctgaggcaggagaatggcctgaaggcgggaggcggagcttggcgggaggaggagaatggcgggaaggcgggaggtgcagtgagcccagatcgcgccactgcacctccagcctgggcagcagagcgagactccgtctcaaaaaaaaaaaaaggaggctgggcacagtggctcacggttataatctcagcactttgggaggctgaggtgggtggatcacctgagttcaggagttcgagaccagcctggccaacatataatgaaaccctgtctctactaaaaaagagagaaattagccaggtgtggtagcgcactcctgtagtcccagcttacctgggaagctgacgcaggagaatcgcttgaatctgggaggcgggaggttgcagtgagctgagatcgagccactgcaatctagcctgggtgactgagtgagactccgtctctcaaaaaaaggaaaaaaaaaagcagtgaccatttggctccagagctacgtgggactcactgtagcacgaaaaagaagccaccagcagaaccctggtcccaacatcaggacgcaggcttgggcacctctgggtttgaacagccgtctgccgtcctgaacccactccgcccacctggtggtcagcgggaccgtggtgggcatggggtccaggaggcctgcccacccttgttggggggctgtggtggctgcctccctggccttcaccaccagctctgttcaggcctgtgggcagctcagagctgattcccagcagtggctcttcagcagaggcctctgggggctggtgtcaggttgggctcacgcccacccatcccttccaggctccttcactacttccgcggccgccaccacctggaggagattatgtacaacgagaacacgcggcgctcccagctgctcatgctgtttgacaagttccgcagcgtgctggtggtgaccacccacgaggaccctgtcattgccgtcttccaggctctgctcccctgagcccaggcggagggcggaaggctgctggggtgcgcaggtgggcgctcgcgtctccccaccccagggctccccccgtgctgaggctgagccctcttggccctgaggcctggcattgggtggatgcgggctggccgtggcccagtgaagcctgcagagccccgctgtccttgcccctggtggttccgctgtggggctgctgccctctgtgttcctacgcttccctccagtccttgccgcacgcgtaggcatctccacgctggaggggggcctgccaggactcctgtctctgggtgaggccgcatccttcaaggcccatgtgggctgtgcgtttctcagaccctccttctgtccctacacctgctccttggaccccccagtctgtggccaccctgaagaatgtgcagaaacacttgtgtggcctgtccctgtctctctgacagccttccatttgtgaagtgccctgtggccccctccccagcacctctgtctgccatgcgcttcttcctcccaggctaccctgagcctttcctggcccagtcctcaccacagtccacagaagccacaaacaggctcatagccaagctgtgacctggtcctgaccatctggggcacgagggcctgggctggccctgctaggctggagaagccctgtcacctgtgcacatcttgctggtggaggcatggcccactgtgcaggaccccaccctcgggggctttcggctcccacactgatgattctccccagcatccacaccgggcctggcgctacgtactcaggcccccagctctcgtgtcctggaggaagagctagctccagacatgggttgatcacctagaggagctctggctaaggcacagttttctagaaataaaacatttattcggtttttaaacaattaaaaaatcttgtctgggcaggccctttgctcaggcctgtgtgtcctgctcagccactctgtcgaccacactgacccaggggctgccccggacatagaagcggaggggtttccgggcccactcccctgcatggccgacgcccacccgggctgctgccactacagccggctcactgggctccaggggaccacgctccagccatacagcttcatcctgtgccaggtccctctggtcaaagctcttgttgatggccagggcctggcacagcttggaggggccactgcagagctcgcggtccttgaggacacggctggcggtgcctttccggagggtgctgcgaagctgacgcatggtctccagaccttccaggggctccagtgctcgcagcaagacgcaagccccgtcccctgtgggacggacagtttggaagtggagcctccctaggctcctgtcctctctgccctagtacacatccagacatcctgtgctgcagggagggtgcagctgccttcctgcctgggccagggacctgctctgtgcacctgcaccatctcctgggtctgacctggtgggagggggctgcacctcactgtgtccagacccctctgcctaccttgccatcctccaagcctgcaccatgaggtgtgcctcctgtgggcacctctggcttccaccaccaggcagggcctcccccactgtggccgcccccacaaagccagactgttaaaaacacatgacaaatgctgggtatcagttcctttccacctggcttcccctggtcttgtgactggcagcagctataaagccagcaaaggaagctccagagagccagtcctcgggtgcgatcattcagccaggaagcaggaagccttggcctagccaggccccagcgctccccttctgcctcacccactcagtgtttgtgttggtcaagtggtgggggctaggagttggcttagagcagctgccagtgtgcaccggatgttgggagagcccatgcaatgactcagtggaaggactgactgcaacaccctgcacaggcagggcaggaggaggctgacgaagccccctcacctcccttgggatccctcctccagcctagccccctccctcaccaggccaggccccttgagaaacagagacagcaagcgaaggctcctgggcccaggggctcactcaagcacagatacccgaattccctctgccctgcaggtttggaaaggccccttggattcctggctggggacaatgatgacctggaccctggccagaagagccctggccctccagcaaggcagcacctgctctgatgcacctgtgcacccctggccctcccagccacctgggagcccgaagcttagcctgtaggtggccaagccagtccctactcttgggctgcggccacgtgaggctccgcatcagcagccaggggcgagcactagtggacaaagccagcaaatgcggcgttcctgtgagcagataccctcaaccagccagctgtcaaaagtatttcaagataaaatccaggccaagcaaagcctttaagttcccgtccattctgtgattcccacgctgcttccagctcaccaggtggggtgcctgctgcccaccctgacccacctcagtagggaggagcaggaccctctacatccctgtgggtgcagggcacacgcccctcgttgtctcactgagcccccacagagccgcctgcaaatgagtcaaagcctggccgccctcatcaccacagccccgtgccctggctccttcacacagaacacatccaagtcccacatcctgacaaaaacatgacccctttgatcacttcctgccaaacctccctttcctcaccgactcctccgccgaccctaagtccccctgctgtgcccactgctccatccttggcaacctgaccacgctgctcttagcactgcagtcatcctcttctccaatcagcttctcatcctcatgtgctgcctccgtcaagggcaggcgacactgtgtcctcggccttctttctgcctccactccaaccaaccctttcttttcctttcctttttttttttttttgagatggagtctcgctctgtcacccaggctggagtgcaatggcgcgatcttggctccctgcaacctccgcctcccgggttcaagcgattctcctgcctccgcctccctagtagctgggattacaggtgcccactaccacacccagctaatttttgtatttttggtagagacagagtttcaccgtgttggccaggctggtgtcgaactcctgacctcaggtgatccgcccgcctcggcctcccgaagtgctgggatgacaggcgtgagccaccgcgcccggccccacccggccctttctacccctttaacctaaccagccctgccccgtcagcgtagccagagctcccgaaaccctggcctggcctggaagtggcacctcctcgctcaaatgctggccccacctcagtcctcctagtggtcccctggctgctagcggacagggctctgccggccctccaaccccccgtgccccagcactgctcaccctggctggagatgttcatgcagaagtacatgccgtaaatgatgtacacgtacagggtccccggcttcatgaacatgcctcggttgcggggggtctgccggccaccccttgagtgggcggcttcatcctctggccccaggtatgcctcggtctccacgatgcggcctcggagttctgtgccattaggaagtcgccggactaggacctgtgggcagtcagtttctgctcagggcgggaagggatgggggtccactcaccctaacagtgcccagcctggacctcatctccccagctcagggtgtgtcagccgcccaggtctagccagggaccttgccccgtctccatcctgcctcttctcttgctcctgctgaggctgaatgtggctattgagggcaccagttgtctcctccagccctgctagacaaccagaccgcaggccgaagatacctcaggccacagccaggctgggctgggaaccggcagtcatggattcaccttgcaggtcaagtcctctcagcaggaccctccattccccagattcctcctttcccaagtgcccttgagaaaaccatcagcatttagcacgaggccaggcatcacggaaggcacaggaccccaaggatgtccccacaccagctacctgggcaatcccagagcccgtgaagtcccctaaacctgggctgctgaggtggccacaagggaccctcatactcagctcccaccctccggctttctgagcagtaggcccagctgccccacggtgccccagcctggaccatggtcctggtaacggccaacagttgtgtcactgctcggagccccagagttaacagcagagcactggggaccaaccacatcccctgcacctctcgtttttaggccagataggtcagctggacagccaggctaccttcacctcagcccacgaagccctgtggtgccaaaggccatggtcagtatcacgggctggggaggaggggcact

SEQ ID NO: 15098 - DNA, 4382 bp, Human
atttttttttaaatgttggcgctgaaactggctttgatcaacgttttaaaaagacgcgcgctagttgtgattggccaagtgatttctttttaccctcttaagtttagaaaggttaatttcatatcttgatttgtctatttaaacttggagatattttcaataatttgttccaaatgcaccatgactattaactcataagtaacaatatgaaacctgatgttaagctacatgaacacatttaatttcaccacaatatgtcatcctcatatgaaagcactctcttatcttttacaagttcaactggtatttgtgtaatctgctgtaaaaaaaaaaaaaaaaaaaagccaaatttataaatggcacaaaaagaccagtgtgcccttttagtcatgctgaacactgtgctaagaagctccacctaagggccgtctggctccaggggatgtaggtttgtattcctattgataattaattagggttagctcagtagagttgaaagtggcttgcaaaaacaaacccaaaaaatacttacaaattacaggttatttcgtatcattaagatgcatacaaaagacaataaaacatttgttctggttctgttgctttaagtcactaactatatttttatgtaaatgtaaacactgacaaacattaacttctctcctgtatgtctcaggccttttaacagctttgcaatcctaacgagccgctgcattgatcgatttaaattacatgtgacataaagtctctttgcattttaattagtttgcttttttgggtttttgtttgttttgagacagtctcgctctgtcgccgaaactggagtgcagtggcgcgatctcgactcactgcaacctccgcctccggggttcaacattttctcctgcctcaacctcttaaatagctgaaattacaggcgcgcgccaccacgcccgacaaatttttttatttttagtaaagacggggcttcacaccatgttggtcaggctgtcctggaactcctgaccctgtgatccgcccaccttggccttccaaagtcctgggattacaggcgtaaggaaccgcgccccgccaatttgcttatgtatttttatggcatctttaaaatggacggttagtttcacgattcagtgttaagaacacccacttataaatggaaaaattattaaagaaaactgcaaaatagctatttacacagaaaatgtgagcccttttaaggaatacatgggtggctctgaaaagagcctttgttaagactgcttccttaaaaagccaatataagagttctcgttttacttgcccttggccttgtggtgactctcagtcttcttggggagcagtacagcctggatgttgggcagaacaccgccctgagcaattgtgactttacccagcaacttgtttagctcctcgtcgttgcggatggccagctgcaggtgtcgggggatgatgcgggtcttcttgttgtcgcgggcggcgttgcccgccagctccaggatctcggcggtcaggtactccaacaccgccgccagatacactggcgcgccggccccgactcgctcggagtagttgcccttgcggagcaagcggtgtacgcggcccacagggaactggagtccggcccgcgaagagcgggtcttagccttagctcgggcctttccgccttgcttgccgcgtccggacattttgaattcttaaaaacgatgttaagcaatgaagacaaaaatgtaaaagtgagttttgttagcaagtgagaaactattatacttggaggtcgaattgtaaataacgctatttgattggctagaacaaccaaccaattgcaaagaaacgctagaatcacctaatttgcataccacagggcacacagagacaattcatccaatcaatgtgtaagcttttaaatgccagtttacgataggagctctacaaatattaccagctgcagagtgaggacacttgcatttctctttaggttgtggacgaagtgtttatttatcatgcctgaacctgctaagtccgctcctgctccaaaaaagggctccaaaaaggcggtgaccaaggcgcagaagaaggatggtaagaagcgcaagcgtagccgcaaggagagctattccgtgtacgtgtacaaggtgctaaagcaggtccaccccgacaccggcatctcatccaaggccatgggcatcatgaactccttcgtcaacgatatcttcgagcgcatcgctggcgaggcttcccgcctggcgcattacaacaagcgctccaccatcacctccagggagatccagacggccgtacgcctgctgctgcccggggagctggctaagcacgccgtgtcagagggcaccaaggccgtcaccaagtacaccagctctaagtaattctaacgtcttcatacccaatcccaaaggctcttttaagagccacccactttttcagctatagagttgtaattacctgcatattttccgtgtttaccaccaacaggtttggttttatcctcatttgagggggttgctgctgtgtaggtctagaccacagttcttttgactggttgaaggaaaatgctatacttaaccgtagcatgtttgttttaccccaagtgctggttagaaggctagcccattgtgctgataagcacatttttcttatgttgtgctgtgatgtgtcccttgtcaaattggtttcataagaaaagaacttttgaaatatctcttttgctactgacatagtgtgagggaaaggaatgtcttccttaattccggtttagtcatcgcagcattggcgaatttagctggttaaaataatgtaatcaaattctttaaaatataaggaaagcaagacaagtaatgtgcatgaaaactgaaaaaatgtgaacacccgagcctggatgcagcactaataatcaacattgttcttggtttagttaaagaaaatttggccactggcaaaataccatttgggagtaatgagacacacccctaatcctaaaatattttcttgtcacttcctcaaagttgtttttgactttttttccttcagggttgacttcatatgtgttcattttattctaataagcaaaagttgtaatttttaagtgaaaaaataatttatgtcattctacttacaaatacaatttttctattctatatactcatatataaagatactgaagttttactgtattcttggtaattacaagccttacttaagatcataaactgttatgaatggcatccagtgtagaatacttaaaatttttacaaaatgtttttgtatcttaaaaatatttaaaatattatatataaaagattcttagaatttcaacccagttaagaaaaaaggaatagtattctatattattactttttttttttttttgaggaggagtttcgctattgttgctcagagtagagtgcaatggcgcaatctcggctcacagcaacctctggctcccgggttcaagcgattctcccgtctcagcctcccgagtagctggaactacaggcgcgcaccaccatgcccggctattttttgtatttttagtagagacggagtttcaccatgttggtcaggctggtttcgaactcctgacctcaggtgatccaccatcctcagactcccaaaatgctgggattacaggcgtgagccaccacacccgtcccataattatttttcaacttcccactccctgtccggcacataaatggacacagaacacagcacatgcaaagcatatataaacattcaaataaacaaaacccaactgaaaaaatgaaagcaacaagaaaaacctaggaaaatgaaaactaaaaatactaaatggcttcatgtgccaatttacattggcatagcagtcgatttttgctttctgtagttccagaagtaaatatctaaactaaggtctacatcagcttgaggggaatacaacaagtttctgaaattatatgcagaaatgtggccatatgtgtttccccttcccagaacaaattatatagctttctatcagattctaaaaatgttaagcagaataaggataccccagtgatgaccacatcctaatccctggagtctgcaaattcctggagtctttgttaggtaacatgacaaagggcaactaaggtttccatggaattaaggctactaattggctgaccttaaagtaaggagattatattgcatgttatgaattagcccaatataattacaaagattcttaaaagtggaagagggaattggaatagagaactagagatatggcagcatgagaaaaatttggccataaattgcagactttgaaaatgaaagaaaaggaccatgatctaaggagagagtggcatctatcagttaaaaaggcaagggaaaagatacaggctctttat

SEQ ID NO: 15099 - DNA, 4312 bp, Human
agattgtgtgcattaaatgttgtttgttcccagttgttcagtttgtcaggcctctgagccgaagctaagccatcatatcccctgtgaactgcacgtatgcctctagatggcctgaagtaactgaagaaacacaaaagaagtgaaaatgccctgttcctgccttaactgatgacattaccttgtgaaattccttctcctggctcatcctgactcaaaagctcccccactgagcaccttgtgacccccacccctgccagccagagaacaaccccctttgactgtaattttccactatctacccaaatcttataaaacggacccaccccatctcccttcgctgactcttttcggactcagcccgcctgcacccaggtagaataaacagccttgttgctcacacaaaccctgtttgatggtctcttcacacggacgcgcctgaaacagtttaacagggtttttcctgcccagtcacaacaaagtgatgttatgctgcaggctgaagtttacagctaatgctgttgaagtctaaaatcagttttggtttgttagatttgggtgagatggctaagattctcagagaaagaagtcaagtttggggtgcatttttcagacttaaaaatttagcagtagcccttgcagtttttccaatagaagtgatttaagaatgttttcaggaaatttaaaacaacagtgagaagcgtgtatggagagttgaactacactccagacttggctataggaaagcacgaatgctgctattgtattgcaccttggaaaagagaacaaaggaatattttcggacaattttaacatgtcacatatgaaaagctaaacggaatctgtcaacaccttgtacgttattacaggctgtgattttaaaaaaacaatccttactaatacatacatagttgctgctagcaatatagtgttgggagtaaaaacacgaaaatgagagttcaggacaatatcccaactctgagcagatttttttaagtagtaacatctaaaattaaaccatattatgtaatatttatttcttttccacagtctcttctcatgcctcgttcacattagctaattaaaagtcccctgagtatcatcataacccgatttacagatgaaggcacggttgcaatgagctatcaccctcttctgaatgagacagtacagtgtgaaggatagcaaaactccactcccatcctcttagggctctggctggaccagcaaattaaattaatgtaaaatggattaacaggagaaaggtatatgcatttatttaacacaggttttacgtgacacaggtgctctcataaggtaatgaaagcccaaaaaaagcagttagctacttatataatgaattggacaattagtaaaatgtaaaaatgcgctaaagcaaagggatttaggctagaatatataactgtgtagagaagcgcccagcaagggctagtgcaaggtttgtacagaattctcttggcctcagcctcctatccttgagaagaatgttgctttttttaaactacagtgagaacatctttcatatgagaatttcacctactgcttctaagaaacaggtcagctttcaagaaaacataaggccagagtgatcttttcacgcctgctcttttaagtacctttgaatagtcaatatgtcttcaagcacttgaaagacttaaaaagtttaccactccggcatattagtgaaagcccttaatataagcccttattaaaattctcagtcgagggtataaattcagattcaaatagtagtgtcgtaaacgggagggaaaaactaaagggattaaaaagtgaaactattgtgttctccctcgcagtccttaggtcactgcccctcgaggggcggagcaaaaagtgaggcagcaacgcctccttatcctcgctcccgctttcagttctcaataaggtccgatgttcgtgtataaatgctcgtggcttgctttcttttcgcgtacctggtttttgttgtcagctggttagacatgtctggtcgcggcaaaggcggtaaaggtttgggtaagggaggtgccaagcgtcaccgaaaagtgctgcgggataacatccaaggcatcaccaaaccggccattcggcgccttgctaggcgtggtggggttaagcgaatttccggtttgatttatgaggagactcgtggcgttctcaaggtgtttctggagaacgtgatccgggacgccgtgacctacacggagcacgccaagcgcaagactgtcactgccatggatgtggtttacgcgctcaagcgtcaaggacgcactctgtacggcttcggcggttaatcttttcgtcagttttcttccaatggcccttttcagggccgcccactccctctcagaaagagctgtgattgtattctttcggatggtaacatctcaatggctttactcggctattctgcctagtatgtagaactattataaaccagttgggagagaccaggttgtttggtctgagtggctgctaaagcagaaatcagctaagtaaacgaggtctccgagataagtgagctataaacttcaatgctatagttttgacatgtcaagcaacttaacgtgcagcgcgagtccgataaatgagtagctcagctttttagttttaaaaacgagttgtgcgttatttgtacgagagcctaagatgctagctgcctggaactgagtaggtggattaaaatgggtgtcaggtctgttttcccaggcgtatctgacttaacgtcagcaaaagctgtacttttagcttccctggtaacacctgccgtccttaaccgccccctgccggtagcgccagaagcctttacttccatttctagttgagcttggcgtcctgctgagtgacgtcacctcccccttctctggagtaggactggcggttaaagctgctttgctattttcagtcctcaggctggaggctcccctaagcaggctgcctacgcagttcgtaaattcccacttagtagactaagggagtctgttttataaataaggactcaaatttcttctgactccgaggtccgtggcagcagctataagatggaagccccctctgatgtaagattctcagatgacttgcatcttcactgtacctgtcaacccaatagtcttctattcctgccttaaattgtaaattccaaaactgatttaattgtgaaagtttcaaactgtacgacctaggaagtgtcaaagttaggtgaccagatttttagaagtcagccaaatattcagcatctttgatttagtaacaaatatattgatggctacttcagcaaaaaaaatcaactttgttttctggttactttgctaacaagcttctcctgacaggaggatatagtgaataggcagttgaataagtgagttcgggtgagaggtctgagctggagataaaaatgtgtgagtcatcagcagataaataaatgctgagaccagatgagatggctaaaaactgaaacataatgtagtgcagcattgtttgtaatagtaaatgagtggcaactgtaaagttttcatcagaaaggactagagtgatctatacatccataaaatagagtatttctctacacagccctactaaagaatgagaaagctgtactccactacatactctggtgtactctggctcagttcttggactcctcttttcttggctaactcaactggcctcaccacttacatgctctgtgctctgtcaaatagtttgttcaacagaacaccacggcctagctgtaagtgccacgttaacttctagcaatgccaaagcctgtgatagtggcagcttcgggctgtttctcattcccgggatgcctaaccacctctccaaattctatcagtttgcttccacccacttcaagcttcagaacgaaacatagagcttaagaaatataggcccggcaaggtggctcacgcctgtaatcccggcactttggaaagctgagcctggtggatcacctggggtcaggggttcgagaccagcctggccaatattgtgaaaccccgtctctactaaaaaaaaaaaaaaaattagctgggcatggttgcgggcgactgtaatccaagctactcgggagggtgagacaggagaatagcttgaactcgggaggcagaagttgcagtgagttgagatcgcgctattacacttaggcctgggagacaagagtgaaactgtgtctctaaataagtgtttgcaattataaaccatctccctgaccttaaatctctagactcatatacaactgcatatttgatgtatctaattgaataatgggcatctcgaacttgtccaaaatatg

SEQ ID NO: 15100 - DNA, 4746 bp, Human
ccatatttcattcctcatatcgaatattctgagagagttagtttgtggagggtagttctggacaatttatattttcataacacctctggttatttttttttaagtagagatgaagacttgctatgttgcccaaaatggtcttgaactcctgagctcaagcgattctcccaactcagcctcctgaagtgctgggattacagccgtgagccactgcattaacctctgattaatatcatagattaacctctgattaatatcatagatttatttgtttgaatgcttcatgtatcctctcaaccacaacttgtttgcagagttttaatctgaagggcttaggtctcttgttcaatgaatgagtttgatctgatgggtgagaggaaggtgaaatggaaagcgaacgagaagccatacagattaggcgagtgagcctaatctctccctaaccataagattgagtatgcctgaattcttcccagagtggaagaatccattttaaatatatatatctacatgtacagatcctttaaatatttgttctgacattcattgtttttgagtcactgtcattgagaaaagtttagaaaggagatattaggagcaggaaatagaaagtaaataaaatatcaaaataaaaatggggttttataaatgatataataggcaaaataaaggaaaggcatcctagacctctggttaaaatgaagatggcacttggcgagatgtgttccagggtagttcacatgatgtatgttttcagagaattgtcatattgcatatgctgctatattttttattttcatgaattaaaaggcatgttgagatttcagagttttacttatgatctcagactctgcattttttctctgtaatgtttgacatttcttcctagctaagtctctagttataaggtctgtgttgtggcatgtggacagtgagtggaagaacctaagaactcaatttggggcagaagaatgtaatcaattatttcagaagtgatacaaacaatatgacatgtagagcattctggcctttcctgggtcttttttctccattcctggatttcttctcttcatgtgagcaagtctgaggttactatataatgtctctcacaggccacagccccattctaaatattcccaatagaaattcatttattaaccagagagtggtgggtggggttgtttttgttttttaaacaaaagtggatcttatgggcattctggaaagctcccgcaggaagctaagaataaaattttgaattgagaagtccctttcttcaaaccacattcagacccaattctgctattctatttatttttcaaggggattagccttattttaacaccaataatcttatcacaaaaacctcccagaggaagaccctgtagattttgtaatgaccttaatcaagtattagccctacacttcaattaatccccaactgtacaaaacgtatgttcttttctctaaagctgtagcaagttgaaaggggattaaaaacggagggaagggaagagtgtttggaatttcaggcacagcaaacaggcacagcagaccaggaagagcgtcccgggaaaacatattatccagacttaagtttatattccctgtctctctcagacttttgcagaaaaatgagtcattcaacaaatatttgaatcgagatagggaaagtgacgaggaagaagtttgcacttatgaggttttaatttgcaattatttggctacctttttgccttcccaaaacatagggtctttaggagtgaaacttcatagccaaacttataccttgtccagcacagagaaggccatcaaaatgcctggtttaaataaaaatattaaaatgattgggagggtaaatcccttgacctataaatctgacctcctttaaacattatttgtatgttccccaataaactattccgtaatttattagttagcaagtggaaataaaaagaaatgtggaatggggctatgcttagcgtcattaagctgacaggaatacagcgcattcaacttgcaaacacccttccactcccacaaagagcaagctgtcactggccaatcaaaacaatgaaccataatgaaacagtttttcttgctccacccactcggtgaccaaatttgaaaaaaaaaaaaaaaccgcgccaacccatgttgttttcaatcaggtccgccaagtttgtatttaaggaactgtttcagttcataccttccactgcgataggaatcatgtctggtcgcggcaaaggcggaaaaggcttggggaagggtggtgctaagcgccatcgtaaggtgctccgggataacatccagggcattacaaaaccggctattcgccgtttggctcggcgcggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctaaaacgtcaggggcgcactctgtatggcttcggcggctgaatctaagaatacgcggtctcctgagaacttcaaaaaacaaaaacaaaaaaacccaaaggcccttttcagggccgctcacaaagtcgtttaaagagctgaaatgcgttgcgagaatgagtttggatgacagaaataaccgtgacagcctgcataagaatgaattgtgtttgccatgaccggccacactgtgacaaaatttcaaagcataaagtaggcatagagaggtaagcgctaataaagtgattggctccacaaaaagcattttgctgggcgcagtggctcacgactgtaatcccagcactttgggaggccaaagctagtgtatcacttgagatcaagaatccgagaccagcctggccaaaatggtgaaaccccctctaccaaaaaaaatacaaaacttagccgggcgtggtggtctgcacctgtaggcccagctagcccggaagcagagattgcagtgagccgagatcgcgccactcccctccagcctgggagacagagagagactcctcaaaaaaaaaaaaaaaaaaaaaaaaaattatgtattttagagcattctaagaatggtactttggacttaaccgaagggctggaggcgcgtgttgaacaaaggttatcaccttttggctcatgcggcacacagctatgtaaataaagcatctttagggacaagctctcatttgcggagggttctatggctgttgtcctattggccaaaacaaagtggtctaagtccgggcgcggtggctcacgcctgtattcccagcagtttggtaggccaaggtgggtggatcacgaggtctggcgttcaagaccagcctggccaagatggtgaaaccccgtctactaaaaatacaaaaattagccgggcgtggtggcgggcacctgtaatcccagctacgtgggaggctgagccagagaactgcttgaacccaggaggcagaggttgcagtgaaccgagattgtgccactgcactctagcctgggtgacagagcgaggctccatccaaaacaaaacaaaacaaaaaagtggtctaataatccccagaactggaggaagaaccataacttattgattttgtttttaaccttatgtatgccaggcatgctagccttgtatacatacaaggctagaggagcaaaggtgcaggaagccatcttgagggagtcccatattattgagagaccggccagctgctgggagaggctagttgttcatcctcactgtatgtgatgagaatctggtgacagtccattgctgggcacagcatttaggcaaaatggctctctgctatgtcaggcaagtgaggcatatttttgcacaatcctagtaattccgaactcattgggaaacaatggcaattacatccaagcaaggaaaggtctgtggttgattttatctatacaaatttaaaacataatgtttacaacctttcattataggacacaatttttaaaaagatgccaaactatacaaataagttcagaaaagtgaggtactattgaaccgtctggaaaacataaatgtatgtgaaataatgcaatgcatagttttgcaggggactttgttcaaagtttctcgaaataccatggtccaaagtagactaacattagcattggttatttatgatgatcagtaagaatactaaatcaaaaatcaaaggaaaattaaactatgtctgtttaaagagaaacgtagtttacctcagactgagagttaaaacaagtttgtgattcaggaaggtggaattcagaacctaattgggcagcctccaacatttccattaaggtttggattcttaaaatttttcagtcttcggtatgctctggtagtctgatgaaacttacagattcttttcataaataagatacttaaagtaattcatagggttacaattgtattagaccaataatattaaaataattatcaaaccacttgaccgtaatatgtgtgtttttgttgatatacctaatagtacttcggaaataagcaagcacgatttccagattcttgcaacaactataacctacaaatttgttatttctatcagtcacacacaatggaagaaaattctaaatttcagctacaggataatgaatagatgaaaaacaacaacaacaacaacaacaaaaaaactcccctaatccatattctgggacaccttgattcctatttattgatcccttgaagtcagtggatag

SEQ ID NO: 15101 - DNA, 4393 bp, Human
ttttccttctgtcatcctgtttcagtataagcagaccacagatagaagtagtagatacctcagaaattcctggaataattaatccacgttcatctgtactccatctgctcctatctcatggaatataaaaggaaaaacaccaagatttccctaggcaatctgtcttgattttaggttcctcaacaggagagccagacaatggctgtaataatattgtcccggccaaggaaaaacttcccctttgccctcccaaggtttatggaaaattactggcaaaacacagattaactggagaaaaggcatatatatttatttcatcacaattttacaggagattttagaattaagactgaaagatacaggggaaattgcccatttttatgcttaggttcaacaagataaacagctgtatagggtacgatctaatgctaacagactgagtggggaagccccgcaaggcttgtctgtcaagattcttcttgacctctcagtgcagcatttcttccttctggttataggacaagactctcttttagaatggggggtcttatgacctacaggcaaacaaggtaggttagagtaatacttttaggttttatggctggttctagggaaaaggagttctggtttgtatggcctaccttgaggaggaattctggtttctatggctagactttggggagaatgggacttacagacaggaaggcagaaggtggtcagtgaaacacttttataatcataatcccattttgagtatttctgtgttatggaatgtttgttctctcatttcctgaaagattccagagactcctcattcagtgttgtgaaaaagttcaggaaatgcaactcaaaaatgtgccactttgttacgctgatttctttgaactgagggcacctaggaaacagtaaattcaaggaagggctttcgctgaactctaatcaaaaatttgaaaattaaaaaaaaattcaaaaaggaatttagttgttaagattcacttccctggggaatctcatcaaccagagaagattaactgtatcacaggagaggagactggtggttaacaccatctaaacagactttgtcacagctgtcacctattctttgaaacacccatttatttttctccaaaatcatatactctcccctaagttgcctacatcccccttctttctcccttatgaatcaagagagcttataagcttctacagttcactgggatttggggtattcgcttttcttccctcccactccccctcccctttttttgtctttgagacacagtcttctggctctgtcgcccacgctggagtgtggtggctctatgtgaactcactgcaacctcctcctctcgggttcaagcgatcctcccacctcagcttctcgagtaactggaactacaggcgtgcactaccaagcccggcttttttttttctttttctcccccgtttcttttttggttattttactggagacagggtttctccatgttgtccacgctggtctcgaacgcctgacccgccgtcctcggcctcccaaagtgctggtattacgggcatgagccactgcgcccgatttgaaggacctcttaaatatctatttagaaattggtcggagtccactcctttccaaaaacatgagtcacaatccgggaaaagcacgagcggctgaaagtcaaaataaccagaacaaaacctccactcatgcttaaaaaaggtattttgacaaaatcctaattcggccaattattattagtattcaagtcgaaggctcgtcaagccagactggggattgggtcaaacataaaccttacaccagacggaaggattacatgcaaatgaaggatgcagattctgatttcccattgggtatttgacattagccaatgggagaattcctcacagcctacctccagtcagtataaatacttctctgccttgcgttctaatgtagtttcattacattttcttgtggcgattttccctacttatcagaagtagttatgtctggtcgcggcaaacaaggcggtaaagctcgcgccaaggctaagactcggtcttctcgtgcaggtttgcagtttcctgtgggccgagtgcaccgcctgctccgcaaaggcaactactccgagcgcgtcggggctggcgcgccggtgtatctcgcggcggtgcttgagtacctgaccgccgagatcctggagctggcgggcaatgcggcccgcgacaacaagaagacccgcatcatcccgcgccacctgcaattggccatccgcaatgacgaggagcttaataaacttttggggcgtgtgaccatcgcgcagggtggcgttttgcctaatattcaggcggtgctgctgcctaagaaaactgagagccatcataaggccaagggaaagtgaagagttaacgcttcatgcactgctgtttttctgtcagcagacaaaatcagcctaacagcaaaggctcttttcagagccacctacgacttccattaaatgagctgttgtgctttggattatgccgcccataaagatgtttttgaggtgtttttaatggctttgagtgtggcacttttagtaatttgtcctgcagaaattagatccatagaaacctcaggaattctaggtatgtgggagaagtgccatgcagcacaaaacatgtttacaggggtgattcgcgttaagtttcacacacagcagttactacattttagaggaaggaaattatacccatgagtgcattcctaactatcttgaatggaagtgttaaaacccgcatgccccacacaagtttgaatatgtcataccatttgctgtagcaattaatggcatacacaattgagagcacacacattaccactgaacatttgagtatgtatttcccaaaatgagcttttttccagtttggggatgttttgctttgttttggggtggagtctccctctcgcccaagctgcagtgcagcggcgtgataacagctcactgtaacctcgaactcgggctcaagcgatcctcttgacagccttctgagtagctgggattacaggcgagagccgccacgcccggctaagagcatttttctaattgcccacacttcttatgcgacacccagaaaaatacaattttaaataaagcgcatatgcaaatttccctaatcgtctccaatattctctgatttcttttttatattttaactagaaacaattggaggtttccgcgttgctttgtgtggttgtaaattttaagacttcaggaaacttttccagtacaagacttgtccacagtggatatagcagctaaggggttaacaaaatgacgtcagagtagctacggtaatgggcaggagcctctcttaatctgcaaccaggcacagagatggaccaatccaagaagggcgcggggatttttgaattttcttgggtccaatagttggtggtctgactctataaaagaagagtagctctttcctttcctccacagacgtctctgcaggcaagcttttctgtggttttgccatggctcgtactaaacagacagctcggaaatccaccggcggtaaagcgccacgcaagcagctggctaccaaggctgctcgcaagagcgcgccggctaccggcggcgtgaaaaagcctcaccgttaccgcccgggcactgtggctctgcgcgagatccgccgctaccaaaagtcgaccgagttgctgattcggaagctgccgttccagcgcctggtgcgagaaatcgcccaagacttcaagaccgatcttcgcttccagagctctgcggtgatggcgctgcaggaggcttgtgaggcctacttggtagggctctttgaggacacaaacctttgcgccatccatgctaagcgagtgactattatgcccaaagacatccagctcgctcgccgcattcgcggagaaagagcgtaaatgtaaagtcactttttcatcagtcttaaaacccaaaggctcttttcagagccacccacttattccaacgaaagtagctgtgataattttttgttgtcttaacagaacaaatttctaaggacccccccggaaagcattagactatggtcttaaagttgattaacagaaataacggtttggtcagtcttgcagtgtaggttatttctgaccttattaaggtgctatttggagagaagctgtgtaagtccactatcattcaggcctctagcttgctatgattagcatttgtttaaacaactttgtaagagtaagggaaaaatctggtaagtagttaactggcgcttactaggcatttttgcaaagctttgaaaagattagaaaattgtgtcttgcgagttccagtgtcttcctcaaaatgcttaggaagattttctcagctcaatacatagtcccctaggttttctcatatattat

SEQ ID NO: 15102 - DNA, 5283 bp, Human
caccaacatggcacatgtatacatatgtaacaaaccggcacgttgtgcacatgtaccctagaacttgaagtataataaaataataataataataaaattaaaaaaagaaaggctttgcccacttaatgtttataaaggaacccactatgtttttttcttgtactgcatagttttattttttatacttaaatatctaatctacttgaagtttgttctattatcttgtttaaggcattaatccaatgtaatctttttcaaatgtcttcccaatcaattgttcaatcatcaggaaaactgaggaacaaaagtcaccagaaaccaacatcaaagaaaaaaaagctattcttcagtagtttaaggaggtgcagactttctcaagactgtgataaagggaagtaacactgcttaattatctgaccaggtatgcaatgccaagtgccagacaattttattgagctgaacttgaagaacatttaaaccatgtaaactacagagagaatatggagaaaaaccactgatttcagagcaagaacatgtatactttctatgcttgagttgataaagtttcccctcatccacaaatgctacaaaactaaaatcttagtcttctcttatttttttcttttcaagttcaaacctttattaatgttcttaaggtactctaattttttaaaaaatttacaaacagtaaaattcactctttagggtatacagtttataagcttcaaaaatgcatagaattatgtaaccatttccataatcaagaaacagaacagtctcataatctccaaaaaattctctcaagctactcctccccaaaccagaatacccagaaaacctggcaaccattgatctgttcttcatccctacagtttttccttttctaaacattatatgtcatataaatggaatcctactgctacagtatgaatgtttgtgtcctcccaaaattcatatgttgaaacctaatccccaatgttgtagtattaagagatggggacttaagggaggtgactaagtcatgacagtggagcccttgtgaatgagattagtgtccttataaaaaaggcctaagagagattgtttgccccttccattgtatgaagacatatagaaggtgccatctatgaggaacaggctcttaccagacacaaaatctgttgacaccttgatcttggacttcccagcctccagaactgtaagcaataaatttctgttgtttataaattacccagtttaaggtattacattatagccacccaaatgggccaagacacctactttatgtaacctttttagtttggcttctttcactcagcataatgcacctgagattcatccatgttgttatgtgtagaaataatctgttctttttattgctaagcagtactccatgagatggatgtactaccatttgtaccaaaggttatttggaatatttccagttttcagtgattataaacacttgcacacagattttcagcatacagatcctgcctgtattttgttaaatatataccaaaacatttctttcttcagggagacggtgctatagtaaatggtactgttttctcactgctagtatagaagattttttttctgtattctgttaacttgctaaactcacttattatttctagaagcttttgtagatgccttaaagttttgtatgtagacaatcatatcatctgcaaaagtgatcattttatttgttccttatctatccacagatgctcttcgacttacagtagcattatgtcccaatagatccattgaaattgaaaatactgtaagacaaaaatgcatttaatacacctaacctactgaagatcatagcttagcctagcctaccttaaatgtgctcagaacacttacattagcctacagttgggcaaaatcatctaaaacaaagcccattttacaataaagtgttgaatagctcaagtcatttgttaaataccatacattatgccaaaatggagataatgggaccttgagccctcaggaacgagatggcggttctccggaggctgagtgccctttacggtgcccaaggaggccgagctctgttgctgcgaaccccagtgatcagacctgctcatatctcagcatttcttcaggaccgacctatcccagaatggtgtggagtgcagcacttacacttgtcaccgagccaccatcctggctccaaggctgcgtctctccactggactagcgagagggttgtcagtgttttgctcctgggtctgcttccggctgcttatttgaatccttgctctgcgatggactattccctggctgcaaccctcactcttcctggtcactggggccttagacaagttgttactatgttcatggggatgcctcgcagaaagctaccaaggcagggcttttggcactttcagctttaacctttactgggctttgctatttcaactatcacgatgtgggcatctgcaaagctgttgccatgctgtggaagctctgaccttttttacttcatactttgaagaattgatgtatgcctctttgcctctgctttgtcatgccattaagcccacaataacgaagaaataacaggtaagtccattggtggatagccttcttctcttaatcacaagattattttcagaacttagtctttgaggaaaacgtttgagaggagttacatctaagttgtgagactgagttctgtattctggtgagttaacggggttgcctcccagcttcttataagactcacagtataactaaacatgatatatgagcttttgccttttaatttatcaatctcttaaagagaatccagctttattactattagtatatgatcaaacttccatatttgccctgggaataatggacaaagggaaatactcttaattcatgaataaaaactttgcagaaaattagacggtgtttaatttttgaaaacttccctctgtagtcagtagataccacctactgatggctacatatactagggaaattttaaaattaggaaatgctgttatctcacattataaatttctaaatcctaggaagaaatgcttggaatacttctgaatatagagaagttccatttaagggcaagtttccccttgtatacatatcaaaatattaccaattgtaaactgagatttaattctcaaatgtgttctacttgttctaaaacaatctgtccacagatataaaactataagtaataaattgttattttcgcacaatgggaatctctaatgtgaaaatgtattctatgaaaataatttgtttaaataaagcgttgtataataaaaaatggagataatgggtttcataccattgtaaagtagaaaaattatagatcaaaccaccataaatcagggatatctgtatatgccttctatttatttttcttgccttattgcattgaaaaaaaaccttcccgtatgacactgaataggagtaatgagagtggatatctttgtcttgttcccaatattaggcaaacattctttcaccatgaagtggatgttaactgcagattttcttgaagatgccttttgttaggttaaggaattaccatctgttctttggtgactgagagttttcatcatgaatggatgttgaattttatccaatgattcatcttcatctatttatttgatcatacggtttttcttctttaagttgtttatatgatgaatcacattgacttttgaatgttgaatctaccttgcattcataatataacctggtcatgttatattaccctaattatgtattgctggattagatattgcttatattttattgatgatcttgcatctgtgttcatgaggaatgttgatctataggtttctttactcataatgtctccgtctggttttataatagggtaatattggcctcatagaataagttggaaagaatgtcatgctcttctattttctagaagagattgtaaagaattgttttctttcttaaatgtttggtagaattcaccagtgaaacaatctgggcctaaaatattttcttttctttttttttttttttttcctgaggcaagatctggctctatcacccagtctggagtgcagtggcacaatctcagctcacttcaacctctgcctgtccagctcaagccatcctcccacctcagcctcccaaccaagtagctgggactacaggcacccaccaccatccctggctaatttttgtatattttgtagagacagggtttaccatgttgcccaggctggtcttgaacttgatccacctgccttagtccccccaaagttttgggattacaggaatgagccaccacacccagccaaattttttttctttgaaaggtctttttaatacaaattcaatttcaatttctttaaaagataagggactattcgtgttatctatttcttcttgaaggaattttggtaatttgtgtcttctgagtatgtcatttaatctaagttgttgaatttacagacttggagttgttgataatcctcccttattattcttttaatatcagtggaacctataggtgacatttcctctttcattctaatgttagcctatagttaggcaaaattagcctgcagtcaagtaatttatgtcttctctaaggtttttcctggtcactttatgttaagaactgtgaagggttggagattttaccctacttgcaaactaagaaattaggctgccagttttgtagattctggtggaagacacatgactcctaagtcagagacaaagtttagtttagtgcttacagcagtagcagcagccagccagcgtgtcaagatttttgcaccagttccctgggcacacattcccacaggtcaacacaaagaggtctagatgatacctgaaactgcagtggcttgtactgcaggaaaggaacactaaacttagagcaccagaatcttttatattgagagtaagctttccttgctccagagtgagacactatctccatcttccagggatgtttatagacattattggggggaaaaatagtccagaacaaagggtagtcagtgtcttactcaaaaaacatgtagaaaagtgagagatccataaagagttgtttcccaacactctggttagaaattgattgattatattgatcatttcaaagaaccagctttcatttgattgctattcactgattttctctatttttatgtttacaatttcattgatttctgctcttaattttattcttttcttccttctgtttaatgtgggtttagtttattctcctttttctagtttcttaaagcagaggcttag

SEQ ID NO: 15103 - DNA, 4815 bp, Human
ccaaaaaacaaacaaacaaaaaaacccaattgaaattataaaatatgttcaacatcattagtcatcagggaaaatggaaatcaaaaccacaagagagtatttcacacccagcaggatggctacaacacactgataatcacaagcgttgaggaagatgtggagaaactggagcccctatacattgctggtgggaatgtaaaatggtgcagtagctttggaaaggagcttcgcagttcctcaaaaggtaccatagcactcagcaattccattcccagttatatacccaagagaaatgaagatatttgtccacacaaaaacatgtatgcaaatgtttgtggcagcattattcatcatagccaaaaatggaaacaactgttcatcaactgatgaatagataaagtgtggtatagtcatacagtgcaagattacttggcaacaaaaagtaagaggtattgatacacgctacagcatagatgaaccattaaaatattatgctaagtgaaagaagccagtcacaaaaaactacatattgtatgagtttatggaaataaaatgtaaagaataagctaatcttcagagacagaaagtagactggtggttgccaggagctggggtgaaaggagaagtgggaagtgactgctaatgggtatggggtttcttttccgggtaataaaaatattctaaaattgatcatggtgatagtagtacagctctgtgaatatactaaaagccattgaattatacactttaaattggtgaactgtacggtatgtgaattaaatctcaatacagctaaaataaataatgaatctctacttatcttcatttgtaaatttcaccaaactactaacttttaattgtagaagtttaaacacaaagaatgtagagatatttacagcatgtataacagagaatgggaaatatactttaataaggaactcttccaaatcaaataaacaaatataaagaaataagaaaaagatgtacagcacggtaaaaaactaggcaaaggacacaatatgcaagagaagtacagatgaacagaaaattcagaaaagcatgggatggtgaaaaggggagacattgattaaagggtacaaatattcagttatcagacctaatgttcagcattgtgactacagttaataataatgtattgttagccaggcccagtggtgcacacctgtagtcccagctactcgggagtctgaggcaggaggattgcttcaacccaggagtttaagcccagcctgggcaatatagtgagactccatctataaaataatggtaataataatgcatagtatacttgaaatttgataagagagtaaatctcaattgttctcagcatacaaaaaaagtaactatgtgaggtgatagatatgtaaattaacttgattgtactaatcatttcacaatgtgtccgtatattgaaacatcactttgtacaccctaaatatataaatatatataatttttatttatcaatcatacctcagtaaagctgggaaaaaacaaacttctagagattggttggttgtataacaacgtgaatatactttagcactattgaactatatacacttaatgatgatcaacatgctaaattttatgtgtattttgccagagttaaaaatttttgaaaagagaaaagtgtcaaatttattaacacctaaagaaatgctagcggaaaggttaactggttcagcctttttggatgtcatattagtaacatgttaagataatttttaaaattcatccttttggtggaataattttatatctagaaaataacaaggaaaaagaatatgtgcaaacatactcactatggcattatttataatgacaaaaattgccgacagccaaatgtatgacaataaggaaatagttacatatattagaacgtatatatgccttgaaatattgtgcaaccacttaaattgtgtttttaaaaatgactaaattattctagaaaatatgatattaagaaacgagaaaaggctttgcagacgccgccgccgaggaaaaccgtgtgctattagccatggtcaaccccaccatgttcttcgacattgccgtcgacggtgagcccttgggccgcgtctcctttgaggtaaggggcctggaaaccaagaagtgactgctcatctaatccataaagctatgttaacagattggagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtcaccactgggagaaatttgaagatgagaacttcatcctaaagcatacaggtcctgaaatcttgtccatggcaaatgctggacccaacacaaatggttcccagtttttcatctgcactgccaagactgagtggttggatggcaagcatgtggtctttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgcttgcagtatcccagtatctttgtgctcttgctgcagttccctttgggttccatgttttccttgttccctcccatgcctagctggattgcagagttaagtttatgattatgaaataaaaactaaataacaacaacaacaaaaagaaacgagaaaaaactcactgcatatatatagaatgacaccaattttgtggcaaataagccatacatatagaaaaaaataccaaaaatcatggtagggttaccaatgttttcaattttttttttgcttgaaacttctctgaatgtcctaaaaggtcgacaggactatgtgtccccccttccctttttttggtatgccttttaaatcataataaaggtacatgtttaatttaaaacagagaaattcagaacacaagccactttcaacttcatctaagagcctattctatcagatacataacaggaaacggagaccaaatatttatctccaatattgaaataaagcatagtagttccatattttattgttcaaatataagaaaactcaggagaatcatgtaataaacattttctagttttgctaataatctcgatggaaggaaaagagccaggtcccgtcactggcccatcagtgatgggagggtagctatggtcctgttgaaaggctgccctgatgttttgttggtttctgtaaacatctggctcttgaaatcctaattattcaggatgtaaaagttttgagaattatagtcatcagaatttccaaaaaagttgtaatgtttattgaagggcagaggaagcttccctccctacctccatgtattcatctaaagctgtgatatcagcaaaggattttgggtggccagcctgaatgtcagtcaaaactccacggatatagggataacacaagggcagtcagggccaggtgtttatattgaaatgagccaaggaaggaaaagcagcattcagtctgttaagctgtgtgaattgaagctttcctgcaactgccagagtgggatttcgatctctcattagaataagtaagaataagtaagaaaaccttttaaagtgagaactgctttaaaaactactgtattgctcaaatatgaatctagtgtgagtgagtctttttcattctacgggctttgtttttcaggccagcttattggagttgcagaaatatttttgttaagctgaaggtcgccactggcacggttttaggcatatcccttcacttcactgagcctgaatgtccccgtttccaatgtgagagtgctttcaagttttaaaattatagaattcactgaaacaagcatgtttattcactcctctctgtgccgccatactgctcgcatgagtatataaatatatatcactttaagtaactactttaggatcagggtcttatttataccaaaggtctttgcatgtaaaagccagttggctcaaccaaatggccaagaaaagatgtccccttctctccctaacctccatgtatcttctcataccagatggtacaatctctgaaattccatcttcagagggttattatttagggttaagtttgatcctttttttggtcactaatgcttcatggtgaatggaggttgggaatattgctctgcgataagactgcctaggtttgaatcctaaattctacttagttgtgaggccttcggcaggatatttaatcaatctatcctttagtgtcctcattcataaaatgggaataatttttgttccactgtcatagggctgttataagatttaaatagatgaaacatgtaaattctcagtaaacattcattcctacttcatctggtgggagaatttcaaagccaagtgaacacctcaggccaagatgtgaaaaggtcccagaatggaaatcgtgacagaatgctagtgatataaacctcacctactgcatatattagcttaggcctggggtgcacactactgagactcacatatttttggagaaaggtttaacattattttctctatttcatgaactacttccttctcatccccaacttccttttataattggcctctcaacattttctatcactccttatgagataatgagaaacaatgggcttaactttcctctctcagctgtcgtgcatcctatctataggttgcaaagat

SEQ ID NO: 15104 - DNA, 33908 bp, Human
  misc_feature (1)...(33908): n = A,T,C or G
gagatgaggtctcactatgtttccctggctggtctcaaactcctgggctcaagcagttctcccatctttgcctcccaaagtgctaggattataggcagtgagccacgggtcggaccagaaataacttttaatgcatcattaattaagtgtattaagagactatcaagactgaaattgatctttaatgtcttaaacgtctgagtggtaatacctgtttcttggtattttgaatgttttgagatgcttgggtggtggggagtaccattttattcaggaattattggagaggtttatgatgtaatctaagcgttggggttttggagagttcttggagggggaggtgagcatggcactgtccgtggtgctgaatcagattgcttgctggttcggatggcagaaaggctctgaaattgtgaaggccacacacacaactacctggctgttaaaaagcacatctcctgtatgcagttgagattcttaatttctgttggtgtccagtgcaccagggaaagccgactgtgtaggcaaccgtggggccagcattagttgcagtgagctattctaatatggggaaaaacaaattgatttaaatgggatgtgtgaacctaggtaaaacctaaaagtcctgctgtgattattctgcttgtagaataaccacctgtgtgagtgtgagaaatttatgctttaaaattaatgaaaagtgattggaatgttgttgtaatttacaccttatttaccagtggtaacttaaaatgttttgaatccgaacttgagttatatgtgtttttcagcccaagcatttagcatgcatttagagtggtaaaacaattttatcctttcctaaacactttcccggatctttacataattatacaggaattgtccactgacaccttgagggtgatgatttgatgttttaagacactggcatgggtgggtgatcccagcactttgggaggccaaggcaggtggatcacttgaggccaggagttcgagaccagttgaccgacatggtgaaaccacatctctactaaaaatacaaaattagctgggcgtggtggcacatgcttctaatcccagctactcaggaggctgaggcaggagaatagtttgaactggaaaggcagaggtagcagtgagctgagattgcgccactgcactccaggctgggggacagagcgagactctgtctcagaaaaaaaaaaaaaagatgcatgtgttcatgatgaaaacgtttaaaatatttgttttaatgtataccatttgcatatgttcagtaatcttcacaacaaaattggctgtagaattgttttaattactaggaaacctatagtaaaataatgactttgcatgattagataaaggttctttacgctgattagctattgtaaagtaagaactacctaaggatttttttttttttttttaatttgagactgagtctcaccctgtcggccaggctggagtgcagtggcatgatcttggctcactgcagcctccgcctcctgagttcaagtgattttcattcctcagcctgccaaatagttgggattgcgggcatgcgccaccacacccagctaatttttgcatttctagtagagacggggtttcaccatgttggccagcctggtctcgaactcctggcctcaggtgatctgtccgccttggcctctcaaaatgctaggattacaggtatgagccaccatgtctggcctacataagagattttatataaaaagttttgtgcagaatatcattgcaaataaagcaaattatagtgtggtatagcatgttttcaaattccatttagtgtttcgaaacagcgaaagtttgtatgtagtaaacattagtataaatattttttggattagaatgaatctttattgtggtacaattggaatttattaatgattaggcaacatcaaaagtataagtttatattttgcttattctattaaagccatgaatgtaaaacccgtggaatttctttttcttctttaaagcgggagatacagatgacccaccaagaattactcagaaccctgtgatcaatgggaatgtggccctgagtgatggacacaacaccgcggaggaggacatggaggatggtaagtgcctgtggttcaccgcctcgcagtgggcggaaacttgtcagaaaacaggttcagatccatgcttggtacttcttgggtacatccttgggtacttctgagcgtagctagttttcaggaggctgtaactgaggaaaatcctgtttgggttttgagtttcaagattgcctacaccattgccaggtaagtagagtctccctagcctaggcaaggaggtgtaatgtaggtttaaatttaataggtgggtatttactcctgcctgcaggtctccagccactgctagtattgggaacaacaagcatgtcttactctccttcttgtttgtttgcagcaagatacgtgcagacattggaacttggctttccattgcattctcattgcagggtgtatatcagttgatgatagctatgaatccctccccgctcctgttagggatgaaatcagattcaagctttggccttcattctccctcactgagttttggtctatagcttctctgtgagaaagcatactcatatgtatgtgcatggacattttttgtgtaggaaatcagtttttttcttccgagaccattccttctttaaatttatcaaattagtgacctcaatatttgcacagtcacacttgtgagtagggagcagccagtaattgcagtatgcagcccctggagtcttgagtgtaatatgaaaccatgttctgtcaaaaagcatgtccatcaatcctcatgagggttgtgtccttcccaggggagtaacggggcagttgaaagaaaccatcagtcacgggctgcaccaccagaaggactgctgttcagacctcctgccaaaagttcagcctccatgagaaactgcagccgtagttgagagttctctcacagtgcggtttacccctggcagctggctgaggcaatatctgaggaaggtaaagaggcgtggtctaaacccgctgctttgttacctgtggagtgcgctttccaccgtagacgagggcaatggtgtgggtgtggtctcgctggttgttgggcttttggaggttttactttagacatctgagatgccgaaagcggttgagtgagtgcatttgggaaggcatggccagctctgaggcgctaggtgtgcgtttgggatcaattctagccacttgtgtagcagtgacaggccctgccctatcggaacattccgggtctagttcccacagagcaatctgttccaacatttccctactgtttttttctttttttttttaggggggaggtcttgggaggagacatagatatagggcggagcttcttagcttctcatggcaacttggataattcttggttgtgggaggctgtcctgtgcattccaggatgcccatggctgctgccctccacttgcggtcatgacatgtctctagacattgccaggtgtctcctggggagaatgacttatgaggggacaatatgggtaaagtccccttccttttgaggtacatttcactaaattagtagacagtggtgccacgccataggacccgaaagtggaaatgcccttcttgtgacctccttgatggaaaaagcgtataatccgagaaggttgagtaatcttccgtagcacctttccttggtttggaactgtggttgccgttgaaagacccagcatgtaatatctttctgatggcaaagtgcgtgggagggaggtggtcctgactgtaggagaagaacttgtagctgagggcagcgttttccagctgcagtacaaattgcgcaatcctcttcttcaggggataagtgtgttgtgaaaaatgcacaggattctaggaagttggatatgtgctgggctaaacaagctttatttactgtcgtatgtctcagggttgtcatatcagaagcagcataaattgcttatccaaaataagtttttgttaatgattccctaagactctggacttcagagctccccctttttttgagtgtcctgtgtccttgagtgttgagtgtccatttcagactagggcacacaatctgggaagcacctcattagaagtttggtctgtagccaaactatcagcgacttgactgatttgcacagaagacttcttagtaagggacatttcttgtgtaagatgctaaatagctaatgagacaaagagatgggagacatgtatagttgagggagagaacttatttaaaaatcctgttaacatagaatttcgggcaagtatcagaattatcttttactgtatctactcattctacttttagttccttattcactatttttcatgagatgaccaaggaagtaccgccatgtgtggctaattgtttgtagtgatgggatgtcactatgttacccaggctggtcttgaacttcttggctcaagcagttcttctgccttggcctcccaatgtgttgggattataggcatgacccattgcacttggcccaaggaagttttattttattttattttgagataggttcttgttgtgtcgcccaggctagagtacagtggcaagatctcagctcactgcaacctccacctcctgggtttttgcgattcttctgcctcagcctcccgagtagctgggattacaggcaaatgccaccacgcctggctaatttttgtatttttagtagagacgaggtttcaccatgttggccaggctggtcttgaacacctgacctcaggtgatccacctgccttggcttcccaaagtactgggactacaagtgtgagccaccaaggaagttttagagcaaatacggcctctgaagatctagatggatctagatttagaatgttgttctccatgaaactaatttgtggggattgactaggacttgcaagaagttgtattagaatgaagagcagaagtttgctaaaatcactgcaacagcaccatttggagaaatttcataccaacctttctgattcaaaaatctgaagtattctgtttttctttaactttctttctttttttttttctttttctttttttctttttggccaggctggagtgcagtggcgcaatctcggttcacctcaccctctgcctcccgggttcaagcgattctcctgcctcagcctcccaggcagctgggactacaggcgcttgccaccacgcctggctaattttttgtatttttagtagagccggggtttcactatgttggccaggctgctggtctcgcactcctgacctcatgattcgcctcgcccaccccggcctcccagagtgctgggattacaggcgtgagccactgcgcccggcctacctttctttttgcaactgaagcccaggctggtctattggcctttgccctgggaggataaaattgctgtaacaaagtgcccagtgggaacttcgtgctgtaggtaattgtccctgcccctggtacaagagtctccaggggccagattggaaggtagtgagagttatcaaggaatctggttgaggatttgtggtgacaccagtttgtagaagtttgttgctttgtcatttacagtaaaaagaagcatgcggtaatgaaatggtggtctgctaatgttagtggcatccaggcagattggagtctttgtgcatgaagtgctaattttgcagtgaatgtgggtgtccttgctaatacctagcatacttggaagttgcaaaaaaataatacataggatccagtgtactgttaactattttcttgggcaaagatctccatcactgagtctcatgtaattcctcgtaggaggacaatctggctggccgtatctgtgaaagctaatttccaagtccacttctccttttttttggccctcctatcttgaatttttttggagaccagagttttttgctcttgttgcccaggctggagtgcaatgccatgatctcagctcagtgcaacctccacctcccaggttcaagcgattctcctgcctcgacctcccaagtagctgggattacaggcgtgcaccaccacacccagctaattttttttatttttagtagagacggggtttcaccatgttgggcaggctggtctcaaactcctgacctcaggttatccgcccgcctctgcctcccaaagtgctgggattacaggcgcgaaccaccgcgcccggccgaccttttgttttttagtgaaattttcttttttttttttttgagacggagtctcgctctgtcgcccaggctagagtgcagtggcgcgatctcagctcactgcaagcttcgcctcccgggttcacgccattctcctgcctcagcctccctagtagctgggactacaggcgccagcctctgcacccggctaattttttgtagttttggtagagatggagtttgaccgtgttagccaggatggtctcgatctcctgacctcgtgatccacccgcctctgcctcccaaagtgctgtgattacaggagtgagccaccgcacctggcctagtaaaagttttcaattattctgctagtatgaagagttttcaggaagtgaggtgaaattttaatacacccgaagtgtcatctaaactttgtgcttgcagatttgataagtctgttctaagaaatgtgccttgagtgtgaggctgaaatcgagtgtgcagtgcactaattgtgaactaaccactgtgtgtcagggcagtgccacactcgggggcacagagacggatgcgcggtggcctctgcggggctgggcagcaggtgaaccaagtgcaaacttcaattctgagtctcaccattgtttgggtctttttaatgtttaaggagtaccttggaaaatttaatgtatagggtgaaagttccaaaagcacttacaatatgtattgattttgtatacataaaatcaaaccctgtaaagagctgaattatataaaatagatgggttggaaaagaggcataaccttgtttctttcagctttttaggtcctgcagtgattttccatttggttgcttctgtgcagttctgtatacatgggcttcataaagcgggcaagctagtagtctcattttgttgaggcctgcgttttgtgtgtgttatggtaacttccaggagtggaattttaaaaaccagagtcaggtcactgtgcatagtgtcttgacaaatcttggatattaaaatcctctattgtcactttgtaaaacagcctcggcgaacctccatttcctcacctaaaatgtgggaattgacatctgtctcttgtctaccttgcagaacttaactcctgatcagctgtgaattgcatgatcctaaaagcacatggcaaaacttattccaccacgccattctagacgttattatcttaaacaagtttcttgccttttagtagacttctatcctcaaaaggattaggggaataccacttgaagaggctcaaataaataattattttggacaagatgcgcctctttcagctgctcttccttccaaagttcctgtgctgtaagcaactcagcagggttatgtgaaataaaataatttgggatgaagagtgtctcaaagaaggtagaagtgcttaccgtcacacatgcttttgatatttcaatactaccctcccaggaggactgatggacatgttttcttaagaccaaactcagtcagaaacttcaagcaaattctcttccctgagaagtggctgatgctgagaactcagttgttagtgaactttggagtctgaagggttgttggatgacatggtgactgccttcaggggcctgaagatgaaggatgggaggatgttcttaggcactctttacccaagcctacaagtctcattttgtgccttaggagcctggtggtcagggatgtcaaaatagcacctgattctaagccgggaacagccttccaggcactgcctgtagagcttggcccttggtgtggccctgggactcctgccagtcagtgagctgtgtgcagactataatgagataggtacagaaagtgaaaggaagcgtttagaagcttgtgtagcatgttgactttgctgtggcaatttcatgatgctttataaaagtattggtcaataacagattggtgtgggtgtgggaggactgtgccttcgcaggagtcgtttgggaagcagtaagatgctgcagggtttgtcaaaggtgattgaccgatggccacatgcaaatgaatagtcactgtcatcagtgaaagattgaattttaaatggagaccttcagttggacctctgctaagaggcactgtgttgtcagaaacttaaatatcttaaatcagcctttggtcttgttatcatttaacaatttatactactcatgtgggaaaaaataccagttcttaaaaaaaaaattattccccctagggtgtccaggctagtatttttgcaaaaatcgtgaaccaatgaggttagcatttattatcaggctactgttgtagcccttgtcttgcctctgagcagtgctgagcttccaggggaatggctgtttccctggctctcaagtcctgcctgtgtgttccgtgctctgtaaagtcagcccaagtcccatgtcgtggtctttacccccagaagtcccgtccttgaacagatatgagccatgtcgttccttctctccaaggtctctccactcacttggtgcctggggtccttgggaattcagctttagtaaagtagacattgttctcatgtggaactcagtctgacagggatggcaagtgtatggttagcactctgagttttggacttcataaggaagaattaatccattcagaaactgtatgttatctcagtcttcgggttttaataaattggaagcaattttttcaaactgttaggttttagcagttaaatcaggatgtatagaacagtttactccatgtcgattaatgctagtgcttttggtcaatgcacaggctctgtgactgatgatgtgttttttttgcagacaccagttggcgctccgaggcaacctttcagttcactgtggagcgcttcagcagactgagtgagtcggtccttagccctccgtgttttgtgcgaaatctgccatggaagattatggtgatgccacgcttttatccagacagaccacaccaaaaaagcgtaggattctttctccagtgcaatgctgaatctgattccacgtaagacagtttaaatgatgcaactacaaacccccacatcgttgtatttcattactggaagccaaatttgatcagcctagtgcaattttatcttaagttatttgctgcctctacatagccttttgattttaaattagattaaatacgtgtttctctttaaaacccactggtatatgtataatatccaagctagaaaagtatatttttatcttgtaagtgaaaaaactaaaaatagtttgttagaatctaccagcccatggaatcagggccggcctggattagctgaccattgagccaccaggcttaattcttactctgtcagtaactgtctgagcagaaaatggcagctgtcagagccagacatcctttccattgtgtgatagctaatttgtacgggttgttcagaaagtacaagtaaaacatactttgtgaaggatttatacaacatggccctctgacttgaggaacatttaaacattcatgtatattatgaaatgtccaaaaactgagaaatcttgatggtccttctatttagatgaattagaaaattaattcaccctttatcaaaaacccagttgattctgggagtacggaccactttgtcaacctgtctgcagttggaaccaggggaagctgctgacttggactgcacctgtcctagtctccctgccacgccacagagtggccctttggaaccctcagtaacatgttccccagagtgaactgactctggctgttctgtcagatcccccagggaataaaatttacagagtctcactctgtcgccaggctggagtgcagtggcctgatcttggctcaccacaacctccacctcccgggttcaagcgattctcctgcctcggcgtctcaagtagctgggactataggcgagtgccaccacacccagctaattttgtatttttcatagggacggggtttcaccatgttggccaggctggtctcgaactcctgacctcaggtgatctgcctgtctcggcctgccaaagtgctgggattacaggcgtgagccagcgcacctggccgtactttcattttctttaatgtttaaggtaattttatgatgcagccagggcctgtggatggttaaagttgtcctcttctgttcacattatgatgtgatctgatgagtatttgggctaggtttgttttagtccgatggacaactttagcctgaagcactttggaaaagtagtgaatggtccatacccagtgtcagcgtcccgagcaagcaggaagtgctgtgggaacagcactgtcctacccttgtcctgaagagtcaaaccatttcagggctcagttgcagctttgattgataaggccccactttaatcgcaaaccttaactttctttggcttaagtgctgtatgtatggtttttgaacctggatctagaggcccttttgtggtccaccccacacttcactgcaggtacagtagttctcttgtggttgtaattttgtgcctcatcgtgaattcgtcgatgccggggcaggacagcaagctctaaggccacagagctccccggtgctggttttcccccagcatgtgctggagggcatcctaggagagctcgagaggcatggcactgaagggctgtaggggcaggagcaacgctgagaggtgacccctatatcggcagtagaagcagaggtcaaaattgtatagatacaatgaaagaaaatttgtttcaacttctaaggaattaaaaaatgaaaccatgagtgaaatcactacagaatacactgggggagccccaaacacccatttctctattaaaggtaaaaatgcctccatcctacctttaaccccaacccgaaaggagagagcagtgaaaacataaatgggaattttggtgtgctatgtttactgtctttaaaaatgtataacatctggtaaataatgtcaactaaggctcagattattcttttaaacaggtcatggtcttgccatgcacaagcagtgctgaagataataaattacagagatgatgaaaagtcgttcagtcgtcgtattagtcatttgttcttccataaagaaaatgattggggattttccaattttatggcctggagtgtaagtaacagtgtatttagtctgaacaattggtgcattactgcttgttgttcccttaactttttgatttttcaagtcctttattcattttagagtcagatttttactttctaaattggacaagtgtctttgaaaacatgttttctccagtttcgtatcttacgtttttagcagctttctggattcacgtctcactttttagtcagactttcaaagggagttcccagtgggctaaatttcctttaaaagacataatgctgtttgaggtcctttcatgattcaggcatagtactgagtggttccatgtgactccagtaatcattcagttcactttggctgctttttgcagaggtggtaaccagtggaacaatcttaggaatgttacttcttactatgctaagtcacttatcattgcattctccagcccctcccctgcttagaggggcacagatttctcctgtccatgctgtggcactgagcccctgggtacctctgggatacctctgaggtgccaagcatttgctgtatttgttgtgagaccactgttaaaagaaaattgaaacagtctaaaattagcaacaaagttgggatgtatttaaaaaaaaagtattttcatctctattaagtatagggcactaatgtaatttgtctcttgggaataaagtgtgtgttcttattcaagctggatattcttatttatgttttataggaagtgaccgatcctgagaaaggatttatagatgatgacaaagttacctttgaagtctttgtacaggcggatgctccccatggagttgcgtaagtttttctttaatcaggtgctgttaaaaatgtcttttgtgctgcagtgaaagaagctttagcgtgcatgtaatagagatgcacatatttaatcagtaagcctcctctctgcgcttgccctgtggcacacagagtcacacctgcttgacactcgtttaacagattgattgagcagtttctatatgttagacccttggaacataattgtataattatggcaactagacagctgtggttttctgttcctaaagaatgtacactcagctttcatagaggagctaagaccggtacataaatacccagagcagagatgctccgttgttactttgatgagggcagggaggaagtcctctccgagtgtgaggaaggggggactgggggaagaggtgagcatcaccgacaactaacatggtgagcgaggagtaaagaggggtgacaaggccgttaggtgtatttgagtgtttccaaggctgggagctaacccctggagtggcaaggtgctggtgaatggtactgcgcagtaggtgtctcccccagcactggtcccgcttggtgacggtcgtgtgttcaggtcgtggcattgtgtacagagggagatgggcgtggaggtgggaggattgctttgctttctggcaccgttctctgtggcttccttttactacttggggtgggggtgggaaggtacgagacacagttaattctgagaatcttatcttgctcccaaacaaccaccaaaatcacaaaataaaaaaagctctgggagtttagaagtctgaggtgaaacttggtgaatacacactcctgtttcttcttgtgtgtgtgtctacagaaaagatgagtttcagctttttccacgttgtgctgaccttgcgtgtgataagtgtaattatgtaaccaaactctaccatgaggcatgttgggtgtgagcatgcaggtctccgttaagtgtctgttggtgctgggcttgatcagtgacaggagtgccactgtcagcaggcaggtgcttcgagggctgtgcgaatgtgggggttgcatttgcaccagttcacacactggagcaagcagaagggaatcggtgaccattgaaggatgctgtgtgataagtgttcctggcctcggtttccttaaggctgaccttgagtcagattgcttcacacacactgcaggagcaatggggtatctgcaagatcccctcaaccttgaactgatctttcaggtgggattcaaagaagcacacaggctacgtcggcttaaagaatcagggagcgacttgttacatgaacagcctgctacagacgttatttttcacgaatcagctacgaaaggtaaatggatagtgttcctctcctgcagccttccgctcaccctttcttctcaggtatatcagagcaaagtcctctcaacaaacatggcgtctccctcccctggccctgtctcctcagatggctgctagttcatgctgcgttttcattccccagtgctgggacacctactttgtaacctgcctcagtgattcagagttaccatcgccaacctttttctttattgagatggagtcttgctctgtcgcccaggctggagtgcaatggtgtgaccttggctcactgcagcctctgtctcctgggttcaagtgattctctggcctcagcctcctgagtagctgggattacaggcacccgccaccacggccagctaatttttatattttagtagaggcggggtttcaccatgttgtccaggctggtctcgaactcctgaccccaagctatccacctgcctcagcttcccaaggggctcagattataggcatgatccaccatgcccagccatgacctaattttgcagacttaaaattgtgttagaaatcaccttgtgaaggtatttagaaaaacatataatccattaacagcaacatttgcaaagttttatataaaaactgagttgaaaagtcaatgcaacttacttttattgaaaattttaacaaaaagaatagacatacattaaatctaatatagatgagttagttctattttgagaattacttgtgattattatgaagcagtacaggaaatcggcactcctggttgtggggtgggcagggagctggctggcttgtcatccttcaaggcatgtttgcacagccacccagacaggttgtcgtgatatatcccagggacagctcagtatgggtaattctagtcacatttaagtttttaatcaaatctttgtttcacaagtaatggtaagttaagaaatggtgctccatggctgggcgcagtggctcatgcctgtaattccagcactttgggaggccgaggcgggcggatcatgaggtcagcagatcgagaccatcctggctaacatggtgaaaccccgtctctagtaaaaatacaaaaaaattatctgggcatggcggcgtgcacctgtagccccagctactggggaggctgaggcaggagaatggcgtggacctgggaggcggagattgcagtgagccaagatcacgccactgcattccagcctgggtgacagagcaagactccgtctcaaaaacaaaacaaaacaaaaaaagaaatggtgctccaataagtaggaaataaaagtagttctctgggggctgattttgttttttgtttactttttctgtattatctttttatcaagaacatatgggtgaggctgggtgcggtagctctcgcctataatcccagcactttgggaggccaaggtgggcagatcccctgaggtcaggagtttcagtccagtctggccaaaatggcaaaaccctgtctctcctgaaaattcataaattagcctggcgtggtggtgcgtgcctgtaattccagctactcgggaggctgaggcaggagaattgcctgaacccaggaggcggaggttgtagtgagctgaggtcgcgccactgcacttcagcctggccaacagagtgagacttcgtgtcacgtgggtggtgattttcaaaatttatttttgcattcttatgttttccagtatccctaaagacgttcatgattttgtaaactttctcaccaatttggggatcgttaaaagccctaacaacaaccttagccattgtgttattagaaatgatttttttaaacatgaagattaaattcttactgttttttaaattcccctgcatcttctcagagtaaaaattcttatttcttaattgtttcaggctgtgtacatgatgccaaccgagggggatgattcgtctaaaagcgtccctttagcattacaaagagtgttctatgaattacagcatagtgataaacctgtaggaacaaaaaagttaacaaagtcatttgggtatgtattagacatctgcctttgccattctgcttcctctttttttttttttttttttaggacaagtgagtagagaatagaaaagttagtagagcatactgtaggcacttaatttagggaggcttgagcatttaatcgtgtcagtgcttttatcattgtattttgttttatctctttggaaatagacactttgttgtagaattttgcttgagaaagaattcaccgcttaaggtttttacttttcaacacaagaacctgtactgctttcagatttattacattttcttggaaacaccacttccccagcagtaaatctatctttgaattatgactcccaaaaataatcttcacagaaaaggaatttgagaataatagctgattatccagtttaggttttcaatctaagttacttttaatttgctcatttgaaagttgagcgtttaaatggagttgtttgttttatctttgaaaggtgggaaactttagatagcttcatgcaacatgatgttcaggagctttgtcgagtggtaagtttcaagcaatacttgtatatttcttacaatgaatattttgaagcatggtcagaagttattaccaagtaaaacctcagacctaattcagaaaatgcccatctttgtttaggatcagacttaggctacaaaaaggcagcagctgtctagttataaaggctggtaagaattacttgaatagggatttgaaggtgaagtgaggaagcttgaattttaatactagcaggcagtaggcttttaatttgttaaattggtatatatacatgagttattaatccagaaaccaaagactggctttgttggctgtcccgttggtcctgagtcactgtacagtggtgacttctgttgttactccagtgtccagacccctcctgtgcagcgaggttctcattgagcagacctcagcatgcggtgattactctccccgcgccatcactaatcactagcaaatcctcattcttccagttgtgataaaagacgcagaagcacacacacacaacatgaaatggctgttcaaggtgattggctgggcaaggtgtgttttcttttttgcagcactagctggattgaatccagttcattaaatatccatggacaaaccagtcaatcctgttgacaggctcaacctcattaatctcttggtgtggaccattacgagttaagtttagtgaacaattttacatgcttttccacagaggtaaaaaatataaaaatgcttctaaaggcactacagattactaatttattccaaaggctgtataaaaggttaacctcaactgttgcatgtagagatgtttgtaaaaatccaaccaagaaagaagattttgtatgtttttgagaattgcatgccagaggtcatatttttatagtctacaacttctttgaacattgatatttctagtcaattataaaattactgtatatattactaagtacaaaaaagtttttttaaagccaaaacattctttttcagttgctcgataatgtggaaaataagatgaaaggcacctgtgtagagggcaccatacccaaattattccgcggcaaaatggtggtatgtggctaccagttctaaaagatgatttttaaaggttttagaatgtgaattttttgactattactagttaaaccacttttactttccttatttgcagtcctatatccagtgtaaagaagtagactatcggtctgatagaagagaagattattatgatatccagctaagtatcaaaggaaagaaaaatagtaagtgttgtgtgtatctaatggcatgatcttttgatgatttctactgtgttttaatgtttcatttacacaagtgatgtttttttaaatagtctaaacacagagaatggctcagatcttaagcaaacagctcactgggtgaacacaggcttgttacctccacccagctctggtgttggccagcactcccacagcccttcccagccaccacctcccctctcctcacaggaaaccaccacgtggacttctaacaccctgggttaactttgcatgttttaggtgtctgtttaaatagaaccttgtagtaggatgtatttgtttgtttatttcgctgttgttttttgagatagggtcttgttgtgctgtacaggctggggtgcaaccatagctcagtgcagcctcgaactccaggactcaggcgatcctcctgcttcagcttccccagtggctgggaacacaggcgtgtgccaccacacccagctaattttttttttttggttaagagatggggtcttactttgttgctcaggctggtcttgaactcctgggtttaagcaaccttcctgccttgggctcccaaagcactggaattagacatgagctgccatgtccagcctgtgtctgattccttttgctcagcacattcatgagatacatccacgctgggagtagtcatagtttgatcatttttgttgctttatagtattccattttgagaatataccacaaaaattttgaaatctttcttcttttgcttgatatttgggttggtctccatttgaggtggttaggcataaggcagatcgaccattcttaatgcctgtttgcatttggaggaagaggattactggcctgtagggtgtgcgtatgtccagcttgatggatcaagttagcgagattcccaaagtggtttatcaattgcacagtcatcaggaaggtggcagagttgcagttgctccacacccacactggagctgtcagttgccagactttgaaagattttggtgggagtatagtgctatctgcattttagtttgtatttccttgaagatcagtgaggttgttcttaccttttcaaatgcttattggcaatttggatgtcttcctttataaaatgcttgtttaaatactttaacaattttagtattggcttcttttctttttccttaactgatttatagtcattcctttaaagaaatatttaaaataagggggaggatgggtgtggtcgctcatgcctgtaatttcagcactttgggaggctgagtcgggaggattgcttgaacccaggagtttgaggccagcctgggcaacatagtgagactccatctctacaaattagctgggcgtggtggcatgcacctgtagtcccagctacttgaggctgaggtgggaggatagcttgagccctggagtttaagtctgcagcgagccatgattgtgccactgcactgcagcctgggcaacagagcaagtatctctctcaagaaagtaaaataaaataaaaagagtgaggaggggaagtgctttatgttgacccacatatttacagcttgcaatgctcctccgtttttaatttggatatggattctcgttaggaatcatttagtgcgggtcggctgagatgagttttttcaccttgcatgcctagaaagattttatttcatctgcagttgtgaaagacattttaactcggtgtagacttctaggttggcaggttccttccttcggtctgttagacgttctaccgtcttcttgctcgcctcatttctgagaagtgggctgtagtgtccttactctttctgttcatctgtttctctgccccaagcccccatattcttcgcttcgcttcacttcacttctcttctctcctgtcttccctcttctctcctctttttgagagggagtctcgctctgttgcccaggctggagtgcagtggtgcgatctcggctcactgcaacctccacctcctgggctcaagtgattctcctgccttaggctcacaagtagctgggattagaggcatgcgccaccatgcccagctaatttttgtattttcagtagagacgaggtttcaccatgttgggcaggctggtctcgagttcctgacctcaggtgatctgcccatcttggcctcccaagattttgggattacaggtgtgagccaccgtgcccagccccccatgtgcttttaaggttttttccttctcactggttttcagttgtttgattctggctgcctgaggttacccccagcctccagatgtcctagtctcctttctctgggttttgtgctgcggtttctgttgctctgtcttgatcttcactaattgcctgcagtgtctagttctctgtgaatcccatccatggtgtttcattttcaaactttttaaatttttttttatttttagaagtttgacttggattttttttaaatgaaaatctttatctcttcttttttttctatgtatttatcaattaattataattatttggagacaaggtcttgctgtgttaggccaggctagtctcggaggtcctgtgcccaatcagtctgcccgccttggcctcccgaagtgctgggaccatgcccagccctgtgtctcttcttagtatgcttttgctttcttctcctttggacttaagtatagttgataatgctcttgtctactaattctgtcatctgtgagatttctgcatctgtttctattgaaggattgttgtcttcatcatgggtggtggtttcagcttctttgcatgcttggtaatgtttattttcttttttctttctttttttttttttgacatggagtctcactctgtcgccccggctggagtgcagtcatgcagtctcagctcactacaacctttgtctcctgggttcaagcaattctcctttcagcctcctgagtagctgggattacaggtgcccaccaccacacccagctaatttttgcatttttagtagagacggggtttcaccatgttggccagggtggtctggaactcctgacctcaggcgatccacgtacctctgcctcccaaagtgctgggattacaggcgtgagccactgagccactgcactggttcacatgcttggtaacttttttattgaacagcaggcatggtggtttttatcttgctgggtgttagatattcctaacctttgctcttatgcacagataagtgacttgtaagtcatttgcttcctgtgaggcttgtttttaagccttgctaggtgggagaacaggttttacttgagggataacctgtccccacatcctttcagttgttagctgagtctcccaggtgttcagcggtttttccacggtggctggtgggaacacagacttcccagcctgtcgtgagctctgaaggttgttccccccaatcctcatcctcttgctggttcttttccttgccccaggtaatttcctcgagttcactgatcagttctcactgacagcttcggaagaaactgcacatccccagatctcgctttctgggcagcattctgctttaggctactctgcccagcaggttcccgctcccttgagctcctctcattctcacttcttggctctgtctgggtttgccttctccgggctgcagcctgtaaactttcagcagagctgggcccatcacggggctctcatttgtcccttcagggatccctgtcctgtaccgcatgtgtccggagcgtgacagcgctgttttcagtgttgtgcagttgcgtttttccttcatgaccggagcaggacgagctctccatacactctggatatacaattccgtgttggattgagagcttgtcactcagcatgtggctcgccctttcactcttaatgttaccattcttaattttagggaaatagtgtgtccttgtttgctttttatgtcctaaaaaattgttacgttttactattttgccttttccatttatctacaatccacctggaacaggtgggggtggggagatgtcaggaccaacttccaccccaccccgtgttgacctctgaggaaatcgaggttttccttgtcattctgccacatcagccagccattcacatttgtgcatctctgcttttgagaccaaggggttgtccacactgcccaattccaagctgtcttcataatcatagctttacagtatgtgctttgttcgaataacagtaaaaccttaactgttacctccatattgtcattttaatgtccttaagaaagataccaatgacctttggccaatgagcaaaggtgctaacagcacatttacctacagtcttggctacagggggagagttactgttagtgttgtttaccttctctgctaatcctaaatatgctgatttaaataacttacacctgtgttggctacattataaatgaagctttagcacttgacttttctctctctctctttaaagtatttgaatcatttgtggattatgtggcagtagaacagctcgatggggacaataaatacgacgctggggaacatggcttacaggtaaattgagtgttttgtgctagtgtcctgttgtagctttcttctttattttcaattcttttaattgctaaataaaaatttgcttgtgccttttcatgtgtttctggtatttagaatatacaaggattctgtttgtaggataattgaatggggagggagagggggatgttgggagatggagtgcagctggtttatcctgtagaagcacatccagcagtccggagggtcttgtggggttttaggcatcttgtcctttccccgttcctcaccttactggtgtcactgctccagttttccctcagtttctcctggtcacaagtgggatttcttagtaagttggactgtgtttaggttgtgtttctttatttttaaatgtatttttaatgaatttagttttctgaggatcacgactttagaatgagtagtgtgttctctagggttgtgtcccccaggtttctgggcatctgagagagcagtgagcatggtgggcgaccaggtggccagcccccgcttggatgaagggaaatgggctgtttctggctgctggtctggctggtctgttggatctgcagtgtcctcatggatccagtgatccagggtctgttttgtaatcttataaccttgactcattgactcaactaatttataattaaaaatgtcagtctggcctgtgcttacaaagcctgccagtgtatatagttcatggtgcctgtgtacccattttgtagtcagctgtcagctccaaatgtactcttctgctaggtcagtccagttggactgagggactgaggtatagatcagaaagttgcttttttttctgagacggagactcggtctgttccccaggctagagtgcagtggcgcgatctcgactcactgcaacctctgcctcctgggttcaagtgattcttctacctcagcctcccaagtagctgggactacaggcgcccgccactatgcccaactaatttttgtatttttagtagagatggggtttcaccatattggccaggcaggtctcaaacccctgaccttgtgatccgcctgcctcggcctcccaaagtgctgggattacaggcatgagccacttgctcatccagaaagttgctttttaatgagaacttggtgtgatgaagaaatattctggtctgttgacgagaattactgttctctattctggatgttttagggtctggttgagcagtatgtatttgagtcgaagcctcagtggacagcggtggagacagaatccttttatctttcagactgtattaaaaacaggtccttccccactgtggagaggggttctgaggtctgtttttgtctttcctgagatagctctgtcctcttaaatgagctgatgtacaccaaagaaccttggcatatgggtgtgccttgtcatggtccccagttcctccaggtctctcgctggctgctgggcaggtggatttccagccagaaggaaggtctgcattggaaatagagctgtgagtcagacatggagtgagggcccctgaccgcctggccgtggtcgagataggcaaagcctgattttactgaggaacaaagagctggccaagatggagcagtgatagagcagggcaagagcttagagtccggtgtccccatagaaggcttgttgagaagttggggtgtcctgtcccacagagtccggcagtcagctggggaagggccttgctgacactgaatcagaacattttcttagaagtgggattgaaccataagccctaagggcgtgccctgtgatatatgggttcttatgcaaacatcaaagagcccaaggaaaggaagcttataatcctgccgactcatcagttgtgttcattgctgcttgttctgtttgggcatttcataagcatacctaatcttgggtaattgtaaccagagttttctgattttccatttaattatttttctgtggttctccataatttgcacagtgtttaatgactgtataacacagcagcaaatgactgtctaaatttccttaaccatttcttccctgattgctgggcatcgagttagaatataatccaaggtaagagaatctctcacagtcagtgctggtgcagcattattttaataaacaaagagacccataaacagacctaaagaaaacatttcaaagatgccctaaatggacacctaaacttccctgcctttgtctccagagtctccagacatgttccaatcttgctgaaccgctgttgctttcattgcttccaggagtaagtagaggctaactacatttgcatttgtttttcaatgtttaggaagcagagaaaggtgtgaaattcctaacattgccaccagtgttacatctacaactgatgagatttatgtatgaccctcagacggaccaaaatatcaagatcaatgataggtaatctatagtgggatataaagttaagatttcatcatcatgctggtctagggggttagtctcagtgctttcctcagtctttatattttcagtcccacatctgatttatttagattttccttctacctctgtgtcccaagagccgcagtgttaaaggaatgattttatgtcaagtttcagaggtcaacctctgccgagtccatttcccctctcaggatgctttgcccagtcccagccctgctctcagctatggctgatttaagtccacaaggatggggctgtttctgcttcacagctcttgcattcacaggatttctaataaatttaattttgaccgattataaatgttatttcagaggggacttttagtgtattcgtttaaataggattttccaatattttgttgtctctcagttggcgtcaacttttagaatgtgctagagttttcaagaatgctaaagtagttgtttgtatgccagttacaagtagttattttatttttatttactttgttttattatgtttttgagacagagtcttgctgtgtcgcccaggctggagtgcagtggcatgatcatggctcactgcagccttgaactgctgggctcaagctattctcctgcctcagccttccaagtacctggctaatttttgtatttttagtagagacagggtttcactatgctggccaggctggtctcaagtgatctgccggcctcagcctcccaaagtgctgggattactggcgtgaaccaccacacccggccacaagtagttttctaggttgttaaaatagtagatgcaggagtgacaatgtgcactaccttatctgatttagaatacagtatttttatcctgattagtttgagcaccagctttgtatggaatataggttggtcattcagccttcaggtttaagggagagtgtaatcaaatcactttacttgctaccagctgaggctttggtcacccattcacagtctttaccgtggtcagaaactgtctcagccagaaaccacaaactggcagccttcagaccaattccaacctgttggtatgtttctttggatcctcactttgtttttatttttgttggagccagtggcagacattttttaaattgtgagatttcacataaatgttcagatttgggcatcgtttaggaatcagaaggtttggcaacttgaggccaccattcctgaaggccgcaggggctgtgagctgagtggtggctgcttcgcaggccgggtgcatgctgtgcttgagaccagcccccacccgtctaacttgccttcctgcctctgttaattttgcaacactgatggtgaaatttggtcaagtaaatcaaaatttgtagagccagttaaaactaagtcaatttcaggatgtctgtagaatattaaaactaagtcaatattcagagtgggaaatatttttacatgtctttctgaatttgatttttcatgtttctcagtttgcagatatccttagtagtcttaacctcgaccttcagaatcatttcttgatatatttggaattcccccaccctaaattattcatagtgtatatttatgttgactaggaatagttatttctatcaagtacggattacgttatgtacttcataggccttcccaaggcaattcatgcttatcctattaaagatgagccagtacattaaatggccttacttactgtaaagtgtgatattttttgtgtaaattaatactgaatttcttttaaaatgttttctaataggtttgaattcccagagcagttaccacttgatgaatttttgcaaaaaacagatcctaaggaccctgcaaattatattcttcatgcagtcctggttcatagtggagataatcatggtggacattatgtggtttatctaaaccccaaaggggatggcaaagtaagtggtgggacccagggctgaatgcaagctcatcagaaagttaacacaagctctgcttcagcctgttctggttcctactcggaaccttgtcagggacccctaactgatctatgtattctctggctgctaaatgctgttttcccatccatttaattgctgagatttgaaggtaaatagtaaattagcatttgtgcttctctttgtgagtaatcaatgttgggccctacagaatcccttatatgtcatatgagacacttatattttcttctgaatgctcgtgggataattacccatgcggtgggcccagtcggggaggctggctggtcgcatgtccctctgcgtgccccctggtcctaccttgtttcctctcatggggatctcatgcagtcttcaccaccactcttgggagtgtagagggcgccatactcatttggcagatgagggtcttggaatctacccccaagaccacagggccagcaccgagctcctgccaaggggatttggtggagggacccgacagcacgagagaacagtgaagagtgcgtgtaacagcagcgttcatcactgtttaatgtggctgcatccacaacgcagatgggaagataactgttaggaacatgctacgttgacttcagtctggcccttaacttgcttccataaaatgccatgggataggataaaacagctcatttagtttgataactaaaggataaaatttgaactctcgtttggtgtgctcagtatggcctttttaattctgtaaagagttggtagtgtcagtagattgaatgtaagtggaaaatgggctatttcagtagattataaaaattgccattgggcgaatggtagcagtgcccacagaatgttgaatggggactgcgaaggtcctggtgaattgtatgagcggatgcctgaggcgctgcctgcctagcacaccgtcagattgtgtgcctgtataagaacacacatggatattttttcaactaggggcatacctagaagttcacacattttagaacaacgctgccttctagtgttgggtacttgtcacagtgcttgatcgctgctggtgtgtgttgttttccttgcagtggtgtaaatttgatgacgacgtggtgtcaaggtgtactaaagaggaagcaattgagcacaattatgggggtcacgatgacgacctgtctgttcgacactgcactaatgcttacatgttagtctacatcagggaatcaaaactgagtgagtagtgttcacttttgttctgttctttactgtggtggacttggacatttgtaccatgaatctccaatatccttttctgtccaaacacattttatgcttattccattgtattcacagcagcgcagaaatgagcagggttgggcttgcgcgtttcgatgcagacttatggtaccaagtaatttcatgttaatagattattttattttatttttttgagacggagtcttgctcttgcccaggctggagtgcagtggcgcgatctcggctcactgcaagctccacctcccgggttctcgccactctcctgcctcagcctcccaagtagctgggactacaggcgtctgccaccacgcctggctaattttttgtattttattttatttttattttatttttttttttagtagtagagatggggtttcaccatgttagccaagatggtcttgatttcctgacctcgtgatcggccggcctcagcctcccaaagtgctgggattacaggcgtaagccaccacgccggcctaatagattattttattaatgatgacctagaatcgggagcttctaagaggggaaagtccatctgcaggggtcaaagaggatgcctttgtcctgcaggtgaagttttacaggcggtcaccgaccatgatattcctcagcagttggtggagcgattacaagaagagaaaaggatcgaggctcagaagcggaaggagcggcaggaagcccatctctatatgcaagtgcaggtcagcccccgcccttctgggactccgggtcaccatgcagccgggcacccatctctatacacaagtgcaggtcagcccccacccctctgggactcccaggtcaccatgcagcagggcatccatctctgtacgcaagtgcaggtcagtccccactcctctgggaccccttgggtcactgcacagcagggcagctgcccagagagaagctgctccacgtgctctcctgagcttggtcacagtcccagagtagttcctgatacacaaaccgggactgttgtgccttgagctgccctgggcagctgcctgagtatttgtaacacctggccctgttggtggcgggcagagccagttcaggagtaaagacttggttgtcagaagtcaggccaccagacagagaagtgattaagtgcacgtcaggttgcttcaaaaagtactgagggggttggagaaagggaggaggtcatctcaccgttggctgtctagctaggtccaatttataggtgagttaagttattgcagtgaaacacagtctccttttcttttttcttttcctttttttttttttttgagacagagtttcactcttgttgcccaggcttgagtgcagtggcgcgatctctgctcacctcaacctctgcctcctggattcaagtgattctcctgcctcagccttcctagtagctgggattacaggcatgtgccaccacacccagctaattttgtatttttagtagagacagggtttctccgtgttggtcaggctggtctcggaactcctgacctcaggtgatccgcccgcctcggcctcccaaagtgcatgagccaccgtgccctgcccacagcctccttttctaaataaatacctgatttaggttttggtcattttatgcggtttttcttcattggtcttctgaagaagtttctttggaacaaaaaatgagttttcagcgttttagtgtttaaatgtgttcagtgtggactcattttttgtcagttgtcaagtcttttctgtgctttcatacatattttcagatagtcgcagaggaccagttttgtggccaccaagggaatgacatgtacgatgaagaaaaagtgaaatacactgtgttcaaagtattgaagaactcctcgcttgctgagtttgttcagagcctctctcagaccatggtgcgtaccggtcccgtggatataccccaccgtggctcccaacgtccaccttccttccgtgtcactagaaaatactgattgcctttgggggtaggtgctgtgtccagccactgcctaacagtgaggagtgtgacccaggaacatttcctgcctgagaaagtgcaagaaaaccattgagcccctgactcctgcacaggggaacccacaggattttgcagacatgttttcaccccttttcctcatctcccactccactccctgcacccctaccccctctttatttttgaaaatgggcattcgatcctgaaggataagtcacagttgtccaaatcaaccggggaagaattagaattctttttcttagaatcacagtttttttttctttttttttgagacagagtttcactcttgttgcccagtggcgcgatcttggctcactgcaacctccgccttttggtttcaagcaattctcctgcctcagcctcccaagtagctgggattacaggcacccgtcaccaggcccagctgatttttgtatttttagtagagacgagagttcaccatgttggccaggctggtcttgaactcccgacctcgtgatccacctgcctcggcctccgaaagtgctgggattacaggcgagagccacagcacctggcctacgatcacagtcttaacattgactatatatatatatgtatatgtatatacatatgtgtgtgtaatatagaggactaaaatatgagcgtgtttttattttaatctactcttaatatttttttcagggatttccacaagatcaaattcgattgtggcccatgcaagcaaggagtaatggaacaaaacgaccagcaatgttagataatgaagccgacggcaataaaacagtaaatattgttaatagcgtatctggtttggaaccgtgcagaaggcgttagtcctctgcacttagtgcagcttgtttcccttttggtccacttaactagaattggacgttttcttcaatacttgactgtagtttttcgctctgtcacctaagccattagactcttctaaaatcagcgtctcttttggaaatagatgattgagctcagtgataatgaaaacccttggacaatattcctggaaacagttgatcccgagctggctgctagtggagcgaccttacccaagtttgataaagatcgtaagtgcccatgagacgcctgcctgcacttagagcagtagcgttggattcctggattgttgttctaaacacacagggttaagccttcttcccttgcagaaagatgtgttgatcaattccacaaaagctcactagacttcctgatgaagtcaaataagactgacttggctgcgagtttcctgtgaggcccggagacagtagcagccacgtggggccgtcctgttctgtcttcagtctcagctgctgtgctgtgctaatcacgttggtcagatcctaaagagcagggttgcaaacgttgtctgtcagggaccacataggcaatatctcaggcgtttcaggcctttctgtctgtactaaggcggccacaaagactatataaatgaacgagctggctgtcttccagtacaactttatcgacaaaacaggtggatcggaatttgctgacccttgctataaaatgacagacttttattgctgtgagtggtcacttctggcaaagacacaagaccatgcgcaatcttcccgtggcaacgctcttccagccagtcagtccaggtctcagaactaggaattctaagtttgctgcactcagtaccgtcttgactgtctaaatgtagtgggtttccatgggtctgatgtttggaaactcagcggtaatagcctcagcttcgtgaataagccacatctgaagtaacttttaggtaccttaagctgtcatttcacttgtcattgagctattcagcttactgtttttttttttcgtttttttgtttgtttgtttttttgttttttaagcattgtgctgagtgtttggatcttaacaaaacttgtttattaaccttgtagatgatgtaatgttatttttgaagatgtatgatcccaaaacgcggagcttgaattactgtgggcatatctacacaccaatatcctgtaaaatacgtaagtccttcgtgcacttaccttctgagtagattttgctcagtacattacagctacacatttaaaatatcttctttctcctaggtgacttgctcccagttatgtgtgacagagcaggatttattcaagatactagccttatcctctatgaggtttggatggtttatttttccataattagtatattcttagtagtttgtggagggttttgtttgttctttttaccccgaatttgttacagtgttaggtctaccagctaactcagggcctcagatgatcttgagaatgacatatttagatttgtgaattttttttttttacctgttgtagaatcaaatctgattgttacatatttgtggatttattcatttagcttttcctgttaacattttaacttaaaaggtggatagaattgggtgtagagaaaatacttaagtacatggaagactatctggccatattaaacgttagacaaacttgcagtgtaacaattttatatctttcactgtaggaagttaaaccgaatttaacagagagaattcaggactatgacgtgtctcttgataaagcccttgatgaactaatggatggtgacatcatagtatttcagaagtatgtactttgtgaaggattgtatcactttgtactaatttcaggatttttttaagttgtagaaccaagaaacatttgtacctagatcccgagccacgtttttgtttttgttttttttaatgtaactgttgagaggctttctctgggttttgaaattaggtgtggtgaacattttcatctcataaagctcttctgaatttcttaaaaattccttaaaatgtctcaagtgcacgtggcaactattagtagagtgggaacaattgcttccttcccctgagatttatgaaatcgaaactccttagaatgtacctacttgggtaattcatttcagtctgtcttcatgtaaaccagccagtctttggtcttagacactcagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15105 - DNA, 5096 bp, Human
aacaaaattctcataactagttccagttccaagcctgggcggcagagcaagattccgaaaaaaaaaaaaaaaaaaaaaaaaaaagaaaagaaaagaaaaaaagaaagaaagaaagaaagaaagaaagaaagaaagaaagaaagaaaagaaagaaagatgcttaaacaaaattctcataactagttccagttccaagatgtgttaatttagtggcacctcagtgccatgaaggactcagaacttcccatttcctttctacattggctgatgtcctcaggcttattgccacagggtgtcacaaaggctgctttagtgccacacagtgcattctccccgagacacatccaaaagcaggaggggagatttttctccaatgtctctttttattagggcagaaaatattcaggaacgttctccttctcatacacacccactccatatagacccagcctctctggagggagtgggccctgccagcaaggaagaaggacagggtgagggggtggcatggaggagacagctgaagcgatggggagagggttcgagtgcacggaatggctcaggtgcaagaattcagttcattcttgctaagcaaagcaagaggaatttgtttctgagtcttaattggcccacaaaattgctgtggaagctgaagaaatcttaatggtcaccctgcagacctggaccaccaaccaagctgctacttggtctgtgctcagaaagccaagggctccatagccagacttccacggccaaactcaggaagcccccaggagtgttgccagctcaatgactacacggtgcccaccatagggcacaccacccaaaaggtgactcagcctgcctcttaacacccacaaggccagggaccagacactgagatgtccactttggctactgcagagaaactaaacacttccccaaccaaattgtctaagagaatcttgcccaccccccaacttcagccatttaaatgtcacaggagagcatccaatgggcagaatcaagttacagcagaaattatagctgcaagagagtctgggaaatgtgattgtgagctctcaatcccctgcaattacaggaaggcaccacagaagaagggtggaagacactgagctccagtcccccaaaatctaccacagcagttagctgtgtctgccacccccttctctccacagtttctaactttgatttgggtcattccatatgttgaaggggagaagggaggaactctatcccagaatccagggttgcaatgcatgacaattaacatagctcattctcctggccacggtaattggctgaggcagtcacatgactgtgggctgctgaagctgataaaacctcaggacttttgctcaagctcctggaaaatgggtttgctctttccagctgaacataaaaaactctggagctgcaacatccaccttccactgggagcaaagagccttctgaaaaatggaggaactgagatgaggcaaagccaatatgatattttgaacccttggattcagcccttcctgaggccacctaggcttttgaggaacatgaaccaatatcttttctttttgtttaagtcaatttgagttgttatctgcaagaaaaacagatagaggaaggttatcaaagactcactttgattattttcttgaacatgcaggcggtggtcactggcttactgagatcagtcctccagctccttaaaagttaactactcacgggctggacacgatggctcatgcctgtaatcccagcacgttgggaggctgaagcgggaggatcacgaggtcaggagatcgagaccatcctggctaacacagtgaaaccctgtctctactaaaaatacaaaaaatcagctgggcatggtggcgggcgcctatagtcccagctactcgggagaatggtgtgaacccgggaggcggagcttgcagtgagccgagattgcgccactgcactccagcctgggtgacagagcgggactccatctcaaaaataaatagcttctctcgccaggcatcctcgtggaagtgacatcgtctttaaaccctgcgtggcaatccctgacgcaccgccgtgatgcccagggaagacagggcgacctggaagtccaactacttccttaagatcatccaactattggatgattatccaaaatgtttcatcgtgggagcagacaatgtgggctccaagcagatgcagcagatccgcatgtcccttcgcgggaaggtcgtggtgctgatgggcaagaacaccatgatgcgcaaggccatccgagggcacctggaaaacaacccagctctggagaaactgctgcctcatatctgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgataaaacagaggaaactctgcattctcgcttcctggagggtgtccgcaatgttgccagtgtctgtctgcagactggctacccaactgttgcatcagtaccccattctatcatcaacgggtacaaacgagtcctggccttgtctgtggagacggattacaccttcccacttgctgaaaatgtcaaggccttcttggctgatccatctgcctttgtggctgctgcccctgtggctgctgacaccacagctgctcctgctgctgctgcagccccagctaaggttgaagccaaggaagagtcggaggagtcggacgaggatatgggatttggtctctttgactaatcaccaaaaagcaaccaacttagccagctttatttgcaaaacaaggaaataaaggcttacttctttaaaaaaataaataaataaataaataaataaataataaataaataaataaataaataaatagataaataaataaaaagttttctactcacactgaagtgacgaagtccagagaaggtggagagctgtgagcagccagagcgagggctgcaggatggtcagcggcagcctctgctttcctccactccacagacactactcctgtctcttaacttgcccatgggctggagctgtgctaattttgctcttaaatattattagaggtcttaacatcttcctcggggatcccactgaaaagtaataacatcagaacacattattacagtttcagatacatcttaaaatatatactgtatctaaaattttacattttggatgaataaacactctcattaatcaaataaaccaattaataagaactaatatatatttcttttttctttttctttttctttttctttttttttgagatggagtctcgctctgttgcccaggctgaagtgcagtggcatgatctcggctcactgcaacctccgactcccaggttcaagcgattctcctgcttcagcctcccaagtagctgggattataggcacccaccaccgcacctgactaatttttgtatttttagtagagatggggtttcgccattttggccaggcagatctcaaactcctgacttcaagtgatctgcccgcctcggcctccaaagtgctgggattacaggcatgagccaccacacccggcctaccccattttacataatgtgattattatgcattgcatgtctgtatcaaaacatctcatgtaccccacatacacctacaacatacccacaaaaattaaaatagaaaaaatggttttaagtataaggaatattaaaaatatccacaaaagaaacacaaatgatcaataaacattctaaaatttaaaatatatatatatttttcttcctttctaatatcaaagatgttgcacttatgaactactcaacacatttaagctgattttttttttaagccacagcctggatgaggagagacagaggcccagggagcctgactgtcctcagccttgagtgaagagcagggcagggagaaccccagtgagtcagtgcccagtgggctctgtgttgtgcggcccagatctccctttaggaaaggaaagctgattgccccagatgctggaggggttgtcagctgataggtctcagctatcaattctcttggggaattattgtggctgaagataactgcctcacccaagatcatgcctcctttcaagggcagccagtatccccgatgcacggagaaaggtcaggctccctcacctcaactgggataagtgaagggcctgcccaactccagagctccctggtgcctggctgaggccttcatggggcctgaattgcagtccagcttccttcccttcctttcccttcccttcctcaggcgctgatcctaaaggcactccctagtaaacatcctgctctctaatttccattggagtcggctttccaggaaaccccctgcaccactgtagtacaggcaggagttcctggactccaggatttaaccaggtagaagagaaaagaattccaaacccatttacagcatctattcctgctgcccctctccccgctccatcttcttgtggaaataaaattacccttcatggtccagctgcatggcccgccttctcctcaaaactcccctgaaccacgaagcagcggtgtccctccctgtcctgaattcccacagcatttcatgtgtccccttttcaggaagcatcatctgctggtatttcctcatttctgcattttcagtgtcagccactgagttcttgagtctgtgagacaccttctcagagccatttttctcatctataaaatgggagcaatgatactcctgggggtttaatgagcaaccagataatctcctgctccagtgcctgccccacaggaaaagctcactaggctaattccctctctccttcctcctgaa

SEQ ID NO: 15106 - DNA, 18947 bp, Human
atggggtttctccatgttggtcaggctggtcttgaactcccgacctcaggtgatccgcctgattcggcctcccaaagtgctgagattacaggtgtgagccaccacgcctggccgaccatggttctctttaagtgtttagataacttacacagaaaagaaggtagaaatatctgatcctagaaggaagaatcaggtaaatccagtggctaaaagttaccaggaattgctgggcatggtggctcaatgcctgtaatcccaacactttgggaggctgaagagggcggatcacttgaggtcaggagtttgagaccagcctggccaacatggtaaaaccccatctctactaaaaatacaaaaatcagctgagtgtgatggcacgtgtctgtagtcccacctacctgggaggtggaggctgaaatggcaccactgcactccagcctgggtgacagagcaagactccatctcaaagaaaaaaaaaagttataaggaaggttttacctcaacgttataattttattagaactgggctgggcgcagtggctcatgcctataatcccagcactttgggaggccgaggcgggcagatcatgaggtcaggagtttgagaacagcctgactaacatggtgaaaccccatctccactaaaaatacaaaaattagccgggcgtggtggtatgtgtgcctataatcccagctgctcaggaggctgaggcaggagaatcacttgaacctgggaggtggaggctgcagtgagccaagatcgcaccactgcattccagcctggcaacagagcaagactccgtctcaaaaaaaaaaggcgtggtggtgctacttgggaggctgaggcaagagaatcgcatgaactgggggacagaggttgcagtgagccgacatcacgctattgcactccagcctcggcaatacagcgggactccatctcaaaaaaaaaaaattattataattgtggaacaaacagtggtgcctcaggtatgtcgagtccttggagctgcataagcagagaccatatggtgatgtcgctgggatgctggcaggggatctacaccgtgattgggtgtgtggaggggtggattgacagagtggagggagcagacgaatggctgctgacatctaagaacctgaggtagtctaggcccatggctgctggctccagaattgcaccatcctgggattgtggctgccctttcactttcaatcatttcttttgcaggaaaacaagagtagaggccaattctcctcttccaaagaactctggatccctaaatgaggcagaagccttgaacccagaagttactctatcttcagaggggtccttaaacctcgaagacattctctacctggaggacacaggtgaccttgatgagacactctatgtgcaagagactgagaaggcagaggaggccctgtatattgaggaggccatgcagccagatgaggctctgcatgtggaggagcctgggaatccagaggagacagtgtgtgtggaggaaaccacggagccagatcggatacagtttgtggaggggcccgtggagccaggaaagcccacaagcccagagcacgttgtttatgagggagagacagtcacaagggcggagaaatctaaccctgaggagagcctcagagccgagcagagccccagcgtggaggagaacctgagcatagaggacctggaattgctagaggggcgtttccagcagtgtgtccaagctgtggcccagctggaagaggagagggatcagctcatccatgagcttgtattgctccgggaaccagccctgcaggaggtacagcaagtccatcaagacatcctggctgcctacaagctccatgcccaagcagagctggagagagatggcctaagggaggagatccggctggtcaagcagaagcttttcaaagtgacaaaggaatgtgtggcctaccaataccagctggagtgccgccagcaggacgtggctcagtttgccgatttccaggaagtgctgactacaagggcaacccagctctcagaggaactggcccagctccgggatgcctatcagaagcagaaggagcagctgcggcaacaactagaagcccctccaagccagagggatgggcactttctccaggaaagccggcgactctctgcccagtttgaaaatctcatggcagagagccgccaggacctggaggaggagtatgagcctcagttcctgcggctcctagagaggaaagaagctgggaccaaagctctgcagagaacccaggctgagatccaggaaatgaaggaggctctgagacccctgcaagcagaggcccggcagctccgcctgcaaaacaggaacctggaggaccagatcgcacttgtgaggcaaaaacgagatgaagaggtgcagcagtacagggtaggcccattgggcatgaaaagaactgaggtcttttaacctggggaaagagtggccagagtccaaggtctttggggctgaaagatagtgtcacatgtaggaagaaaaatttgttctttggggccacgcaattttttctccattcttcattcattcaggcccatgctagggactagaagttatctgcactgttttttgtttttttttttttgagatggagtctcgctctgtcgcccaggctagagtgcagtggtgcgatctcagctcactacaagctctgcctcctgggttcatgccattctcctgcctcagcctcctgagtagctgggactacaggtgctcaccaccatgcccggctatttttttgtatttttagtagagtcggggtttcactgttgttaaccaggatggtctggatctcctgacctcgtgatccgcctgccttggcctcccaaagtgctgggattacaggtgtgagccaccgcgcccggcctgcactctgttttttttgcgacagggtcttgctgtcacttaggctggtgcagtggcatgatcacagctaactgcagcctcgacctctcaggttcaagcgatcctcccacctcagcctcttgagtagctgggaccacaactgtgcaccaacatgcccagctaattttttcttttttgagacaggtgcaatcttgagggctcactgcacctcaaacctcttgggctcaagcgatcctcctgccttagcccccaagcagctgggactacaagtgtgtgccaccatacctggctaattttttgtagagacagggtttcaccacgtggcccaggctggatttgaactcctgagctcaagctatccgcctgccttggcctcccaaagagctaggattataggtgtgagccaccgcagccggccaatttttgtattttttgtagacagggttttgccatgttgcccaggctggtcttgaaatcctgggctcaagtacttttaatggcaaaagctgcaattaattttgcaccaaccttaatagaatcctctcatcttcactttccttttatgtgcatttgtccccatctctcttgcattcaagttatttctgattaagtgtgagccagttctaatccctttttagaacagagtgggatataaatactaagtgaataaacaattacgtagtccctcctagactgtgaactttcagaaggtagggaatacattttacttattgttgtattactctctgctactcaaggctcagagcacatgtgctgctgggcactaatgagaagactgtagtgtggtgctctaagcagtactttaatcttttgaaacactgattcctttggataaacttagaaatctatgtcttcccagagattgtgatatgcccttaagggaacaagtttccctgttgaaatggctgcattcacttcactgaagattttgtcaagctttctgtagtttgtattatgaaaacactctgtctgggagcggtggctcacgcctgtaatcccagcactttggttgggaggctgaggtgggtggatcacaaggtcagtagtttgagacaagtatagccaatatggtgaaaccccgtctctactaaaaagacaaaaattaggggggcatggtggcacatgcctgtagtcccagctacttgggaggctgaggcaggagaatcgcttgaacccgggaggcggaggttgcagtgagctgagattgcaccactgcactctagcctgggtgacagagtgagtactccatctcaaaaacaaacaaaaaaaaccaaaaaaaaaaaaaaacactgtggtttttggggtcataatactgaatgttttttatttttatctttatttatttatttttgagacagagtcttgctctttcacccaggctggagtgcactgaaccaatctcggctcactgcaaactccacctcccgggttcaagcaattctcatttcagcctcctgagttgctgggactacaggtgcccgccactgcacccagctaattttttgtattttagtagagatggggtttcaccatgttgcccagggtggtctcaaactcctgagcttaggcagtccacccgcctcagcctcccagttatttttacagagtctcgctctgtcacacaggctggagtgcagtggagtgcagtggcatgatctcagctcactgcaacctctgcctcctgggttcaagcaatcctcctgcctcagtctcccaagttgctgggattgcagacctgtgccaccatgcccagctaatttgggtattttagtagagatggggtttcaccatgttggtcaggctggtctcgaacacctgacctcaggtgatccaccggcctcagcctcccagtgttgggattacaggcgtaagccaccacacccagaagtaatactgaatgtttttaaactcttcatattccccttaccctattttttaaaaaattggttcacagtctagtgaaaagtcatttatttagcatcaatactatccttaacagccaatactcagacagacattacattaatagttgtatctcagagaagaaagtaataggtgatttatgagaggtgcaggtaaaagggctgtgggatagatgatgatgatgatgattattattattttttgagacggagtctgtcactcttgcccaggctggagtgcagtggcgctcagctcactgcaagctctgcctcccgggttcgcgccattgtcctgcctcagcctcccgagtagctgggattgcaggcgcccgccaccgcaccaggctaattttttgcatttttaatagagacggggtttcaccgtgttagccaggatggtctcgatctcctgatcttgtgatccgcccgcctcgcctctcaaagtgctgggattacaggcatgagccactgcgcccggccgggatagattatttttaggcgctggttaaatcagagaactcttcatgaaaaaagaggtggaatttgagctaggtatgaaagcatagggagaatctagaccagtgctgcccaacagaaatatgatgcaagtcacataaataattacaaattttctaatagccacattaaaataggcaaaaattcagctgagctaagcctgaggggagcaggggagaaaagatataggtaaaattaatttaaatatattttatctaactcaacatatctgaaatataattagtaacttggctgcaggtgacaagcttgagttttggactttattcagtagtctgctgcatcattaaagggatttaatcagggaagtaacatgattgccttgctttttttttttttttctgagatggagtctccctctgtcacccatgctggagtgcagtggcacgatctcgccttgctgcaacctccacttcccaggttcaagcaattttcctgcctcagcctcccaagtagctgggattacaggcgcctaacaccatggacgtggctaattttttttttagtcggagtctcttctattgcctaggctggagtgcaatagcgtgatctcggctcattgcaacctctacctcccgggttcaagcagttctcctgcctcagcctcccgagtagctgggactacaggtgcacagtgccacgcctggcaaatttttgttgttgtttttttttgttttttgagaaggagtctcgctctgtcacccaggctggagtgcagtggcatgatctgggctcactgcaacctctgcctcctgggttcaagcgattttcctgcctcagcctcccgagtagctgggactacaggtgcatgccaccatagctggctaattttttctatttttattagagacagtgtttcactatgttagccaggatggtcttgatctcctgacctcatgatccacctgcctcggcctcccaaagtactgggattataggtgtgagccactgagcccggccaattgtttgtatagtagggacggggtttcaccgtattgcccaggatggtcttgaactcctgagctcaggcagtctgcctgcctcggcctcccaaagtgctgggattacaggcatgagtcaccacgcccggccctaattttcgtgtttttggtagagatgaagttttaccatgttagccagctggtcttgaactcctgacctcaggtgatctgcctggctcggcctcccaaagtgctgggattacaggcttgagccactgcctgcctctctacttttttttttttttttctttggagatggagtcttgctctgtcactcaggctagagtgcagtggcatgatcttggctcaccgaaatctccgcctcctgggtcaagtgattctcctgcctcagcctcccaagtagctgggattacaggtgcccgccaccaggcctcgctaatttttgtatttttagtagagatggggcttcaccatcttggccaggttggtctccaactcctgacctcgtgatccacccgtctcggcctcccaatgtgctgggattacaagaagtactggtggcaggatataaagtgggctagagatgcagagcaatggagaataattagaaagctactctaaggaagaggttaagatggtttcagatttgacgatttgtgcatcttcccaaggattgttttccaaagataatcttatgacacaaagttttaaaaagaatattcagaagtctatctaatctctatcaaatgaatctttctctattgagaggaagtcttggtcttcctgcctcagcctcccgagttgctgagattacaggtgtgagccactttatctggcctgatacactcttggtagtataatagcttctcttgttgctataccatcattaaagtaggaagcaaggtctgaggtccctaatttttctttctgaaatggcttcctaaactgtttgctaaagttctatttcatcaacttactttttttttttttttttgtgacggtgtctcactctgttgctaggctggagtgcagtggcacaatcttggctcactgcaacctctgcctcccgggttcaagcgattctcctgcctcagcctctcaagtagctgggactacaggctcacgccaccacgcccagctaatttttgtatttttagtagagatggggtttcaccacgttggccaggatggttttgatctcctgaccttgtgatctgcccgcctcggcttcccaaagtgctgggattacaggcatgagccaccacgcccggcccatcagcttacttcctaagggtgtccctttaatccttaggctgcactccactcttaacgttgcctctatcatcaccttcatcaattcaacagtttctaagtgcctaattactgtgggccaggcagtgagctatgtgctggcaatagcaattagaaatagtatgtgtggccgggcgcagttgatcacaaggtcaggagttcaagaccagcctggccaagatggtgaaaccctgtctctgctagaactacaaaaaaattagccaggcatggtggtaggcacctgtaatcccagctactcaggaggctgaggcagaatagcttgaacctgggcagcagaggttgcagtgagctgagattgtgccactgcaatccagcctgggtgacagtgactcacctcaaaaaaaaaaaaaaaaaaaaaaaaaaaaaaaaaaaaaagggccaggcgaggtgcctcacgcctgtaatcccagcactttgggaggccgaggcgggcggatcacgtcaaaagatcgagaccatcctggccaacatggtgaaaccctcatctctactaaaaaatacaaaaattagctgggcgtggtggcatgtgcctgtgttcccagcttctcgggaggatgaggcaggagaattgcttgaacccgggaggcagaggttgcagtgagccgagactgcgccactgcactccagcctggcaacagagcaagactccgtctcagaaaagaaaaaaaaaagtgtgtgtgtgttgcggggtgggggtaatgctcctgccctcaaagagtttgtactccagaggccgggtgcagtggcccatgcctgtgatcccagcactttgggaggcagaggcgagtggatcatgaggtcaggagatcgagaccatcctggctaacacggtgaaaccctgtctcactaaaaatacaaaaaattagccgggcgtggtggcgcatgcctgtaatcccagctactcgggggctgaggcagaattgcctgaacccgcaaggtggaggttgagatcgcgccactgcactccagcctgggcgacaaagactccgccttaaaaaaagtttgtactccagaaggaagcataacagacaaaatgaatgtatttcgtaaaatctaagcactgttgattttaacatgcatcctgatcagagatgttaaaatgtggcagtcttggcatcaattaaacatatttcaatgttataagcactgtaatagctgtagtgataaggcactgtcctgatgaaaacaggcatgactaccccagcctgggcaaaagaggggacatttcatagatcaacaatagctagtatgtacttgaagttctttacacaaaataattcctttagtccttacatctctatgagttaggtataaggcatttgaaaaataagaagacagaggtaaggcagagcagtgatttgcccagggttaggcagcttgagagtgatggagcgaggatgtaactcctgaacaatctagcttgagtccatactcaggctcttcaagatgctggagctgaaccttaagaatgaattcatgccaggagcagtggctcacacctgtaatcccagcactttgggaggccgaggcaggtggatcacctgaggtcaggagttcaagaccaacctgaccaatatggtgaaaccccgtctctactaaaaatacaaaaattaggccgcctgtagtcccagctacttgggaggctgagacaggagaatcacttgaacccaggagctggaggttgcagtgagccaagatggtgccagcgcactccagcctgagcgacagagcaagactccatctcaaaaaataataaaataataataataataataataataataataataataattcactgggcaggtaagggagaggtcttccagacagagggaacagctcatacaaaagcatggaaacacaaaaagacatgttttgggaagtgagcttagtggtggaatcacaaggaatgttaactagatccagctgggactaaacatttttttcttttttttttttgagacggagcctcgctctgtctccaggctggagtgcagtggcgcaatcttggctcactgtaacctttgcctcccgggttcaagtcaattctcctgcctcagcctcctgagcagttgggactacaggcgtgtgccaccatgcccaactaatttttgtatttttagtagagatggggtttcaccacgttggccgggatggttttgatctcttgacctcgtgatccgccttggcctcccaatgtgttgggattacaggcgtgaaccaccgtgcctggcctactaaacacttttatggttttttttttttttttgagatgaagtctcgctcttgtcccccaggctggagtgcaatggcacgatctcagctcattgcaacctccgcctcccaggttcaagcaattctcctgcctcagcctcccgagtagctgagattacaggcacctgccaccacgcccggctaattttttgtatttttagtagaggctgggtttcaccatgttggccaggctggtctcgaactcctgacctcagatgatccacccgcctcaacctcccaaaatgctgagattacaggcatgagccactgtgcctggccagttttatgtattctttagactagtggtttccaaaactaaagttttctctaaagctgtggaccttctcccccagataattttacatagaatgcaatatataaagcagttaaaagcggagttattctctaacggaaaagtaccaagggcactccaatttggccagcttttggggttgcacagaaaagtttgagaaccactaaaaagcctgttaccttgagtatgagctctaagccaatggcaaatcctggctctatcactaagttggaaactttggacaaattacttaagctctgtggctcagcaccctcacatgaaacatgagattaataatactcccatatccatagggttgcaaggaatgaactagtaagccactttcccacaattccatgactatacattgattagacctcttcttcccctttaactctttactcatcctttaaacccatttcccttcttcctgaagtttcccgatatccttagtgtgcgacagataaccctcctgtttccacagcacctgttactttatactactattgctgtagcagttccccttttcctgagttggggaatgtatcctttctttgtctttgtcctatgtagaaaattaaaactggcaatgctgtcaatgcaagtgctggggcaactgtagacagacatgtcctggcccttgagaaattagtatctaggtagaaggcagcagaaaacaagggactggctgtctaggtgaaaaaagtggcaggaacacaggcacacagatctgagttgttaggctagagtagtgctgtctatcactgcaagcaagccacagatgtcattttaaatgttctggtagctctattaaaaaaagaaacagatgaaattaactttaatgcattttatttaacccaacacatatatttcaacatgtaatcagtatcaaatatttttgacatattttacattttgtgtgctgtcttagaaatctgctgtgtattttacacttacattacatctcaattgagactagtcatatttcaaatgagtcctatgtgactagtgacttcggtactagtagtccagggctagaggaaaatgttcatacggaagagtaacagaggttcaagttggaggtaggggtcaaactagagggggtctgaatgccactaaagaaagtggaaagcctttgaaggattttgagttgattgtaaagttaatctagtggttaacacaggattaagagaccatccttaatgccactgtagcaatccttccttcatttcattgaggctgttccactctgtcacagcttatcactggtggtgcagactgcttttccaagcatgtacttttgtaccttaccaacgggtctggtaggtagtgaggactgagcaatcaggacagcagtatgcagatgcttccctcttcagatgacacactcttaggcatggctgggcactaaaaaaggtcctttgacaatgttggtgaaagctgagattcagccagagtatcaaacagtgcggattgatgtgccacaggtacaatgtcaagtatgactcagaggacaaattatctagatccttctaataatagcatgtaccccaacaactggattccttagtattcttcaaaatctgaggtaaaatcactctcgctttaaaagataccaacttcaccccttcctctcttcccaactccctcctgcttccttaaggatccatgccagctagcaggtaaaccagaggctgacttgctgacatcttccttaccttattcctcaggtatacatcctaggcagggaaaatttacagaatgcatcccagcctgattttggaagaatgagaaagttatctgagggctcccaagggcctcctgtgcataccatctttatcttccaacttagaactaaccaaattcagtctttttgtgtaatgaaaaaaggataagctgggcacagtggctcacacctgtaatcccggcactttgggagaccgaggcgggaggactgcttgagcccaggaacaagaccagcctgggcaacatagcgagaccttgtctctatacaaaaataaagaagaaaaaaggatgcaggaaattaacaataggatagccaacaccctcactaaagcatcaatttccatatgatgttaagtaccaggtagaaatctctctgactttaaggagctttggacacaaaaacttttccttaaacaagccatttattttctaaacatggacttccactagttgtgtaactctcctagaattctagccaatatttaataattgttgccacacttttgtatttcaacttaagtattttatattattaaaaactaccaattatcttaacaaacctgcacatggagggagaggtatatgaaactcagcccactaactagaccaaaatcctcctcaatgacactaaggttgtaatactaaaaagtcccaatcaccctcccaggattctattaaagcaagctgtggttaacagacaagatgcctttttcgtcatcattttcaaaagcattgtcactttttttccaagacacaacttctttgaacctgtttcataacctatcatataaataccagcctcaatactgctatcaagattaaacaatgaacaaaaaagtgttttataagtaagagtggacaatgtgagtttttattgtttggctcattagaaatgttcttggccatctcatgcaggaacagctggaggaaatggaagaacgccagaggcagttaagaaatggggtgcaactccagcaacagaagaacaaagagatggaacagctaaggctcagtcttgctgaagagctctctacttataagtcagtttctgctgctatacaaatctcatctaatactggctgaggggatggtgggagggcttagggaaaattttaccttagaatcaaaaacaaaaagaggatttgggaaatgattttcaaattgtgcttatccaaaaacacatggaaaatggctctctctttttaaagggctatgctactacccaagagcctggaacaggctgatgctcccacttctcaggcaggtggaatggagacacagtctcaaggtgatctttgtgaagagaagagtggtgtttgcattgttactgctttcctaacaatactaattaatgccttaaaaacaggccggacggggtggctcacgcctgtaatcctagcactttgggaggctgaggagggtggatcacctggagtcaggagttcaagaccagcctggccaacatggcaaaactccatctccactaaaaatacaaaaattagccgggcatagtggcaggcacttataatcccagctactcaggaggccaaggcaggagaatcgcttgaaccaggaggcagaggttgcagtgagtcaagatcacaatacagcactccagcttgtacaacagagtgagactgcctcaaaacaaaacaaaaacccaaaaaacaaaaacaacaaaaaacccttgtgtgcctaatgacaaggggataacccaaacctccaaaacgcctgagtcaggcattcagagttcatttggaatgtttgtttctagtaggactcaaaatatgccctgattatcaccatgaattctgtggcatctaggctttgggcatcttgtttcctcatcctaccctacccacctgctattctcagttttccttataatagcagagaaagcagttgtgctatcaaaaataataaacatatctatccattaagttccttatataatattcaaaggctgtggttttgggtggaagcagagatgttcatgttacacagacttactctttttttttttttttttttgagacggagtcttgctctgttgccaggctggagtgcagtggcgtgacctctgcctcccgggttcaagcgattcccctgcctcagcctcccaagtagctgggattataggcacgcaccaccacgcctggctaatttttttgtattttagtagagacggggtttcaccatgttggctaagatggtctcatctcctgaccttgtgatccacttgcctcggcctcccaaagtgctgggatttcaggtgtgagccaccatgcttggcctaaacagacttaacttttagacactgacaaaactgaaggcatctttctgaccaatcacctactcaggatccctcccccaatgttttaccagtatattctgataaaagttctagagtccgtgaaagaaactaaggataaaagaaagtccgtgtcaagttgtacattatacagatgcctataaattttattcatttcctaagcttacatcaaattcacaactttcttttttttttgagacagagtctcgctctgccacccaggctggagtgcagtggcacggtctcagttcactgcaacctccacctcctgggttcaagtgattttcctgcctcagcctcctgagtagctgggactacaggagcatgccaccacggccagctagtttttgtatttttagtagaaacggggtttcaccatcttggccaggctggtcttgaactcctgaccttgtgatccacgtgcctcagcctctcaaagtgctgggattacaggcgtgaaccaccgcgcctggcccacaagtaactattgttgctttttctaattttctaggattttatttcatttttttaaatttctttttagtagagatggggggtcgggtcttgctattttgcccaggctggagtagtggcacgatcttggctcactgcaactctgcctcctgggttcaaacaatactcctgcctcagcctgctaagtagctgggattacaggcataagccatcacacccagccttgaggattttcttatactgtgtttgaatccacatgactgataatatgcttaatgtttgagaaattataaccttgcaattgaggttaatgatctactaactacctttgtgttgatcagattgtgtacaatctggaaaagacaacgactaatccaaagaaatgaaactacagaatttcaggcattgtaattatacctgtaagaagttaacctagcagagaaaacgtttaactatccctcccatcaccatcaccattcattctatttgacaaacaggaggcatccaaatatttgctaggggaaagtcatccctgatcatccataaatcacactgtaacaatctcttctcaacaaagcctgcagtaactaaacctcagaagttcactgttataaactttttctttcaactttacaggggctgtttagaaatatatggccaaatctgtaacccggaaacagcaaaaaacttcttagcaaaggatcactaagtaccctttggatgtactcttccaaccagacaagagtgccagaaacttggcaagcaattcatcctgtggaagttgcaaatactggctgacctgcttaaaaagattctagagttggccggaggcagaacatgtcaactctttgctggattctatttcatctgctgttgatactgatctcaatgcaccaaggaaaggaaagatgagcctcctgtcttccagcaacaaccctcacatatgcactgagtaaaggatgaatgtatggacacatctgggagtattttaaagaatgtatcttgccttgtgttgacccaaaccaaaaacatttttgaggggcacatgtggggtcaaaaagatagccaatttccattacatgggtttacaatttccattcttttgtgccacgagtgttagaatttaaatgaatacttttacaaagtctactttttgttcaaggatatgctgacccatatagtttactcttaaaattgtgtcaaggtatttctcactatactctaaaacaactagacttgaaaagaaaccatttgagatttgaatctaatggttaacgctattcagattttcccaaagatcttacctcatgaaagtagttctgggtcagaatgatctactcagttaaaaaacaacaacaacaaaaaactaagcgattgggaaaaaacaggaattttatctggttattgcatctggtgatagaggccttcaaagcctattatttctaacctaagtaaaggccccagtgaaaaacatactggggaaataaaacctctgagaaaaggttcaagcaccttttccaaatttaaatcttgccttaaattctctctaccacactgcctttgacactcttggaagtccatgtagttctctacagacagacttcaaagaaacgttaccttatcaaagactaatctgtgccacctctgattcagtgttttatgtctttcactttccctgggaaggagtaaagttcttttctacagctctgggactattacatttaattctgctcttgatagtcaaagaccatggacaacaactgtcatctgaaggactcttctagaagccagagactggtgtttgatggatgttttatactaaataaaacccatcagcatggggttatgtagaaaagcaatttattccattttaagcacttacacagttagtcatggagagtaacaggcctgctggtgaaacaggtcacccaaaatggagatggcatcaaactagtggtcaaggactaactcctaaaaaaaaaaagcaactcttatcaaggattaatttaatttttaaaacaaatacaagttattgattcactcttctcaacttgacagtctacctgtggtataactgtcaggtaaaaacatacatctttacaacttggtggtcccaagttaaaaaaaaaaaaaaaaaaaccaacaacaaaaaaaaaaacaccatttcacagacaggaaataaacaacatgaaaacagctcaagaaatacactaacgagcaaaaatatatgaatatatggggaaagaggaacgtgttgttttgacttaactgaagaaaccaagaggaaactggtctacgtatgaaaatgtgcatcctggaaagtcaggtgtcaagattttcgagtaggaatctatatgacttgaatctccccctatttcctgaataaaagtgacatctttcagtatttatacttcatggctcagacacctacctcatttggctctattccttactcactctagcctttacttaaatgagtctgaaaaacttggggatatagcataagaagaaaaataatcacacataatattcccctttctgtagctactttagacctgggttactagaaaattcctgaagaaaatttcaacgttaagtctgtggctttgttgaatcaagcccccctattaatatttagaaaacacccacggtttgggctaatagcattatcggtggtacctattatatagagggatagctgaataaagtctgtctcaaaaccagtgttaaatcactctcagggttgagaagaaaaaaggggagtctaaaatcacaacaagtaaagacatatctaggacccttgtccttctggatccacgcttccttcagggtcttcatcattataaatgttctctgcctgcccaaaaacaagaaaaagaatttaaacatgaagacttcttctaaaactcaaggtttcaacaacagattaggccaggaagccagagagtaaatactttatagcttttgggccacacaatctgtgttacaactattcaactcttggatgaaagtatccggagacaacctataatgggtaatgaaatattaattagcatgatcatgttccaataaaaataagcagctgatccccagacgcctgattaggacattcccacaaaactgcagtgtggatactatttgtcttgatagccaacattcttgagttctttaaccaggcattattatttttctttccttttgagatggagccttgctctgtctcccaggctggagtgcagtggcaccatctcggctcactgcaacctatgcctcccaggttcaagcaattctcctgcctcagcctccagagtagctaggattacaggcacatgccactacgcctggctaatttttgtatttttaatagagatggggtttcaccatgttggccaggctggtctcgaactcctgatctcaggtgatctgcccacctcggcctctcaaagtgctaggattataggagtaagccactgtgcccagcctaaccagacattattaataatagccaaaaagtaaaaacaacccaaatatccatcaactactaaaatggatacatggtatatccaatccatatgatggaatattatttggcataaaaaagccagtcaggccaggtgtggtggctcatacctgtaatcccagcacttgggaggctgaggcagacagatcacttgaggtcatgagtttgagactagcctgaccaacaaggcgaaactgcatctctactacaaatacaaaaatcagccatgtgtgggggtgcacccctgtggtcccagctacttgggaggctgaggcataagaattgattgaacctgggaggtggtggttgtagtgagccaagattgcaccactgcactccagcctgggtggcaaagcaagactgtgtgccaaaaaaaaaaaaaaaaaaaaaaaaaaaaaagctgtcacatactttaggattttatttatataaggtgtccaggccaggtgtggtggcacacgcctgtaatcccagcattttgggaggccaaggcaggcttatcacctgaggtcaggagttcgagaccagcctggccaacatggtgaaacgctgtctctactaaaaatataaaaattagccaggcgtggtgacaggcgcctgtaatcccagctatttgg

SEQ ID NO: 15107 - DNA, 6153 bp, Human
ggagagtggggtgcggggcggcggagcgccgggaaggggagactcgctcggcgcaggcaagcgctgcccaacgccttgcagctgcccccgagggctcgcgttccccggccctgcactctccgcgggtgtcactcgggcactgggctccgcagcgcagcccgcttgcaagtcagagcgctccgggccggctctgagcgggctccacgctccgcgctatataaccccgcgaccgggaagagcccgcgccagcctcggcatcggccctccctccgcccggcctccccgcccccgggcgcaccccgcccccggcccagcccccagcccgccagccgtccgcggagccgagccgggtagcccctctcacacggccgtggccgcaacctcagccctcctcgcacctcccttcgcagctcacgccccctcccgtggggtgtcctggcctccgcctgccgagctcggcagtcagcagagccccggccatcctcctccggccgtccggtccccactggtccctggctagccacttttcgtaagctagagcactccagaccgccccgcctgcgatcaggcgctgcggaagacagccctgtgggctggagcgacgacaaggacctcgcggagcggcgaaaggggtgtagtctgcgactaccgcggcagggagccgggagggcggccaaaagtgacttcgaattgcagctagccgtttggaacgtggcccaagaggctctcattttcctggctggaaccgtcgccgcggtgcttgcctgcggtcctggtcagccgttgccctcccgccgggcgggcgaagactggtgcatgctgggatttgtagttcgtccccatgaggctcgtcctgggaacattatggggaggaacggagcctaatcctgtcagcgcagcctggggattaggacccggagttgccaaggtgtcagcactctttgctcttgaattgattaaaaagtctaatcaaatgcatatattttcttcaaacaagttttacccgaaagtttgttgaaagaggctaaatcagggagttctttgcgtctgcaaggcggctttttagttctggattcttttccggcttattctaagacacctatgagtcgtggggcttctctcgcgaagtctttaagtggacagtacgcatgcgccaacttcctctttttccggctggaaccatggagggtgtagagtgagttgcttctggtcctcttgagaatccttctccatctccagagccagatactttttgtgtcactttttctctctctggccgtagcttgcacctttgcccacctccctgcttgattgtgaacgctgtgtgacaccagtggggacctgaggctagggttgggatgcgggcggtcttaggacggaggttttggagatcccgggaacgagatgtcgggttggaatgtgtgtggaacccgtcggttggctgacggcccagtcctcggtagagggtctttcgggggaggcgcagaacctctgaattgtgttcgtccttggctggtgcttggtacaggcctccctgccgccaggcctttgctttcaacatgtggatcctgattgaaccagagtggtggtggcttgttttttttttatttttattttttaatttttgcgcttaaagtctcggggtcagtgccttgcagtagtctttcagctagtacattttgttattcgggtgttggtgtgttttttttgtttttttttttaattagtcgtcggaggccgggcctcttggttgaaatagggaaaaacgtattgctattgtcatatttgtgattgcgttttaggcaacatggtgttaaaggttattgacatggagctaaaatatgcatcgtacactgtagcatgccagagcaagtaaagttactagtgactaaagtcagtgacagcatttctggtaaacaacactgctcagtacgggagtaatacagcgctgtgagctttttgagctattgataacatttttgtttattaacgttagagagaagaagaaggaggttcctgctgtgccagaaacccttaagaaaaagcgaaggaatttcgcagagctgaagatcaagcgcctgagaaagaagtttgcccaaaagatggtaagtaaactttttgaggcactagcacataaggaggcgccttattgggattgaggatgaggtgaatgttcttggcaagatttacttcctaactgtactgagtaattgcttagctccctaatgttacaatctgaaggtagtggggttttttggtgggggatgtaattgcatactgtggcaagaaaagatttaaaggaaacatgttgtagttttctttttaatgattggcattgctaattgtgattgagctaaaaattatgaataactgataattggttttcagcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagagggtaagttcagttttactgcattcgggtttgaatgggaaaaaaaaaaaaaaccttcacattacttctgggagccctgattctgaaacaccggagtaacaatattttaggggaagctagaacaaggagggtgctgatcactaatggtttagttgcaagccatgttccccaagctcctatcccttctcttaatagaatacagaaattcagtgtgtaacatgagaggattcctatctgtttaggtaggattcgatattcaaaactataatggttagtattaataaaaatttcgatgaaaggcaaatgcatttctggtccgttttcaccacagtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaagtctcttttctcctttgatttctatttgataaattggttatgtagcaacatgaattttagatgttttaacagtggtcaccttatttatgtttgctttttcacttcaggtaccccaatctgaagtcagtaaatgaactaatctacaagcgtggttatggcaaaatcaataagaagcgaattgctttgacagataacgctttgattgctcgatctcttggtaggttctatttgggggaaaatttggtattagaccatgcgataatttcttaccctcttgtggccgtacatttctcactattgtgaatcttcatgtgttccctatgattcttgatttagcttaaaagaaaacgtaagacatggtttcattagcttgaaccttatctttgtaaagccatgcatttaccttgtttattcctggttatgtttttatctcacagcctattcaaaaagattttgaataattatttcaaaactttttgcaactttaataatcttaaataaccttaaaatatttaggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgagagacctcatcctgagaaaggttgagttaatgttagagtataagtggtggtaatcttgaatacttttcccattaaatattgatgggggtttgaattttaatcagtgcttttgtggggagtgggggtcaactatcttaatgattacagttggtttgtttactgcttttgaggacctttctggaggaaaggaaaagcctgttttggggagtctttaaagatggaaattgggtggtcttaaaaatgtaaactcaatcattactttataactgcctagtttatgttaattgttagctgcctaaagtgttttctaatggttttcttttttcctttcaggtgtctaccatgattatttttctaagctggttggttaataaacagtacctgctctcaaattgaaatatattgttgtatttgtgatttgttgttgttgttgttagcctgcctctgtcttcccttaactactgtggcaagtgtggtgtgtgataaaattaagccaaatcaacagcccatttcgtgcaaaatcagggtcgagtctgtgtgaaagacatctcttgggtttttaaaaggcttttctatacaaaagattttaattttttgttttttaactgtgctgagtgattcgaaatgggtttattctaagaaagcctgtttcacaagcatttgtacatgatttgtcggtaaggtaatccaactttggtttatggaaaaaattgaatttagttgctaaaatttatttctcgggccttcgcttgtttataaactgccatgtaaatgtgttgttttccttttgcattccatttttgtgttcttgttttgcatcttttgccatacttacgtgagttactaataattgttacatactgtgggtattatgaaggaaggcatgaaatttgtgcccagggatgcaaattatttcagagcatctgatgaaattaatgggcaaaaacttcaaaggtttttttgtaaataacattcctttatacttcatgtattgtttcacctagactagtgaacaatgtagagtgtaacatgaagtacatagaatgagagtaaaaatgtttgtggtcctcatttagttgtcaaaggtctgacacactgtgaaacagctcccttagtaattattttggtactactgctccacagtcatttattgctttttaatattcgaaagttgctagacaaatagaatttctttgagttctttgttcctggttttgggacctatttctctggcttagtaagtttgtttagggtcagtgaattttggagagaaatcaagatgatcgtttataaaaatcattttacatatttatgattgtatcagtgttttgctagatgttttttgtcttagcagttgggtcaatattttgaaatagtacatggatatctaggtagagccaaagagtttattttttaattttcctttgtagagatgagatccacaccagcctgtattccccagcatgttactgaactcctggcctcaagcaatcctactgcctcagtcccctgaatagttgggattacaggcatgacccactgcctccagagggtttttaagttataaattcagttttgtcttactgctttggtagatagagagtacagttcccagtgttagcacatccagtgtcatgaagggtagttgtgcctcagaagatgtcagagcctgtttggcttccaggttttagaggaatagtgagggccatcagtggcctctgcagggtcagaattaagactaattatggaatgaagttgtacagatggtgtattgcttgcttaatctaggtgcaggtgggtgggtgcatgaaatgtgggaagtcttcattgggataggaataagcactttatatacagagagatacttagcaaagctttttttaaaaaaaaatatataaatatatagcccatgcagacacatattgtaagtgtggcctggggccagggaggatggggaaatgtgggaggggttgcagagaaccaggattcccatagagaacagagtaaagtgggataaccaatctggttttataagaggattgtgaggaacaataataggtacgaaaatgtttgtgagctggtggaacctattcaaatgcagattaacacctgattaggaaactcacttcttataaatgtcattgctttcaagggatcctcctctggaaggcctaaccaaccttaggggtctgggcacccagtaggttctcctacaagattacacctcatatatgtttatttcctgttcatccttctaaggtccggctttctctagtggatggtcccttagctatctcagtttttataaagttgtcttggactcactggcctttaaccagtgttaacctagttagtaacttctttgaaggttcatttgtggttcgctggattaggagtg

SEQ ID NO: 15108 - DNA, 21125 bp, Human
  misc_feature (1)...(21125): n = A,T,C or G
aacatttactaagaagaaaatattctgtcttggttattatttacttattcactgcctctgaactgatatgaattagctctgagagagtaagagccgtgtctgttttctgtcttcacatttttatcaacactgcctagcaaaactcccgggcctcagaaagcttttgttaaataaatgaatgaaaaataaatatatctttaaaaaactggaaacaaagcttccctggaacctcagctcaccagctcatgggaaaattaagaaggtatactgtatctacaggttaaacattaaaatctagaacttattttaaacaatttcaacagaattttaactgttgcatgtttccccgcattcttaatgagattcattaaatatgattcaagtttcttgatatctttattattttcattcgctactgtgtgatgttcacatgacatacataaggctctatgaaccagaatttgctttctgaaaatgtcctctatgtcaatcaagtctttgtgtgtattttcccccgtccctctcaaaaattaagtgaagcacagcacatctgtaggctacctgagaggtgcagcgtggttggttttcttcacagttgctaaacgaaaggcctactcttcttcagtgagatttttttactctctagaacagcagtatccatagaaatataatggaagccacgtaatttaaaattttccaaaacattctcattttgacatgtaagcaatataaaattaatgaaatactttacattctttttcttttcagaccacgctttagaaatctggtgcatgttctacacttagagcagacctcagttcagactagccacttttcaggtggccagtgactactacactggacagttgcagctctagaaaatccactcccaaacccctaagtgaactacatactctatcaatttgtagcttctactctatctcatttgtaccattgtttcacaatttggatagcattagagttaataaattttattttagcaactctgctccatgggtagtttctgaaataaaaatacaagcaaaaaaaaaaaaaactttcctaataacactggttctacagtataagctctccctcgaatgtctaatagagctttcgtagaagtgagtgttccttgtaggaacggtgagtcgagactggaggtaagaactaagacgttcttaaaccctactacgtgctggaatcctgaagtgcctgccatcattcaaacttaagcactaactctctagagagacactgccattcataccacagaacgagaaggcagtggcgatcctcaacggctacatgtcactgcctggtgagcactcttccctcagaccccattcccagaagctctgcctcgattccccaggggtaggcgagctggctgcccgaattcctaagcgttaccggggagatgtgagggcctccgggggcgggaaacctcaggccaggcgcgcgctggcccgctctacggggtctctcgggagcgctttgcagggcggatgactgacgggccagctacctgccttcctgagcctgcagagataaacagcctatcctccctgtgcacacaggccccgagggcgggcaggtctccaagcgcagcacaactgccccaggcccgacgcagccacctgcccgagggctccctccccaccaggccatccctcagccggtcctcctccgacagcgaacaaggaaccccggaggcgcggaggcgtctcgccgccacccggcggcgcctgccagaggcccttcgcgatgtccgcaagcagagaaagccctgccctcccaagccccggcttcccctaggcccctcgacacttgtagtgtcctcacttgcggcccctgacccggggctgaccggttcgtgactctcctgccaatcagagacagagttcttccggccaaccggccaatcaccgcgcgcgggtgtccgcttcggcttttcggcccttcggctcttcggcttgtcggcgttcgcggttgtttggccatccagtgccttccgcagcgccgctaaagcgcagttctcgttggtgtaactttttcttttttttttcagccacttccggctcctgcgtcgctccggaagcctgcgagttccggaagccttggtaatccagattcggctaggaaaagacaagctttccagagaatgtttcagagaaagttacgtggagcgtgggcgtttcgcagactcataaggtcagtgtctgccctagagagccggagtgcaaacccgaggtcttgttttcagctgggaggtcgtggagtttcacgaccttgtaattgtcgccgtttgcttttttttccctgtttattggcttcctgtctccctggaaaaggcaaatcaaagctgctgaattttgggaaaggcagtgaagcaaacctaaactcctaaagatgtttttaggatcgcggcattaaaaataaacacacacagctgcagttgagcccctctgcattccacgtagtaacttaagagacgaacttcgaaatctttttctctcatttggcggtcgtgaagatatttacctcttataaacggctttataaagaattgaggatccaaactttacttaatatctgaaagttcatgtaaagtgttatatgtagtacaaaaaatttgagtgcttagttttctaacactgttgaaagcgcacgtaaatgcagtttggttttcttatggaggaagagataatgaaaagtttctgataaaattgcttgcgataaattagttatatttcacgttgacttttgataagaaatctgaatgtgagaattgttaacattttttcctgggttcttaaattaaaaatcgttgtttgtttatttattgaggtaccattttccaaatttcccacatttagtgaaagggcttttggcaaaatgagcaagctgttgaacgttcaagtctaacacattctgttaaacttccgtgatgcccctcggaaatattttatcttgacgtttcggacaattaaatgatacttgggcgctcacaacaccgcagcttgtagtctaaacaccttcccctaaagtgttacctttacttaatcctgaacagaatgaacttggggtggctcttttaacttatctgatctcacctatgttatcaattacttgtttccagaaagattacagttgagtgatcttgagccagaaagagatttgaaagaattatttacagagtcaaaaaaaaaaacccttcatatttttttcttaaaaaaaaaaaatagaagtaacaggacatagagcgaatactagactagtagactgaagagtattagactaaatcaagacagttggattctagtcctgactctagttgcctttgtacaattttacctcttggccgtattctccttatttttagaaactagtgttagtactcaagctggggttttaaaactgttccataggagaacttgtgtagaaattttctggagccgtgcagggagagacaaagcaagcccaccctcaggtttattttaacaagagcagccatttaggtgttccgcttgaataacaaggttcttgttaagaagattaaatttatgtcttaaacgagatgatctgccttttcttctagcattaaaattctggtttttgggataattattcatttgtactcaatgtacatttattacagtttttaaaaataatatattcacagctaatttatttctaaaagctacaaatatgtccctattctgtttcaatttattttatcaatacaaatttgaaatgtttttctttatgaacagaattagaatttattattccttcttctccatatccttttattttagccataaaagttttgcttatatttgatgcacataatgattcttgccgtagggaggacaagtatttttcattttacatatttggtacctgaacgttaaaggtattagcaggcttgctcatcatcacacccattaaaagagctcagtcctagccccatgtttttctcacaacatcaaataattgtaagtttctttccctcttgcacaccatccacattctcaggttccaatagcacaaggaaaatgtgtgaatgtacacaatctttatttctggccagaagttctctcttgaattatttcattttttcctcttttgatgatctgagttggacaacctagaagcaaattggatgttctctgtacctcttttctgtgaagtgataacagtttgtaaatgtttcatgttccttttctattcctttggaatgtacaagaaatctcaggagaaaagccctaaattgctccatttgccctgtctgtaatcctgctcttttaaacccagccctgtagtttctttacatggaagtggaggcaaagaagggatgtctagtgtcctctgcctttctccgtgtgggatattagacttcttcctaacatattcccatctatacaataaaaataccttcttctatgttgcttcttactcaatttaatatattttctttttatcagacatctcccttattactgcctgtcaataagatgagataaaattccatccaagttatcttttctttcttcttactagtaaaacaaccaagaacttaagtgtaatggtgttttgattatgcctaaccactgtcttttcatttttttgagacagagtcttgctgtgttgcccaggctggagtgcagtggcacagtctcagctcactgtaacctctgcctcccgagttcaagcagttctcctacctcagcctcccgagtagctgggattacaggtgtgcaccaccacacttggctaatttttgtatttttagtagagacagggtttcaccatgttggccagactggtcttgaactcctcaccttaggcgatctgcccacctcggcccacttgtcttttagtgttagatgaatgagttggcattacctctaccttgcatgtatgtgttcgtaatagttaatgttcacaccttgagtttttcactcatctattccttttgttcagatttgacatggtcctttgaatggtcctttgaccacatgtatagtgaagcagggagaaggaatatagacaaaatacatcccaagcaacaaggaaaactttacctcattcctttaatttctttccccatctacagtcctgacagcttgactggcagtctggtcttttgaatgatcttgaaggggaaaaagatttcttttgagttctgtgggattaaatttgatccaagcttagcaaatatccattctactaagtgtattttgtatgttctacagtttttctgatgtttaccataaatttacttattaccagcttgactttagatgggttgttaatcttctcaagccttaatttttatcttcttaaaatggagatgataatactgtacttactgtgttgtgaggattaaatgaaataaagaatgtaaagaaaagttgtagtgccttgtacatgatatgtatcacatggtagttcctcctattccattgctaatggctctttgttcctttggggatatttccgtgttctcttgtaccataaaatgtgcaattaaatgtttgttccagttattttcaagtcatttagaattcttaagcaattagattctaaagcccatttttaaattatttatagggtatttaaacatctagctgctcatacatttcatgtgtgtcctgttcatactcgcactagtgtttttcccatagtttgtgcctatactcttagtacttggcctctttaaggtagccccatctgtgtgacctgtggtaccatcctaaagtgtttatgtttaacttttgggtccattaccgcgttgtcagtataggacgctggtttagagctggttctgccccctctggtcatgggatttcacacaagtcatctaatctctttgcacctcaatttccttgttttagaacagaagtaataacagaagctctttattagtattataaggattaaatgatttaatatttaaatttgtacttggtaattagctatagtagtcacttgttagcactcagtaactggtaggtgttaagtgttttctctggttgtaaactaacaagttcattgggattgtcttccttagtggtttactgttactctccatgaatactgtctctgtctcctgtgtcctgctctgatttctctattttcctcatgtcctgtattgctcttttgcaattggaaatagctgttcatttttttccctttcccttgcaagatttcctaaagcagtttctataaggattctagataggtaggtaaacttacagttgcttttttttgtttgtttctttttttagccagtgaagagtatagtgtaataaaatgacttgtctagagtcacacaatctgttagtgaacctgggctagaatacagagctaatcagaggcagtttaactctgctttccccaatactcgctccaacatctgttctttattttcacaataagcattctcagactcagaagtatcaggtttctgaaagaaaaaaatatgagtgccatgctgttatcttaaaaatatacttataaagctaggcccaagtattggaaattcttttctaaggtttaaaaaaagtattttgtgctagttttagatacttgaataactatattgtgtatgagataagtaaggcactcagttgattgtgtaagactcaatataatcttgagttgtgttgagtttcctcttctccctaaatgcaaaaaaaaaaagatattttcccctcttctagggcaggttacttaccattgtccatatttttgagaaatatgtgcaactttgaagtttatctttcagatacattttagaaatgttttgtcatgtatccactaccacttcaaaaagaaaaatcctatttggattttgatgaggcaatgttcattgaagttaaaagtaatttagaggtctgttggacataacacagttttaaaatttcacatatcttggctatacccaaatgagcacaactgggatttacaacatcaggtgtctataaactattaaaacttagtttatgtatggtgaaagagaggaacgagaaagtagtgacaaggcacttagcaagtctgtgacagaagcgggatttgaacttaagagttgttaggcctgttcacagtgccagaggtcacagtgttctaatgggcttcagccatagccttttttcttttgcccatatttgaaacgtgttctgggaatcagtgtccagttaaatccctctttgatgcacgtcccatttattagtattgatttcaatacattggacagtaaatctatctgactacacaaaggaaataaaatagtaggttataggttcaaaacttaagatgtctagtcatagaattttattcatataacctcataatatgaaatgctagtttaacattttcagaaagagaaaacaatgaacgtggtctcatccactttgattgccagaacatttaagatggtgtggcagtgacattttcattctaaaacttagtttattattgtggagatggaaaagaatagcctggcagggggtgcatgagtgggtatgacacagtagagattacttgagaatcacgtttctgctgacaaaagtttacaggactgtaaatttaaatgcagaattttgtagacagtatgcattgacaaatatgcctaatggtaatacctctaatactgagagtcttggaacaggtcaataataatgtgtatattgatagcagcgatgtaggagatgttacatggtattatagctaaaatccatgttatccccttaatcataattacgttaatattgacaggcccttgacaatacccacattattattgatagatttctgtcaataacatgtttttaaagaaaatatattcattcataatttgtactatactcaataaaactataaaatacatcctgaaacattccttcttcctcagtgagatacagtcatttgtttagtttttggaatgtgatatagatggcaaagtttttattttgggatatgaaaaacataaaaggaaagcatgagttatttaagggataaggttatatattgctgctcttagtaaataatttttagttgtctttttctgtgaaagaaaagcagtgtgacatgtttagtgataaaatgtcagcaggagacccttttaatagtttttagtactagatcattttgtcttaaacatatttatgtgacaagttaatcacacgaaccctagtagatgctatactttttatctggtcttgattttgccttaagcatctttttcacatatccttaacatggtagaatccttcactaaatgctaagattatttactgccaattataattttagttacatatttttatatatctctttgcatagccaataaatatatctctcccctcccctgggttagcattttggaatcttaaagttagtataggtcgagaattgcaggagtgggtggctggtaggattgtgtatgaaaaggtagaataggaaaaatctattagaattaaatttaatggtggttcaattcaaagcaattctttttacaaaaagcagcttgtaatttttaaaaatattcaagtttgagcttacatttataaaactaaatactaatttacaatgaccaataatatagaaattgttaaagcttacttaaatgattgaaggtaaagtcaaaatagacttaccagtggttgggcatgggtgttggcaatccttgtaacagaagtaaggagagtactagtttaccaaaagcactgggaatttttgacccaaaaatgtgaagggatagtatagtcttcctcttgatttccatggttcttaagtaagttaaattactttgacttttcagggaagttgttagcatcataggtaggcccctgaattgttgcaggaatcctataaatctggtctcccagaacggcagtttttcttttcttcagttttattgaactctgccgtcagattaatcttttgaaatttatatcccattatgtctcttctcttcaatgattattcatgcctacagaatcaatacaatttccttaacacaggttctttttacaatgtggctaggttgacacttcagccagtctctcctgccagcctgctttggtcatgacagatgacttgtctccttccagataacagatgcagccacattgacgggggttaaataaccaaggatgtagctcatggtgcaactcatgtccgtatgtcccagctaggctatggtcaggagcttgctatttctgggctttcacacagcctgttcccttgccttacataccattttcctcttttctccctggaaagttttgtgatcttttataatgttttcacgttttgggatccattcttcacttcagagatcaatggccagtcctgatttcctatgtcttttaaaatgcttgaataaaaggaagctagctgacagttaaatatttagattgaatctctggtacctaggagaatgccttgtatttgataggtgtccagtatatatttgttacattgagtaaccatttgtcagagaattagaattcactaaaacacaaactgcttacactatattgggaataattttatgtgatataaagtcgtttatggcatttatgcttcatacctattataacaaatcttgttgtactgctgtagagggaagaagattccataattgggttaattgaatttctagttattttgatttcatcattttcttctactcctttgctgcccttttctaaagagagtattctagaatagctgtacctgccagaaagagaggagtggggtgggagtatgtgtgatgaggaagaactgaatgtaatatgctggtgatgaatacaagtttgttgcttgtcttggactgcctgtaccatgttgtgtgcagcaaagcaccctagagtcaaatattgtaagtgtgcattcatgaggtttctttacttcaagataacaggcacaactatgttgataggggctaaataatgacaggagcaggtcatgcgggaacccatctcttttctctatccacactgtgtcatatcctttcagacaaggtgcaagttaagtgggcagtgagttccactgaaccatcatatctctgcccactcctgcctggcccctcccacgtgcacacataagggtgacattatgttcgtggtttaactgccacaatttatgtcttaatgatgtcaatatttcctggaaaaacattttgatacaggttgattgaggcattactataactaacagtgaaggtttcagtctttcgaaatgagatttgccaaaattagtttggggcctgttacttttcatgctcatccctagccaaagcaacaataatgtaataaataatactgctttatggcttctaaaccactttcgtaacattatctggtttaatctcaacaactttgtgaggtagctgttatttccaacttttaggagaagaatccgaggctaatgaagttttttaagatctcatagcaagtaagtgacagagctagaacttgagcccaggcctgtttgattttaaatctgctttttccactctgtgacagatgcctaaagaagaatgtagagcatgggagaagtattccactttaatgaactatggtgtgtaatagacagtgtctgttctatgtttacaactaaaagaagtcacaaaaatgactaaaatgttggaaaataaaacctaaaacaaaaaatagagagaaattattcatctggaggagcaaaggctgaagaacagtttaataatatctttggtctattaaagagtcttacgtagggaggagagcaaacccagctgttcctaatctacactgaggccaggccggggaggaaaagaagaaagannnnnnnnnnnnnnnnnnnnattcttctgacaaaccactcactctgaccagtttctcactaaatatcactaaggaacctgaggaagagatgcagttatgagttgcttatcaagggggtacattctgagaaacgcatagtttgatgatttcatcattgtgcgaacatcatagggtgtactcacacaaacctacttggtatagcctagttcacacctcgttatattttactgtgctttcttctggtttgcagatactgcttttacaaattaaaggtttgtagcaaacctgagtcaatcaagtttatctgcacaattttttttccaacagcatttactcaacttggtgtctctgtgtaacgtttaggtaattcttggcaatatttcagacttttttttattatgatattcttagtggtgacctgtgatcagtgatctttgttattactattgtaactgttctggggcaccacgaactgtatccatataagatggtgaacttataaatattctggggcaccaagaactgtatccatataagatggtgaacttaacaaatattgggtgttctgactgttctgctgacttgcctattccctaagacacaacaatgttgaaattaggccaattaagataagcctacaatggcctcttaagtgttcaagtgaaaggaagggttgtacatctctcactttaaatcaaaatctagcaatgattttgctagattttgctaagcttagtgaggaagccatgtcagaagccaacacaggccaaaaggtagaccttttataccaaacagccaagttgtgaatgcagaggaaaagttcttgaaggaaattaaaagtgatcctccagggaacacatgaattaaagaaagtgaacagccttattgctgatgatgtgggacaagttttagtggtctagatagaagatcaaaccagccacaaaattcctttaagccaaagcctaatccagagcaagttcctaactctcttcaattctttaagacaaagaggtgaggaatctgcagaagaaaaggtggaagctagcagaggttggttcgtgagatttaaggaaataaccatttatgatataaacatgaaagctgaagcagcaaatgctgacatcagagctgcagcaagttatccagaaggtttagctaaataattgatgaaggtgactacgctagacaatatattttcaagatagacaaaaggcttatattggaagaaaatgccatgtaacactgatagctagagaggagaagccaatatgtggcttcagagcttcaaaggacaggctgactctcctgttgtgggttaatgtagctggtggctcttaagttgaagccagtgcttatttaccattctaaaaattcaaagacccttaagaattatgctagaactactctgcctgtactttataaatgaaaaaaacaaagcctggatgacagcacatctgtttacagcatggtttactgaatattttaagcacacaggtgagacttgttcaaaaaaaattatttcaaaatattactgctcattgatatgcaccttagtcacccaagagctctgacgaagatgtacaaggagattaatgttttcatgcctgctatcacagcattcattctgcaccccatggatcaaggagtaattttgacttttatattttttttttaagaactacatttcttaagcctgtagttgccaatagcaatttctctgatggatctgggcaaagtaaattgaaaaccttctggaaaagattcgccattctgtgtaccattaagaacatgattcgtgagagaaggtcaacatatcaacatgaacaggagtttgtaagaagttgattctaaccattgtggatgactttgaggagttcaagacttcagtggaggaagtaactacagatgtgatagaaatagtaagagagctataattagagtggagcctaaagatgtgactgatttgctacaatctcataatagaacttgaattgataaggacttgcttcccctctttttttttttttgaaacgaaggtcatgctctggcactcaggctggtgaacaacagcacagtcagctcactgcagcctctcaatctcctggactcaagcaactctcctgcgtcagcctgcccttagtagctaggactacaggtgcatgccagcacgcctggctaattttttttttttttttttttttagtttttgtagagacagtgtctccctgtgttgcccagaaatcctcccttggcctcccaaagggctggaattataggcatgagccactgcacccagtgagttgcttcttatggataagcaaagaaagtggtttcttgagatggagtttatacctggggaaatgctgtaaacattgttgaaaagatagcaaaggatttagaatatcccataaacttaattgataaaacaatggcagggtttgagactgttgactccagttttgaaagaaggtttactcttggtaaaatgctatcagaaagcttcgcatgctacagagaaatctttcatgagatgaagagtcaatccatgcagcaaactttgttgttgttataagatattgccacaaccaccccagccttcagcagtcatcaccctgatcagtcagcaggcatcaacatcaaggcaggaccctccactatcaaaaagattataactcactgaaggctcagatggttgttagcattttttagcaatcaagtaatttttaattaaggtatgtacattgtttttaaggcacagtgctattgcacacttaatagactgcagtatagtgaaaatataagttttatatgcactggaaaaccaaaaaagttgtgtaacttactttattgtgatatttgctttattgcagtggtctggaacctaacctgcagtgtctctgaggtatgcctgttttcttatgtgattctgatgaagtcacaagtttgaaaaccactagactagaggagcagagaccacaggactgtgatggtgaagaccacagtttagaaggattaaaagcccagagatatatgtatctttatcatagacacatatatctgttagcagttaaaaactaccagaataagattacgttgttacaaagaaagttgaatgtgttacaaatagacaagatctatcttgttttaaatcactgccttcttgattttagcacttatgtagatcaagtagatttaaaatagattagttttaccagaggggcatcagacttctaaaattctacccagattttttctgtcatatttacataactgcctactgaacttttccacttagatgtctcataggatcctcagatgtttaaaattgcatgtatatattttctttctgttcaaacctgtattgcctcatgtatttcttgtttcagggacttggatcactatcactcaattacttaagtcagtttttcttggcttatttctctccagatagtgtcacttctaccacctcaccgctgtcaaagataacccttttctctctgtccccattgatacttttctaatttaggccatcattagtttctcactagatcattttaacaacctgttaactcgtctctatgcttccagtctttctctcagcctctattccattcttgctcagggtggccagaacaagtagtctaaaatgtaaatcttactagttatttgcgtaccactattgggggcttcccgttaccttcctcataaaatacagcctcctcagcttggcttctagggcctttaggacctgtctcctgcttctttccagccttatctcatctgtgcacctctagtccttagtacctactcttctcaccattggcaatagtattcttaccctcctttaccaggctgacatgctaatatcaggtggctgcttaggtattgcctctcccaggaagccttctctgaccttctgaagtatagttgtaaccatagtgccctgaattttcccttgcatatcactgatcgcaccttattgtaatcacctgtttattttatatagcacacctttacttttctctctcgttccacaaccctccacaagggttgaaaacagtgtctgttgtaccattatatcactagctctcatattaacaggtaaataacagatgcacaataaacatggtgaaattagtaataatcatctttctggatatggtaatttgaaatagttttaaagggtaatggatgggaattgatattttctatccttcacacatcccagactttcatcctattcatttattcatttatctagtgtttgtagagtgccttctgtgtaccaggaactgagatagttgttctgattcaactgtgataaggctcaaataatcttcacaacaggctcatcctctagtggaggaaataaaccatttaaaagtagtttatgtacagtacatagaggccaagaaagggaaagaatagagtgccaagggaacaactagatgggcagcaacccaaatttggagtcagcaggaagtgatgtctgagccagtacttaaaatcttattatgagttttcagttaaaagattggaaacggactgttccacacaaagggaacagacagtgaagtctactggtgaacaggagaagggggtactttttgactggatgtgatgcgtaaggaaggaaagcaagctgggagtggatttggggaggtttgtgttttagaacactggcagtgtggagaatgcactgaaggaggcagaaggtaaggtagaccagtttgatggaatccatgagagaggagagcagccagaattcaggaaaaggcttgcgggggatagggagtgacagatgggttaggaaaaattttggaccacgtaccaacagtccttggcaatggatttgatttgtagagtgaggaaagggaactcccttttaaactttattcttttttgtatgtagcttctggcaagtatgaggcaaggatttcacagaagaacttggagcaaaaattcccactgtcatagctataggctgtccagtcttgagggagctgcaggaacaggaaaaaggtgagatctccccagaaaatcattggcatttatggtgagaagcattcctgttgtatatctggtttgagagaaaaatagctccaaacaacctgttattcattgatcatttttgtttcctggacttgaacttgttaaacatgtagtcttctgccactaagtcttctaggatgcatgggtaaatttagaacttccctcttgaaaacaactttggttgtcaaagatactcccaatttcaagaagtacaagtttactttaccttctaataaattgtgtttatcatctttttactaaaaatcataacagagtagaatttgaaaggactttgaaggtcattttatctccagccctttgttttatatgtgaagaaaccaaggcataggtcagggtcaggggaaatgacttgtcgaagaatatgtgaccagaccgtggcagtgagctccagcaggatccatgcctccctcagtaactgttctttctgttagggtattggctttttaaaggcctagacatgataatcaagcccggtgtggtgatagcccattttaatttttttgtgtttttttcccctagctttattggagtataattggcaagtaaaaatggtatatattcaaagtgtgcaatgtaatgatttcatatatgtatccattgtgaaatgactgccacaatcaagttaattacatcaatcaccacccgtagttacttaccacctgtgtgtatgtgtgtgatgaggacacttcagatttgctcttggcaaatttcaaagaaacaatagagcatattaactatgctattctggacatgagttcctcagaacttactcatcttataactgaaaatttgcaccctttgactaatatctcccatttctctcaccctcccagcccctaccaaccaccattttactctctgtttcaataagtttgacttttttagaatccacatataaatgagatcatactgaggtccattttagcaactaaatttaagcctcatttttttttttttttgtcatgggtggatttgccagttaataatatttaaaatatctgaactggtctatatactggattatggcagtgacttggtgttttaattatatcagcttgcacataatacatatttataataatatatgtgtattgaatcagtaagctgtacctagctaaccattcagcttcttatatttcatttaaatttttttccctttagcaccaatttgtttccttagtctatttatggcattattgtggtatatatttttatatcatagttttcttagagtactgtgtgatatatacatttttagtaccttaataatgatatttctgcattcttgttccttcatactaagatttagtactatttattttcggcaatagcgtgatagaatagtaaccatgtattgttcatttagttttctttttaacttcctttacacatataaaatgtatttgagaaagattaaatgacttgctgaaaaaataacacctttggagtcagtagtagtgctggaaaataaactgaggtcttgacttaaccatctattgcaatgttctatatagttgttgtatttattaccttcctgtatctcttcattagtcatgttattcagcctcctttctgttagcttcaggattttaatgtctccctgctagaatatctgaccaaagagtattgcttagaagtatatttgtggaaagagggtacagttttgttttgttttgttgttatttctttgatgaagagggtcaagaaaaaagaaaaagaaattaagaaaaaaaggcagggggagaaagaaaggctctgagagacgagacagaagtttcaagtaagaagtgattattcgctgtactatttgagactactgaaacgctcatcgcctatgtgtcctgtgtaatttgtgtatgacagtttccaggcataagttgaggaggttgtacaagatttcaactctttgctaatgttcttcaattgtattttttcctagagaccttcagagaagacatggcttccagaaaagagaatgcgaagagtgcaaacagagtgctaagaataagccagttggatgcacttgaactaaacaaggccctggagcagctagtttggtcccagtttactcagtgctttcatggatttaaacctgggctgttagctcgctttgagccagaggtgaaagcgtgcttatgggttttcttgtggagattcaccatctactccaaaaatgccacagtgggacagtcagttttgaatattaagtacaaaaatgatttttcccctaacctgagatatcagccacccagtaaaaatcaaaaaatctggtatgctgtttgtacaattggtggcaggtggttagaagaacgatgctatgatttgtttcgaaaccatcatttagcatcatttgggaaagtcaagcagtgtgtgaattttgtgattggacttttgaaattaagtgggctgattaattttttgattttccttcagaggggaaagtttgcaactttgacagaacgtctcctaggtattcattctgtattttgcaagcctcaaaacatacgtgaagttggctttgaatacatagaatagggaacttctctggcatgggtttgctgaatttctgatttttctcttaccacttatcaatgtccagaagttgaaagccaagctgtcttcatggtgtattcctcttactggtgcacctaatagtgacaatacattagccaccagtggcaaagaatgcgctctatgtggagagtggcccaccatgcctcacaccataggatgtgagcatattttctgttatttctgtgctaagagtagtttcttatttgacgtgtactttacttgtcctaagtgtggcacagaagtacacagtctgcagccactgaaatcaggaatcgagatgtcagaagtaaatgctctttagaaactaaaattgcttcctttgaggaaaaaaatgcaccgtgtttaaattcttaatattagtcatcctaagtataccatttatgtatcctttataaggaatgtgctcctagccactgtcttctcctttccaggcatgactgaaatctaatcactggaaaccatgtgattctaaatatattatgtaaatgttaatgtattatgttttttaaatcattgcattcaatttttaatgtcaagaataatggacagcttttgtcaggtgactactaacaatgctccttcattttactacttcttaaaacaaggttggattctaaagataaagattttggagactctgggatgagtgtgcatttattttcagagttgacataatatgataatgtgacaattatgagactgttttaaaccttaagacctgatgcctcagttgtaacttttttttttttttctgagacggtgtcctgctctgtcacccaggctggagtgcagtggcgcgatctctgctcactgcaacgtccgcctcccgggttcaagcaattctcctgcctcagcctcccgagtagctggcactgcaggtgcatgccaccatgcccgggtaatttttgtatttttagtagagatggggttcactgtgttagccaggatggtctctatctcctgatctggtgatccacctgcgtcagcctcccaaagtgctgagattacagacgtgagccactgtgctcggccgcctcagttgtaatgttatgcttttctctgaagccaatttttaagaagttcagtcctcagctgtctgacccctccacagttggctttatattcagaaagtaaaaattacttaaggcagcttggaagtgaggcctgggaactactgggggcaactagtatgaacagcactatttacaggtctctttctcttgcctttgattcagagctgtcattctcagtaaatattgatagttttattgaaacaaaaggggtctttagcatgggaatagtaacagcagtgcataatcaagataattctgtatccttcactctttttctctgcctttttttacttaaaagtaaattcagactcttaaaatggtatagaattattagcttgaacattgaattatctcgtcttaactagaatgttttttaaaaaacagtttttaaatgtttttaaataaacatcttgctagtatggtggaaatacactgccagttcatttttctcttcacctttcattgaacaagtactcaggtgccaggtactgatgtagccattagaggcacaacagtatattaagcaggaaaaatcaagttaccttcatggagtttacattctgtgattgaatgaactgtaagtttaatttaggttcaatttagtgtaagatactgaagaagttttgtagtttgagttaagagtattttacatcttaagaatttgccttcttttgccttctgtaattttaaaacattattgtagaaaacaccaacaattcaggaaaaaatataaaatcaactttcccacaattttttgagagagatcatcactatattttactatatttgtagatttgttgcacgtacatttcttatttacaaaattattataatgcataaaaaatagcattttttcctatgtataaatattcttcaaaactattttagggctgagcacaatggctcatgcctgtaatcccaggctccctacttagggaggctgagcccaggagtttgagttcgtttctaaaaaaataaaaatatatacaaacgtctttgttttttgtttgtttgtttgtttttggtgagaaagggcctcacccagtcacccaggttggagtgcagtggtgtgatcatggctaaccgcagcctttccctcccagggctcaagcgatcctcccatctgagcctcccaagttgctgggaccacaggcccataccaccatgcctggctaatttttgtagagatgaggtctcactttgttgcccaggctggtcttgaacttctgggctcaagcagtcctcctaccctggcctcccaaagttgtgggattacaggcatgagccactgcacccagccataatatatttttaaaatgctatgtatatgccatcatattcctattcctattattatttaaccaccatcatagagcatttaggttcttttcactttctgttgtgaataatgcaatgttgaatctgagttcattaagtgaagagtccagctgcacactgcaggcccagtctggatgtaggtgctcagatggttctctttgagacaggctttatcctttggctctcatttttttgatgagtgtacatggcatgagggacacagattccg

SEQ ID NO: 15109 - DNA, 26684 bp, Human
  misc_feature (1)...(26684): n = A,T,C or G
ctcttatttagagcctttctgtttctctcaatagggttggagagttatccttatcttctttttattggggcttaagaagagagatgaggttccatggagtaaacaatacaaggatataaggacctcatataatctcacgtatccattttccatgaaagccattcttggcacgaatttgccattctatgtttgagcctcataaaaggcaatgcatcataaatatgcactttttgggtagctggaatgtactttaaacgggaaactcaagaaaacagctaggaactctttatgccaggataagtcaaatgcactggcaatagatcaaataaaaatatctgagtaaatgccttccagatagaacatcaccctagttcttcagcactttacaaaaagatctgttctcagttcacattctcttaattccctgtcatttctccccggtcttccaaatatgttttttaaattatgattccatgtataaacacaagatcgtattttgcttttctatgaaaaattgagagccttctctgaaccataaacgtatctttctccaaaatgtattcaaatcaggcatattgaaaactgttttgtgttcgtgttgtgaggttttttaggggaccgcacagaaaccctcagcactagttagtgccttgtgttctaaatgaggaaacggaagccaaggacctgcaggtggctggggactgtgcacaggctggttccgctcaagtcacatgactcgtcagccagtgagtaggtctgggtagcagttggcatggatgaacatgccctccataggctttcagaccttcttcaaggccaaagggaaggccttcatggaaatataattatgtgaaacaccccagaattttttcacaaactttcctgcctataaacgccaggtcctaccactgtccagtgtcccacttcccactgtccagtgggaagactccctccaggacaaaaccaccctttccttcagggatgtgacgtgctgtgctttcgttgacagtcatgcagctgctagacatgtcacttcctagctctccattcgggtctgtgtcccaggacctaaagaaagctaaaagaagccgggcgtggtggctcatgcctgtcatcccagcattttgggaggctgaggctggcggatcactggagatcaggagtttgagaccagtctgaccagcatggtgaaaccctgtctctactaaaaatacaaaaaaagaaaagaaaaaagaaaaaaaaataagctgggcgtggtggcgcgggcctgtagtcccagctactccggaggcggaggcaggacaatcacttgaacctggaaggcggaggttgcagtgagctgagatcgcgtcattgcactccagcctgtgcgacgagagactctgtctcaaaagaaagaaagaaagagagaaagaaagaaagaaagaaaagaaagaaagaaagaagaaagaaagaaaagaaagaaagtaagaagcaagcaagctgaaatagcttatttttctgttttaaaaaatagacttttagtgttcacaagtaagaataaaaaaaaaaaaagcttggccttaggaggaatcctatctgcttaggcctctgagaggcagcgtcacctgaagggaaactgactgggcaagagccaggctcttaggagctgtctgtactttgcttcccatccgtccgctctcccccagcagccaaagtctcctccctccattatattgcaaatcaatgaatccattagactttccatgttttctttttagactttgagattcaaggtcagctagaattaatggttaacagctgacaggtgaaagtgtggttaaatgcagctttggctagcaggcacacaggcaaaatcaagttctacatctgtccctgtgtatgtcacttgtttgaatacgaaataaaattaaaaaaataaattcagtgtattgagaaagcaagcaattctctcaaggtatatttctgacatactaagattttaacgactttcacaaatatgctgtactgagagagaatgttacataacattgagaactagtacaagtaaatattaaagtgaagtgaccatttcctacacaagctcattcagaggaggatgaagaccattttggaggaagaaaagcacccttattaagaattgcagcaagtaagccaacaaggtcttttcaggtacagtttcagaacttactatttaacattcctctcaagcaaatacgccttgaaatgctttttttaaatcataggaatttaaaaacactttacaatagagaatgattgatttttaaaatgtgtctgatttagctttgtagagatgttccgctaatatccataactaatctgagaggaaatgtggaacaacagaagagtaacagtgtctactcagtaacaagcgttttacgagttaaaaagacatccaaatgcagtactgaaaaatcagaagtcttgatttgtctcactgatgactccgtttttcctagagcagtctgtttaatgcttactggagataaatagatttataggtgaccaagacaatcgattaatgtatcagccacagacttttttaaatagaaaattttctaagtaggaaatcattcatagctctttgaaagatatagggagaggcctcaaggaaagaaagaaaggaaaaaaattgggaaaggaaacaaagatgaaaaattggggtggggagagcggtcagatggtggccatgagaaggatctgaacacagagagcggcggggccggcggggaaggagggaggaggggagagcgctgcttccctgtgggttccggcttctgcagagctgtaagagttgaatgccacacacagtcacactaaggaatgctccaggattgggaaagataaaattcaacattataatgagaacactgtgaatgctattgaattaactactcccctctctccctatttcttgtaagtcttagtgtcagtaaactaattataaatttacattttatgttctaaaagcatgcacctttttctcattgtaggatgattttcttatatcaagtggtacatttcattttatttacttcagtttctggtggtaagtagagtgttatcttaactatgggctgggagagggaaatcacactgcaatctccacacatgtgggagaatcccacaccatttatgccgggaaggaaataaaatgtttttattaacttcctgcctgaggctccagaggttttcaaagcagggtaggaattgaggtgaaaaaattgtttgtactggtaggaatctgtgtctatatgtgtaccatatctacatccatgcctacatacatcattcatttaaatgatatttaaaagcaatattaaaaagaagaaatcttgatttgcctcactaattagttggtttttcataaagcagtcagttcaatggaacatacacacacacataaaataggaattttgtactgaaaaatgttatgtaactattcatacacagtttatgcatttcaataatttaactaccctgttaattctccaccctatgtcacatctgctaaatttgtttataaattacttagccaatattaagtaggatatatcagtacaggtattgtttagttccatgaccattctttatttaaaatgaaagctgaagcattcctttagaaaaatagcttatgtctacatgttatatttaatttctgatactattgctagcattttaagcatagtaaattctttttgctggcctatgtgaaaaaaggcaaacctaggtgaagatattaaaagtaaattccacttaatatattaaattacacagctcataatttcaattttctctgtgacaagactactgctcaggttataatattcctttgttataattatctggaaattgtattgttatttcattgataaatatgtcagcgctaaataatttgatatattttgaacactggacccaataactacataaacaattgaccctgaatcaggggttccacatccatggatttaaacaacattgaagtgaaattttttaaaaaaaattatatctgcactcaacatgtgcagagttttttcttgtcattattcccgaaacaacacagtataacaacaatttgcatagtatttacattgtactaggtattataagtaatctagagatgatttaaagtacacaggaggctgtgagtaggttatatgtaaatactatgccattttctatcagggacttgagcgttcatggattttggtatctgcaggaggtctggcagccaatccctcatagatatcaaggaatgatagtgtacatatttaggtcctttatacatgcacatggaacatttacaaatattgaccacacacaagcctctgaaacaaggctcaacaaattttaaggggttaaaattatactgatcatgttattcaatcaccgtgaatgggagctagaataataataaaaagggaattgaaaatctgcaaacgtttgaaaattgagtatttataatcaccgtgaatgggagctagaataataataaaaagggaattgaaaatctgcaaatgtttgaaaattgagtatttatacctttttagattaagatgaatcagagatgaaatcacaatggtaattagaaaaggaattgtacaataatgaaagtacagtatatcaaaactttgagatgtaaccgaatcagtgttgagatcaaatgtatagatttacatgtatacattagaatacagaaaagggaaaaattaatgatataagatgacaagaagatagagaatagcaacttaagtgctaagaaattagaaggcagaaagaagaaatcgcagaaattaattaaatggaagacacacatatttgagaggtcaacataacccctttctagcccattttataaggtcagggtaatcttgacaccaaaatctgataggaaaattctgaggaaaaaaagtcacaggtcttttatcttatgaacatatgtacaaatgtcctaaacaaaatattatccaacttaacccagtagattgttaaaaaaattaaaggatgattacattgtgatattgtgacaaagttgggtttattccaggaatgaaaagttgatttaacattcaaaaatcaatagatgtgtgacttcggggtacataccgaaaaaaaagaagggaaagcaggaactcacacagatatacttgtacacccatctcatagcagcattattcacactaacccaaaggtggaagcagcccatgtgtttatcaacaggtgactggataaagtgtggtacatacatacaaaggaatattactcaaccctaaaaagaaaggaaattctgacacatgctatgacatggatgaaccttgaggacattacgctaagtgaaataagccagtcacaaaagaacaaatactgtgggatctcactgataggaggtacttagggtagtcaatttcatcaagacggaaattagaacagaggttgccaggggccgaggggccaggggaagggctgagggttggtgtttaatgggcacagagcatcagctggcgaagttggaaagttctggaggtggatggtgctgatggttgcacagcaatgtaaatacccttagtgccacagaactgtacactcaagatggctacatggcacatggtatgctatctgtcataataaaaaataaaaataattttaaatgttaatatgtgccgaaaaatgcttgctaaaattctattaatgatcaaaactttaaataaactggaaatggaagagaactttcatcagctattaaacgatattttaaacaaaagcaaacaaaaatccaaaccaaaaatcttcaagaaacataatacgtaatagcggaatattgaaagctttcccaagggattgagaataggacaagaatacttcccattatttccatttactcttgactggaggtactcgttggtgcggtaaggaagggaaataaaaggaaaacgattaggaggaacataagctctcgtttttcacagatgatgtgattgagtacctagaaaaatccaaaattaaccatcacataaattatttgagccaattaattaaatgagtaagaagtctcgatacaacgtcaatatacaacagcaagcacttgctcgttcgcaaaagcagatgaactagtttttactgacactagaagcagcatgtgttccatgtgttccacatccatgcactcaaacaaccttgacgtgaaatattttttaaaaaattgtatctgtactcaacgtgtgcagagtttttttccaaaattgttttccaaaaatttttaaatgtttatatgtttagggggtgtaagtgcagatttcttacatacatatattatgcggcggtgaagtgccggcttttggtgtacccatcacccaagtagtgaacacagcctccaacaggtaatttttcaacgctcaccccactcccatcctcccatctagtggcatattgaaaatcaatttgtcttgtaaaattaaataatccaattaggagggggatatattctaagaaaattagtgcatgatgcacacacacacacacacacacagaacacgtgtgtgcgcatgtgcacatgagagagagtgagagagaaactgggtcttgctctgtcgcccaggctggattgcagtggtaaaatcacagctcactgcagcctcaaactcccaggctcaggagatcctcctacctcagcctcccgagtagctgggattacaggtggaaacaaccatgcccagctagtattttttttttttttttgtattttttatagagacagggtcttgccatgttgcccaggctggtcttgaactcctcagctcaagcaatctacctaccttagcctcccaaagtgctgggattacacgcatgagccactgcgcccactccgcattattaaatatagaacatttatttgattcatcagttaatattcttcttaaaagtactattttaatgtagcaagattgctttccaccaaaaggtggggtttccacggtggggtttccaaattattctcaatggggtgaggatgtgtgttatcacacccccgagccatcagatgctgtcagaaagtgatcactctgaagtctttgtttcaaataagcacagggtttggataaagagacgcaattaggaaaggaaaaagcagaaggctcgttccagacctggatgagatcctaaaaagcagcagcttttgccagtaaagatccttgaaatgattcaattaccctcaaagcactccttgtctccaagacaatcactcataagcacaattccattgaagccaacgtaccattttgtgattttcgtttccacctgaggctgttcattcaataaactcacataaaagtgtttattgccttgatttccaaattcaggcgtatttcctggtaagtagagctacttgccttgcctttatgagattaccacctaactagatgtatgcccagtaaaatccaacataacgcatgccatgtactacatcacagaatgtgtgactcagttgttgaaggacacctgctttgaaggaggggacattactacggtcttcacaccaagcgccaagtactgccaggtagtctgcacttaccacccaagatgtttactcttcactttcacggcggaatcaccatctgaggatcccacccgatggtaaatgcttatgtttctacatcgaggagacagatttttaaagggagattgctattcttaacacatttccatctaacattttataaaatttaacattaacaactggaagataaattgtctttcagttgaaatattgttacagaaagaagtgatggtgtttacgcaatttagaaaagaataaatatgcctccaagtgtagactttccagcctctcctatagtctcatattaatggtatgtttcttctgtttgtctcaatttttacacttcttaaacatttcacactttgcttttctatcgattattaatttttgtcgtgcttctcaacaaactggaacttctcccaactattttattagaaaaaaataaaatatttaaaaagataatttgaaaaaaagtacagtacagtgatccccctgccaccaccaaaaccgcaatgtttgctatatttgtacagcaatatacaatatacaatacctatatttgtatacatgtttaaccgtttgaaataattttaaaacatgacactttacccctaaatacttcagcatgcactatcctacacaaaagacatacgaaatttaacaagaattcctttatattatttcagttttccctcaaatataatttatagtaattaaccagaatcttaccaagagtcactcactgcattgggtggtttgtcaggtttaaaacattttaaacagtccaccaaccatttgtattcccatcctgagcttgaaaatttaataataagcctttctgtagaattaagttttcaacatctttattattgctacattcacaggcatttatgtagcacccagaacttataaaatttactattccagaacctagagcagggattggcaaatgtcttcttaataacgcagagtaaatatgttaggctttgtgggcaaaacccacagtaaagccaaggatattatttaagtatttatgtcaccacttaaaatgtaacaatttgaaaatataaaaatcattttgtatagctaacaggctaaacagaaacacacagatttttggttgcattttaccaacaggtcctagttgacacattcctgtttgttcctattagaaaggagtattacatgcagtctcttaagtgtagggatattgaagtaaaaaacaaactcagaatcttgctaagaaaatatttgttttggcatgagataaagtagtttgtttccttctttttggctttctgtgtgctgacttttaagatccattattttaaaaacataaattcctattcattaatatgtattttttaaaaaaacaggtttacttgtgtcctgaaagacagtgttacagaaacactgccaagagtgaataggacagcagcgatttctgggtattctttcaagcaatgctcacaccaaataagcggtaagatatgttctcagaatcaacaaataccagctgtgatgtacacatatcgccacatcggatgtggttttaaggctatgaaatgaaacactgctatgtggaaataaacccccttaatgaagttctttcagtgtagagtataaactagtatacatacatgcctgccctccaacacactgtaaaaacctctttacctcatagaaagacatatcttactacctcacttcccatcatttatttatattctttctatttcccagcctaaaatcttaaatgaaagtctttttttttttgagacagggtctcactctgttgtccaggctggagtgcagtggtgcaatcacagctcactctagcctcaacctcctgggttcaagtgatcttcctgccttagcctctggagtagctgggaccagaggcatgcaccaacattcccagctaatttgttcatttttcctagagacagggtctcactgtattgcccaggctggtctcaaactcttggcctcaagtgatctgcccgcctcggccttccagagtgccgggattccatggtgcccagtcgaaattctttattaaacgtattaatccaaattgaaaggagcaaatataaaggttgaagtgacacttgtcttaatagtgaatagatacttgaatcagttaattagcgaaataatcagtgcagttagggagaagagaggctaggtcagaaaatcaaaatgtgaatttacaagtctaaaattgttacagtgtaagaaggacattggcattcttttactgcttccattcaagaataagaattttgcagattaatataacgaaagacctctgaggaaaggtgggtgaaaaagttgaaaggatgagtcaggagggacagttgcttaggtcattgcccctagaatctggaaggtactcatgtcttctgcttttatttccagcttgcaacaaagacatttatgtggacctagacatgaagggcataaactataacagctcagttgccaagagtgctcaagaatgccaagaaagatgcacggatgacgtccactgccactttttcacgtacgccacaaggcagtttcccagcctggagcatcggtgagtgagtcccaggacattcgagtggtcgatgaaaaacagaatcgtgatttactaaaaagcttttgccatcaactttatgccagaatttattttgaacccctaaaagacatttctataaaagtactcctagttttcttcatgaaaaatacacttaaagcctaatttggatgcatttcatttatggtaaggagtctatcttttaataacactgtcagaaaaatatatatacttggctaatttcaaaagcgctacacttttaaattggcacttttgaaacagctgcaattggtatgattgtcagtgcccttcccagtctaaaaaatgttacagtctaacagaataaaaataaaaacctactctctctctctctaaataacagttccttacctaagacaaaatactcatgtaaaaagtcttatcctgctccatactggattttgaaatatttcaaggataaatctatcacataaggatttaaaaattatctgatctctaataaccaaatctgtgttctcatctttaaaaatttactagggaaatagattattaatttgtatattcagaaatatttgagatgatttagattttcatagtaaactgcatttatctggaatcaacagaaaagtgaaaaacattcaaattactaatacttgcgttttaacattggattttaacattctgctctccacattcacaaagaggagtgaacagaaagcaaacaaagcatcaacgagttatttcaaaaacaacagtggtgaaaaacacacacaccaaacccctaaattcatgatttgacttgtaaggcttatctttagctcagctcagacgacagcttttatgtctaagacttaacagaatgtgaactgcaagacaagaaattggaggtttctaagcaagataaagttaagtcattaaaagtaagaaggacttagccaggcgcggtggctcacacctgtaatcccagcactttgggaggccgaggcgggcagatcacctgaggtcaggagttcgacaccagcctgaccaatatggtgaaaccccgtctctactaaaaaagaatacaaaaattagccaggcgcggtggtgggcgcttgtaatcccagctacttgggaggctgagacaagagaatcgcttgaacccaggaggcggaggttgcagtgagccaagatcgtgccattgcactccaacctgggcaacagagtgagactccgtctcaaataaaaaaaaacaaaaaatgagaagggcttgagaagtcattcattcatgcactctccttcttcatgtggtcactctctcaagctgtcattatactgaagaagaaataaacttacacaattcacaggtgcttagcaacactgctgggaccatgcccagccattcagcctcccagatggatgcttcggggtctcgcaggtcctctctccaaaggggactttcttaatatctcatgttttttcctccttgcagttggaagaataagacacttttcctttttctttttattcagtaacatttgtctactgaagcacacccaaacagggacaccaaccagaataacgaagctcgataaagtggtgtctggattttcactgaaatcctgtgcactttctaatctgggtaattatcgacttcttgatgatgtaattcaaccattaaatatgctgatgattacagtagatctcactcaggataccagcttatgctcacgatgaaacggacccaaagatctttaccttcttcatgtgatagatttcatcatgtcctatacagttagatcctctatttaaatttccagtttaaaataatcatgccattttcttctaaataaaaaaaaattaaaagatcttgggatacacttaaattttttaatatggaatttacacatactgtgaccggaattttcctgatagctggtgaattgagtccctgacatagttcttccgtcgcgcagcttgtattagggacattttccctaatacggtgtttgcagacagcaacatcgacagtgtcatggctcccgatgcttttgtctgtggccgaatctgcactcatcatcccggttgcttgttttttaccttcttttcccaggaatggcccaaagaatctcaaaggtaaggagttaacaagtaaggataatttgttatcttctaaaaatagctgatcaaaatccatcattaaaaattccaagtaactaaaaatttactctaaatgtcagtataggataaaagttgcaaagaatttctagcccctctccctttctattccccacctacttaccacaaacccaacattaccgaggactctttttttttttttttttttttgagatggagtctcgctctgctgcccaggctggagtgcggtggcatgatttcagctcactgcaaccttcgcctcccaggtccaagcgattctcctgcctcagcctcctgagtagctgggactacaggcatgggacaccacgcccagtaattttttttgtatttttagtagagatggggtttcaccatgttggccaggctggtctcaaactcctgacttcaggtgatccacctgcctcggcctcccaaagtgctgagattacagggttgggccaccgtgcccggccagtaaattttaaaataaatataaatattacttcacctaaataaattttaggtacaggtacagttgtgttacatggatatactgtgtagtggtgaagtctgggctttcagtgtagccaaatagtatacattattcccattagataatttctcctgcctcaccctcctctatcctcccaactctctgagtctccaatagctttcattccactgtctctgtgcctgtgtacactttatttagctcccacttaaaagtgagaatctacaatatttgactttctgtttctgagttgtttcacttgagataatagcctccagttctatccatgttgctgcaaaagatatgattttatgatttttttatggctaagtaacattctatagtatattctatacaccacattttctttatccattcatttgctgatagactcttaggttgatccatatctttgttattgtgaatagtgctgcagtaaacatgtgagtgtaggtatctttgtgacatgatttttttttctttcttttcctttggctatgtacccagtagtgggattgctggaggtctccaccttggcaaaggggcagttgtctagttctaaatgaaatgaagagattccatttccatttcatgacaactaaaagacaattcagtccaatgctttgtttaaaataattgaaccaggaacagaaagagctgaaaatgtcagtgaaatgtcaaacccaaagtggagagagagagagaggtggaaatgaatgtctccatcaagtgggttagggtggtggtggagggaggtttgagaattgagtccctgtttccttaccaatggaaattaacataggacatcagaaacagcatggaaaatttctttgattatcaaaagtacactagctaaggttgctgtccctcttttatttatttatttatttgagacagggtcttgctctgtcactcagatttggttgcactgggtgtgatctcagcccactgcagcctccacttcctaggctcaagcaatccacccgtctcatcctcccaagttgctgggaccacaggtgtgcaccaccacccccagctaatgtttgtttttttgtagagacagagtttcgccatgttggccaggctggtctagaactcctggcctcaagcaatccacctgccttggtctcccacagtgcagggattacaagcctgagccactatgcccagcttgctattcctcattgacaacattcacttaaacaagcaaacaaatatccgtaaaattaagtcagctttaaaacctggcttgtatatatctctgaattggaactctcagagccctcagcacttgcctgattggcctcctgttgatgaaaagttgtcctccagacaactcagccaagggaggccctgtgtgccttgcctatcacatgagcctcactttccactgagtgaggctgtcatttcagaagcgccgggtctgtcacatgaaaatatatctgttaccatcacttactaaacaaatttagtagaatttgtttggtgcttattatgtatcaggcattgttctgaaggctggggataccatttagtgaactaaatcgacaaaaactttgcctattggaccagagtggagatgagagagaagtgaccagatcgatctgtgttatcagcagacagccaataagatttgctgataggttggaccacggattgtgaaggagtcagtgatagcaccaagacttttggcccaaggaactggaaagatggaaatgtcaatgacagaatgtggaggatttcgcaagcagcagagtgtaggagaagcaatgcccttggctcatctagggcaaagggttgaattggcaactggaaatagaagtcaaattcagaagagaggtttatgtggacatctgtgtttaggtgtcaccaatatacagctgatactttttaaaaatctagtgaaattatcaaagggttaaatgcagagagggaagaaagtaggtccaaagatcaagccttgggacattggaagtttagaaataagaaagatgtcattgtcacttgtaattttgtgctagtcactgctctttttctttgtcttattaccttactgaccaattcctagaataggaataacacatttgatctttaatacagtatgtgataggaacatggcttctataagcccaaacttggcaatttaaatttaaatttattaaaattaaataaaactggctgggtgcagtggctcacgcctgtaatcccagcactttgggaggccgaggcggtgaatcacgaggtcaggagtacgagaccatcctggccaacatggtgaaaccccgtctctactaaaaatacaaaagttagccaggtgtggtggcatgtgcctgtaatcccagctactcaagaggctgaggcaggagaatcacttgaacccgggaggcggaggttgcagtgagccaagatcgcgacactgcactccagcctgggtgacaagagaaagactatgtctcaaaaaaaaaaaaaattttaaataaaactaaaaattcaccttcccagctgtgttagccacatttcaagtgcccaatagccacatgtagttggcagttactgtattggatggcacaggcatagaatatttccatcactgcagaaagatctatggacagtcttgctctagactgtgattttgtctacttaggaaaagtcactcttttccaggaagatgcttccagggtgtggagtaaacgacggacttcacccatctccttataaacctattgcaaccctggataggaggtttctaggtagcatgaagactcttgaatctttaagataggctgggagtgttgaaaggaaggaaatgaaaagggaagatactaggaagactgacaatagagcaagctcagaaaatttttatggaggtgatttagttagaaaatttgtctgcaacctaagggccatggagtgtgactccgtggtttatgggtgtaactccgtggtttatgaagagtactttcaaaataggaaaatcttcacaactaagtgctagcatgagctgactttactttctctaggtgctgtaaaaatgtttttatgtgtttgatatgatatatttctacttcccttttgtttttgttagaaatctttgtctccttaaaacatctgagagtggattgcccagtacacgcattaaaaagagcaaagctctttctggtttcagtctacaaagctgcaggcacagcatcccaggtaaactgagagttctgcattctggctgagagtgaccagccccgaggaggctgatacatgctgagggagggtctcactctgacatgtggtctgctgtctagtgttctgccattcttcattttaccatgacactgatttcttgggagaagaactggatattgttgctgcaaaaagtcacgaggcctgccagaaactgtgcaccaatgccgtccgctgccagttttttacctataccccagcccaagcatcctgcaacgaagggaagtaagccatatgaagggttatgcagacacccttgtcccgtctgcctgtgaggtgcattatgtttataccgttttgtttccaactgcaggggcaagtgttacttaaagctttcttcaaacggatctccaactaaaatacttcacgggagaggaggcatctctggatacacattaaggttgtgtaaaatggataatggtgagtataatgtcacttgaaaaaatatagctgaaggaattattccatgcttcatacatcacaatcaagactgtcagttatagccacagaagggagaacattcaggaaataacaaattttgcaattttctattattttcactcctgtcactcaagctgaccatgttttaaaggtaaatattgaggcttgactaaactgtacattgcctagtattaactaaatatatgctttaatttgacacatttatacacctggcatttctgttttctttctttcttttttttttttttttttttgagacacagtctcactctgttgcccaggctggagtgcagtgatgtggtcagtgttcactgcagcctctggcttgaactcctggactcgaacaatcctcccaccttagctccctgagtagctggggctacaggcgtgcaccacaacactcggctaatttgttgtagagatgggatcttgccatgttgcccaggctggtcttgaactcctgggctcaagcaatcctcccgctttggcctcccaaagttctgggattacaggcttcagccactgcacccagccacaactggcatttcctaatgagacccagactctgccaacactcctgttatcaaggccagtaatctttcctattatcctttgtaagggaattatcgatcagcactttggttagtcaaattactaattttcttccaaaaattgtgtatctattcaagaaatactggagcacctcctttttagggtctttattcagattccatgcagggttctggagacttagggattggcaaaggttaaggtaaaactttactagtaacaatgagtgtggtaggatggaaataagtgtttagattacacgagacctgtaataacataaaagttacaataaaaatccaaccagcagtgtttccatcccagtggccaatttctgagcatagtcacgagagatgctttgtaggcaaacagaattgttctaagggacaaaatccccaacaggaaagaacacaccacaaacactcctgcttaaattaccatagtaacttaggatggctttactatatattgatttacataaagctgcatgttcttatactgtttattgccaaatgtccaatattacaatacactataaggtgcaactgagatttaatgaataaaatggaagtaacaatcctgcctcgtgatagttttagaagcacaaaaacattctgtgtcagattatctgctgtaccgagaaggcgaatcaatccttaatttctgagaacttgttttgtagaacataaagacgttatattgcctccaacactggtatcctaactaacagactatgccttcctagagcttagaggcgctccgatgaaaatctctggatggctcaagacttcttaaaaagcaagtcaattacgtcgtatctcatacattctgttttcctcacaataaatttccctaagacaagaaggagcattcggcaccattctgttgtctttcttctacttctaagcgttagaagggacacttagcaaatgttgctgttaagtaatgttgacatggtttaataaaatgggaatgagcacgtatacctcaatacattgcagactgcattttcccccttccttcttcattatggttttctctgttggatttatagactctggcctgtagaagttacagaatatgccaggtatagattgatagctacaggagaaaatgtaagataaaggaaaataaagtcttacgtcttttcagtgcaactttggagggagtgaattagataactaggtttttactgcgctgtatttgatgaaataaccccctaatgtgaaagggaatagctgcgtgagatatttatggtgccttgtctgtcactggtctacaatgtaacttaactttctgaagatagatagcagcaccattaaaataaacatttcttaccacaaaatatgattctaaacacatattttcagcatttcgtttaaactgagaaacagcataggatgaacctcaaggcctctcacctggaccttgagttatttctaaaatatcttagttactatttacctattaattttcctaaaatttacctttatgacgcttcccaccttgcagaaattccagaatagatggccctccaaaatgaatgttcacccttccggctctaaaatgagagcctctgttcaggcttccgaagtcacatcgtgctcgttctcacctcagttgctgttagctgctgtttccttccgaactccttctctcatcctctcctcctatttgaaatctgccccagaattatacactcattttcctaccaaggaaaaaaaggcctagaaaggttgttttacacccacaaaactagtgaatggaccttctaggacccggcttctcatcagtgattcttctgttaacttagactcctcccttagctcaggacgcggagccttctgagcacctgagcctggttattctaaatgtgatctgggcacagcacattgacatcacctgggagcttgttagaaagaatttcaggacccacacagatgttactgagtcagaatctgcattttgaaagctacacaggcaacccacaggcacataaattttgagtcgcataggtgtgtgcgtgtgtgtgcgcatgtatgtgtgcgtgtgtttgtgtgcacgtgtgtgtgtgtgtgtgtctagaatactgctgtctacgaacaccctattcccatccatctgtgttccatggctccaaccgggagggtgggttcttgtgtcgggcatccagtaagtagaaatagagggcactgtcctgtctaggcagccccaagagaaaagaaacagagggatgagcctgagtcaaagtccctgaaaagtaccaaggaccccagagaatcccaaactgtcaacaaggccaaaggtcagaggaagttcatagcagatcagtcttactttggacgtgggtggagcaggagtgactgggatcatggtcagcagagtcactgggacagggcaggaactggacaatggctgcagcctgcgggcaaggtgcttgccttttctttctaagagcagttctcaaacgccagcagggctggttcaaacacagatggctgagcttccaggctggagtttctcattcactggatctgaggttgggctgaagaatgtgcatttctaacacgttcccaggtgacgctgttggtctggggactgcacttgacaaccactggtttaaaaacaccattcacgttatcatttgaaggagggtaagacagccttgtagtaccacacaagggagggctacattcttaggggtgtgtaattacaagatgacttagtcaattccatttttcatgtgcatgttttgctttggcagcttgattataaagtctctgtaactcagggtcatgataaactattgacttgaggaaaggttttcttcttgttcctgaaggagcataattactgatggaaaggaagatgtaggaagctgctcatcacaatgcttctgttgcagagtgtaccaccaaaatcaagcccaggatcgttggaggaactgcgtctgttcgtggtgagtggccgtggcaggtgaccctgcacacaacctcacccactcagagacacctgtgtggaggctccatcattggaaaccagtggatattaacagccgctcactgtttctatgggtcagtaccacggctgtttttattagttcatcttcttcacacatttataaaaaatattactagcatgttaggaaataaatactttaaccaattagattgtcttatttgcaaaattaattaattgcttcagtggtaaaaaacgcaaaaaggaagagctcatggtctcccagcatcagaacaggtgcaggtacaaggctgcttgactgcctgctattccgcttcccatttaaccgcattcacatccccaagggccttcatgttattccctgcaagagcatacctccctctgtgcctcgctctgtgcactgtgcccggaactaaactcacagaggatttaccattgtctgaatcaaatttctaatatgtgtgtgtgtgtgtgtgcgtgtgtgtttaaatacagaaagtggccaggtgtggtggttcacgcctgtcatctcagcactttgggtggctgaggtgggaggattgctcaatgccaggagtctgaggtcagcctgggcaacatagtgagaccccgtctctaaaaaatatttaaaaactagcctggcatggtgttttgtgtgcctgtagcaccagctgctcagaagtctgaggtaggaggattgcttgagcccaagagttcaagggtgcagtgagttactacagtgccactgtgctccagcctgagcaacagagcaagaccctatctctaagtaaataaataaaatacagaacgagttcggtatgcatcctcacattggattccttacttaggtcactttcagcattggccaaacaaaaaggctccagctgggggtatatatattccagggaagttaagttggccaaactttccgtttgctacttcagtatcctccgagttgtttccagacacagttttgtgtgctttttagttttggttttcttttttaatcaatctgcagcacactcatgttaaactcaagaacacatgtgaggccaagagttcccgttacctgtcacatatgggaatggagtagcagaaagcctagtttctgtcacagctagttactggcgagattgagactgagtccagcggtcttcgtgtgtgtgtgtgcgtgtgtgtctgtgcagtgtgcgtgtgtgtgcgtgtctgtgtgtgcgtgtgcgggtgtgtgcgtgtgtgtgtgttggagcacggagggagtgctcattcattttttgtgtataatggattttctttatagggtgaatatgttttttatcccgaaaaatcttaggataaaatcacttttttctacctaaatgtccatcattggcagaaaatattagtaataattaaacagccacacacttcacaatgtctgggaattatttttagtaaaggaaatttctttccctctgttgtttgctccttagggtagagtcacctaagattttgcgtgtctacagtggcattttaaatcaatctgaaataaaagaggacacatctttctttggggttcaagaaataataatccatgatcagtataaaatggcagaaagcgggtatgatattgccttgttgaaactggaaaccacagtgaattacacaggtacggagaattttatccggaaagttgtctccaatggtgaactggataaaatgtttaacactactagacttacggcctgaccctgccaatctctccatgcgttatcatcatgaaagggagagggcctggaatgctagtcattcactctgctaaggctgacacactttcctggctattgaaacttattttgggaatgtgggtaaagagatacgttttcctgagtcttcttcaggtgcatagaatgacataatttcataatactttggaatagtaaagataatttagtctaaagataatttattaaagataatttagggatgaaggattgaaggttagaacaattaagcaacttgtgcaggatcaaagtgagttggatgaggagttagcggtgagggtgaggcttgtctctctctcgccctctcatcctggcacatgtgcgatatcgtgctgaacctgagggaggaaaatacacgacaacaaggcaaaaaatgaatatagtaaacaaagaaaacacagataatgtacagtggaagaagagtctcttctggaaaagaggatatattttgcgtctcatatttaaaccacgattttttaaatttagattctcaacgacccatatgcctgccttccaaaggagatagaaatgtaatatacactgattgctgggtgactggatgggggtacagaaaactaagaggtaaaaatgatgttgttatatgtgctccatcctagaaatgaagagcggaaccttttctgccctgtcaagtcatgtagctgaagcacaactcgagtcacactactcagttgcaggaagcggattaataaagatggagaggcaaaaatcacccaagtgaggctggtgcctcatatgtttgattggaaattttaaatgtgactaaatctctttaaagactaattatatttaatgaagtttaatgtgaagcctagcacttttcagtaaatgttctagcctgctatccaattactttcttgggaagtcattccagttagagtcataattaatttttgaacttaattaacattaacaaaatggtacacgcaatagtgggaataatgtcttcttcatacttgtaattataaaaggtctgtgaagtaaatctaacattttttccttctagatttttatatagacatgagttttgtgttgttgttgttttgagatggactctcgctctgtcgcccaggctggagtgcagtggcacgatctcggctcactgttacctccacctcccgggttcaagtgattctcctgcctcagcctcccgagtagctgggattataggtacccaaccaccaccccaagctaattttttgtatttttagtagagacggggtttcatcatgttagccaggatggtctcaatctcctgacctcgtgatccacctgcctcggccttccaaagtgctggaattacaggcgtgagcccccacacccgtccatgatttttattttaaatatatgtggcccagcaccactggtggctcacgcctgtaatcccagcactttgggaggccaagatgggtggatcacttgaggtcaggagttcaagactggcctggccaacatggtgaaaccctgtctctactaaaaatacaaaaattacctgggcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagactccgtctcaaattaaaaatatatatatatatatatttatatgtatgcatatatgtttatgtgtattgtgtatggttattctacaaacgaaccaaaaaaatttttttcagacaaaatacaaaatactctccagaaagccaagatacccttagtgaccaacgaagagtgccagaagagatacagaggacataaaataacccataagatgatctgtgccggctacagggaaggagggaaggacgcttgcaaggtaacagagtgttcttagccaatggaatatatgcaaattggaatgcttaatgcgttggggtttttttgtttgttttgttttttttgtttgtttttttttgagacagagtctcgctctgttgcccaggctggagtgcagtggctcgatctcagctcactgcaagctctgcctcccaggttcacgccattctcctgcctcagcctcccaaatagctgggactacaggcgccagctaccaagcccagctagcgtcttttttttttttagttttagtagagacggggtttcaccatgttggccaggatggtctcgatctcctgacctcatgatctgcctgcctgggcctcccaaagtgctgggattacaggcgtgagccaccgcgccgggccgcttaatgcattttaaaaagcagtcttctgccaatgagcagggaacacagtgtatttgtttgacttagactgaaatcaaaagcaaggagattgactggatgaacgcaagcacccaggttctctgcagtatattaaggggccaagacaacattttaggcaaaatcagcctgagcaagatgtgctgaagatgggaagcgtctgagttgatctgtgcaccttttcttgtctcccctcgttctagggagattcgggaggccctctgtcctgcaaacacaatgaggtctggcatctggtaggcatcacgagctggggcgaaggctgtgctcaaagggagcggccaggtgtttacaccaacgtggtcgagtacgtggactggattctggagaaaactcaagcagtgtgaatgggttcccaggggccattggagtccctgaaggacccaggatttgctgggagagggtgttgagttcactgtgccagcatgcttcctccacagtaacacgctgaaggggcttggtgtttgtaagaaaatgctagaagaaaacaaactgtcacaagttgttatgtccaaaactcccgttctatgatcgttgtagtttgtttgagcattcagtctctttgtttttgatcacgcttctatggagtccaagaattaccataaggcaatatttctgaagattactatataggcagatatagcagaaaataaccaagtagtggcagtggggatcaggcagaagaactggtaaaagaagccaccataaatagatttgttcgatgaaagatgaaaactggaagaaaggagaacaaagacagtcttcaccattttgcaggaatctacactctgcctatgtgaacacatttcttttgtaaagaaagaaattgattgcatttaatggcagattttcagaatagtcaggaattcttgtcatttccattttaaaatatatattaaaaaaaatcagttcgagtagacacgagctaagagtgaatgtgaagataacagaatttctgtgtggaagaggattacaagcagcaatttacctggaagtgataccttaggggcaatcttgaagatacactttcctgaaaaatgatttgtgatggattgtatatttatttaaaatatcttgggaggggaggctgatggagatagggagcatgctcaaacctccctaagacaagctgctgctgtgactatgggctcccaaagagctagatcgtatatttatttgacaaaaatcaccatagactgcatccatactacagagaaaaaacaattagggcgcaaatggatagttacagtaaagtcttcagcaagcagctgcctgtattctaagcactgggattttctgtttcgtgcaaatatttatctcattattgttgtgatctagttcaataacctagaatttgaattgtcaccacatagctttcaatctgtgccaacaactatacaattcatcaagtgtgattttttttttttttttgagatgaagtctcactctgttgcccaagctggagtgcagtggtgtgatctcggctcactgtaaactctacctcctggattcaagcgattgtcctgcctcagtctcccaagtagctgagattacaggcacatgccaccatgcccggctaatttttgtatttttagtagagacggggtttcactatgttggccaggctggtcttgaactcctgacctcgtgatctgcccacctcggcctctcaaagtgctgggattacaggtgtgagtcactgcgtctggccatggaaaatatttattgagcacaattatgtgagagcatcatgctgagctttgaagatacagtggtgagcaaacatatatcctggcttcatgaagattatactctagttaacatgagcaacaaaataaaataatcacacaaaatatataggttcaagctgaaatgagtggctgcaccagattctatgagataagaaaggaagaaggacatttttcaccaagttcaaagactgggatacaaaggaatttgtcctgacaaaggcaaaacaaaaacaacaacaaacaaaaaacccaaaagagcaaaatgacagtagaacataacggggccagatcaaaaatgctgacaggttcccaaaagaataaaatgacggtaggacatgacggggccagatccaaaatgctgacaggttcaaacaaaattggaattgaaaatcagagtgcgttcaagagtatcaaacaatactatcttgttacttgcttattaccttagtagactggaagcaacacttcacacaaaaaaagggtttggatgtaatttcggataagaagagatgtttctgtaaagtctttcctgagaagcatattatttgagaaaaacacatatttctgtttttagtatttcactttgtataatgtcttaatttttgaagagctggtatattcctatgattcattaatgaaagttctataagatataaaatatacaatgaggagatctcctcttctgtaccagaagagtgcacattctacacactgcgtagcacctttctcacttacgttctgtctgggcacacttctgattgac

SEQ ID NO: 15110 - DNA, 26684 bp, Human; identical to SEQ ID NO: 15109
  misc_feature (1)...(26684): n = A,T,C or G

SEQ ID NO: 15111 - DNA, 5334 bp, Human
ctaccttctttcttctgtgaggggaaagggaagaggtgtgagttttggcaggagatggtatcatcaactgaaggagagtatatcaacttaagattgtttcctggaaatacaatttttaaatactaaatgccaggttggtgaaagctgtttcaagtttgaatacttctttttataaccactagatggagcttaaagactatcttatataatgctatatgcttttaaaaacaaactctaaactcgttcatctagaaaaaagaatagattttttattcagttggacaacctttcatgtacactaattacagctaactagttttcaaagaatgatatatttatacttaatactaaactatagaaaataaaactttaaagattaagaaggaatctaaatgtcgataccattgagtaatgatataaacaggttcttttgttgtttcttgttgtcttcggtgctgtattacaaatataattcctttatttgtgacaatataattaaatcctcagtatccattcagcaaatgcttgagaaccaactctgtgaaatacaattttcacatgttttggaaaagttaagccttgtaaattaaatctaatttgttctttaaaaaaaaaaaagataaaagtcctcgttttcacaaactcattttggtcacttcgtcaattatgtagagattctcctatgttcctagttacagaagtatcaattttattttctagctttggtacacttttcatgttggattacgatgtgagattttgaaacaactgttataatttacattaaatatcatttttaagttgcatatataaaatggaatatcaagaaaagtttaaacaaacaatgattcaagttagattagtagattagattctgtagtaggatgaacccacataggtaagagaatttaatttttccttcttagacccaaaagcaacaatgagtaacagaatttttaaccacaacacattcttaatagaagggtgtttttttttttttttatcttagtaccttgttgttaactatcttaagatcttttcttatttttgtaggcttctgttttggaaaatctgaggctagcggtacgatctcagcttggatttacttcagtcaggcttcctatggcaggcagatcaagcaacatttggaaccgtatttttaattttgcaagatcacgtcattctgggtcattggctttggtctcagcagatggagatgaggttgtccctagtcagagtaccagtagagaacctgagagaaatcatactcacagaagtttgttttccgtggagtctgatgatacagacacagaaaatgagagaagagatatggcaggagcatctggtggggttgcagctcctttgcctcaaaaagtccctcccacaacggcagtagaagcgacagtaggagcatgtgcaagttcctcaactcagagtacccgaggtggtcatgcagataatggaagggatgtgacaagtgtggaacccccaagtgtgagtccagcacgtcaccagcttacaagtgcactcagtcgtatgactcaggggctacgctgggtacgttttacattaggacgatcaagttccctaagtcagaaccagagtcctttgagacaacttgataatggggtaagtggaagagaagatgatgatgatgttgaaatgctaattccaatttctgatggatcttcagactttgatgtgaatgactgctccagacctcttcttgatcttgcctcagatcaaggacaagggcttagacaaccatataatgcaacaaatcctggagtaaggccaagtaatcgagatggcccctgtgagcgctgtggtattgtccacactgcccagataccagacacttgcttagaagtaacactgaaaaacgaaacgagtgatgatgaggctttgttactttgttaggtacgaatcacataagggagattgtatacaagttggagcaatatccatttattattttgtaactttacagttaaactagttttagtttaaaaagaaaaaatgcagggtgatttcttattattatatgttagcctgcatggttaaattcgacaacttgtaactctatgaacttagagtttactattttagcagctaaaaatgcatcacatattcatattgttcaataatgtcctttcatttgtttctgattgttttcatcctgatactgtagttcactgtagaaatgtggctgctgaaactcatttgattgtcatttttatctatcctatgttaaatggtttgtttttacaaaataataccttattttaattgaaacgtttatgcttttgccaacacatcttgtaacttaatatactagatgttaaggttgttaatgtacaaaaaaaaaacccttatactcacctgcgttttcatttgtttgacatttgtctattattggatttcattatcatatgaacttgtcagtgggaaacaaactgtctaaaaatttttctcttacgtttaacatacaatcatgtgaaatttaggcagagttcgataaattactggcaaaaacaaaactcttttataaagattttctaatgttgactttaatactctaacatggtacaaaccaaatggtaaaatcccaagtcatttcttttttcatctctatttagcaacagaattaagtggatgaagatattctactatgcattaaatcttgaactttataaaacatgtacaaaaattgtacaagataagttccacctggtaatgtctttccctaatacagggttgcgcttgcattggaccctagggatttgcactaaaattatatcaaggtctcagatgagcttagtgcacaagcactatcactttaaatactattatttgctaccacagcaactatatatttccatagcttttggctgggggcgggggacatttttattacaacttgaaattgctttgctggtttcatatttatttgttgtatttaaaaaatacattgttgtaagagtgattttttcaatatattttattcctgggggggatcatgctacactctcaaaagaaaattaagaaatcattcagatcatcccccctttttaagtagtgtgaattgcaaaacccaacatattttttttactgtcagttgcggtttatttattctttaactgtctgttttagtagtttaatgattatgaaaaatgtatctgtgtgtgatttgctatttattaaattttaagtactttgctgaatgtcattttaaagcatgtttgaagtcttgtgtatttgtctgtgttaatgctgtcaggaggaactgactaagatgttttaatatgtatcaaaaattaaaatgattttttttattgccttgaggtactttttaaatcaaagctgttctttatttgttgaattttggtgcatatacaaattcaggccataaaatatgcaatatatctagaataaaaatgattagaaggagatcattccttaactactttatagtaaagtagtagcttttaccagtactcgagggtaaaattttctaaggacttgaatattattttgcttgagattgcccttcaattgatgtatctcacaagatgagagagtttaattgattaaactgccttttaattgacgtatctcacaagatgcagtaacacaatcagttctctttttaaattgttttcacatacattttagacccctataatatattctactggcagaatttgggttaccaaataatcttttatgccctagtactaatatattatcaagtacaagggttttggttttctagcatatgttttaatttattattttaattaactaatacatcatcctggttcaaacagtaaaatgtaaattcctcttctatcccaacacccatcttttagttcacttgaaagagacacatatcagtaccagattcttgtatatctctctagaaataaccatatatgtacataggcatatcagtaccatatatagtaatgcaaattgtaacataactatgcatacattttctgtaccttttctcaaagggaaataatacatcattagagtttgaatattaaaagtaagatcaagcatttctgttatttgttttttttacatttaaatcattgatctctcctgaatttagggcttcactatcttttttccagatgactacctagttgtcacaaagctatttattaaataataaatcctttccttactaatttgaaatggaacttacatagtacatttccatattatttgggtatgtttctacactgtattttcttctgttgatctgcttttctctttttgtaccaatcctttattgttttaataactgtgatttttaagtgtttcaaatattcttatttatatttccatttgaatgacaatcaatttgttgagttccacaaaacatccatgggtactttttttttttttggacagttttaattttatagattaatttaggggaatttgacatcattatcatgttaaagctttttatctaaaccatggtgcactatctaaaaatcatgccccttcatctttttttgtttccttcagatgaattttacactttacagagatctcatacatttttaagagtttattttttttaatttttacattttattgcctttattaatgaaatcctgtttataattttgcctaattttagtgcatgtaaaggccaattatttatgttaattttctacctggctacctgattccatttttttgttgtttttaatagtatttcacttaattagtttgtgtttgccaactacacagtcctgtcatcagcaaacactgataatgtaaccattgttacagtttgcattcctctttgtatcttaattgcattgtctagtacttctaaaataatgttcaataactggctataatgaattgagttgagatagatttaatcatattaaggagtatcaactaatccctagtcttaaaactttttaaagactgcatgtttaattttatcacatgccttttcgacatctgtggagatgatcatatgattttttttcctttgatcctttaagatgaattttactaatatattttgtaattttgcactatcattacattctttaaataaattctttttggccatgtgtatttttttaatatattgctagactgcacttcatattttatttaggatatttggacttgtattaatcagtagtctatagtttgtgtgtgcatgcatacacgtgttcactttgagaagtgtagtattttatgcttgtggatttggaaacttccctccttttacaatgccctagaacagtttaaatagcattgaaattttctgtttcttaaaatttcagtgaa

SEQ ID NO: 15112 - DNA, 71863 bp, Human
  misc_feature (1)...(71863): n = A,T,C or G
aaacacttagttcaaatttagctctttatttcatttgggattttattttattctttttttgagacagagtctcactctgtcgccaggctggagtgcagtggcacgatcttggctcattgcagctccgcctcctgggttcaaacgattctcctgcctcagcctcctgagtagctgggtttacaggcctgcaccaccatgcccagctaatttttgtatttttagtagagacggggtttcactatgttggccaggatggtctcaatctcttgacctcgtgatccgcccgctttggcctcccaaagtgctgggattacaggtgtgagccattgtgcctggcctgggattttctttctttctttctttctttttctttagaggtaggttccactctacctttgcttgaagcttgacagttcattttgtaatttagggtgaaaagatgccatctaacaaagtattccgttattcgactaaaaaaactgtttcattgctatgcttctaggattttcaaaggtcagtaaaagctccttttgccagttatctttttttttttttaatgagacggagtctagctctgtcgcccaggctggagtgcagtggcgcgatctcggctcattccaacctccggctcctgggttcaggcgattctcctgcctcagcctcctgaatagctgggattacaggcgtgtgccaccacgcctggctaatttttgtatttttagtagagatggggtttcgccatgttggtcaggctgttctcaaactcctgacctcaggtgatccacctgccttggcttccccagttatcttactaaactggaaagcatagcctttacttgtggcatgaacaaacttaatcagtaagaccactacttgctaaagatacggaaataaactgttagagagccattactgcagccataagaattaattttttttttttttttttgagacggagtctcgctgtgttgcccaggctggaatgcagtggcaggatctcggctcactgcaagctccgcctcccgggttcatgccattctcctgcctcagtctcctgagtagctgggactacaggcacccgccaccacacccggctaatttttttctttgtatttttagtagagacggggtctcacgtgttagccaggatggtcttgatctgctgacctcgtgatctgtctgcctcggcctcccaaagtgctgggattacaggcgtaagccactgcgcccagccaataattaattttttggtagtttgaatatgtgtgccattatttggttgcaatattgcagtggagtgttttgttttgtttttttttttgagacggagtctcgctctgtcgcccaggctggagtgccgtggtgcgatctcggctcactgcatgctctgcctcccaggtttgcaccattctcagcctcccaagtagctggtactacaggcgcctgccaccacacccggctaattttttgtatttttagtacagacggggtttcaccatgttagccaggctggtctcgatctcctgacctcgtgatctgcccgccttggcctcccaaagtgctgggattacaggcatgagccaccgcgcctggcctttttttttttttttttttttgagacaagatctctcactctgtcaagcaggctggaatgcagtggcacaatctcagctcagtacagcctcaaactcctgggtgagtctcccaccctggcttccgaaagcgttaagattactggtgtgagcctggagtactattttgctacttagaaacctttagtcctttatatatttagcaaatgtgtgaaaaaataaatgaatgttttgttattggcttgatggtggacatttatggaatggctcggttagtgacatgacatgaacaggtgttttgtttctttcccaattttttctgtcttcagttttccctcattttttttcatactatatgcgtatttgtatgaatttagtgtttcataaaatgatttgtgcttttcttttagaatgattacggacctgaagccaaagaacaagatgcgctagtggacagattgctgaccaggggcttgagagctgggttctattttccctcctcaaactgactttgcagccacggagaggtaagtgctatttccattttttctatcttaaaaatggtagtaatataaccctcctggagttggaggatttgttggctaattcttgaatataggggatgcaggatatcaggtgattgagagcatacaggcttcataatcagagtcctgggtttgaaactctttacgatgatatactagctgggtaatatggggcaagttactttaacctgtctactcctgtagtcctcacttgtgagagaataacaccaccaatctcagagactattctccgttaatgagaatgtgttttgtaaagctttaagtactattctgaacatgtacatagaaagatcccaggaaattgtggctgcttttctgtagaaacccttggaatgtgtattttgactattggcaaatgaactgaaaagaaagtccatgacctgtggctacttgtaattttgataagaaacagatggaatcctgttcttggggaacctggtatcctggataaaaattgtcttaatttgagttagcctagctcattgcccattttgcgtcagagtgtgacagtgattatcattttaatttagcctgtaatttttgctataaaatataatggacattatatggaacttggaacagaccttctataaatattggaatctactatgctttgggatctcataaacaacaaagtgggattctggttgtaaaaattatctcttctcacggtaccggaaagcacatttttttcagaccctagaaaaatgtgaaaataatttaatcgtacatgtgtaatggcaaaaaggaatgtagaagtggaaattacaaatgccaggattagataagcttatgtgaatgaatcatctaaatgactactaagatttttcttacaagctctgcctggagcaaataaagagaagggaataggaatgaaagttctgttattcttcaaacctttattttccaaatgggcaacttgttatcctgctagatgggaaggagaaggtctgtggtagtattctgtcactccaaaaataacttacgccctgcaggttcttttaggagtgttgacacagagtgcataccaaaagttgctgatttaaaaactattgagaaatcgaacctttaagagtttagggaatgggtttataggaacacgttaatcactttcaagtgttatgactagcttaattgcttagatccctgtttctcaaactgggatatgaatacccttagggaatcaggtggtatgatttcggggtacttggagtcacaagaaagataaacatgacccatcttcctagaacttcagttatagtcatagaggaggtggtgagttaagtaatttaactggtcagtgattaaatattaaatattggccaggcacggtagctcacacccagtacattggaaggccaaggcctccaaaatcccagtaatcctagtactttgggaggccaaggcaggtagatcacttgaggtcaggagttccagaccagcctggccaacatggtaaaaccccatctctactaaaaatataaaaactagccgagtgtggtggtgggtgcctgtaatcccagctacttgggaggctgaggcaggaaaatcgcttaaacctgggaagcagaggttgcagtgagccaggattgtgtcactgcactccaccctgggcgacagagtgactctgtctgcccccccccgcccccccccccaaaacaacaaaagactgggcgcggtggctcacgcctgtaatcccagaactttgggaggctgaggtgggcggatcacaaggtcaggagttcgggaccagcctggccaacatggtgaaaccccgtctctactaaaaatacaaaaaattagctgggtgtagtggcgggaacctgtaatgccagtttctcgggaggctgaggcagaagaattgtttgaacctgggaggcggaggttgcaatgagttgaaatcactgcactccagcccaggcaacagagtgagactctgtctcaaaaaaacaacaaaaaaaaccccaagaagacaattagctgggtgtggtggtgcgtgcctgtaatcccaactactcgggaggctgaggcaggagaatcacctgaaccaggaggcaggcagaggttgcagtgagccaagatcacaccactgcactccagactgggtgacagagcaagaccgtctcaaaaaataaataaataaataaatattaaatattgttatattaaaacaaatagacatttttggagcagaatgaaaactgtatgattaagataacataggtcttcaacaaaatgagcatgagtgcctgagggtgggaagttctctctgtataggttctatagtggatatgtttgagaagcaatacatttgagctatagaacagctctgctatcctgctccttactttgtccttgtagtatttgtgtagggaaaaactctcaagcccaggtttttcctttgctttcacataacaaccaccatcaacacaaaagaagacttacgtggctgggcccagtggctcatgcctgtaatcctagcactttgggaggccaaggtgggcagattgcaagtccaagagattgagaccatcctgaccaacatggtgaaatcccatctctactaaaaatacaaaatttagccgggcgttgtggtgcgtgcctgtagttccagttactggggaggctgaggcaggagaatcgcttgaacccgggaggcggaagttgcagtgagccgagatcatgccactgtactctggcttggcgacaaggcgagactccatctcaaaaaaaaaaagacttacgtgaccaaagatggggtggagggattttcctcacacaccaaacagtgtatgccaactaggtgtcatccaacaccatctacccaagatggtgtcagatcccacacgtttagggttcagtcccataagaccacctgtccttcctaccagtcacaagcccattccttcagagcttctgaccaactggcttcaagttgagtttcccacgacctctttcttgggttccattagtttgctaaagcagttcacagacctcaaggaaacacttctttagatttgccagtttgttaagaggactactttatttatttatttttgagacaatctcactgtgtcgcccaggctggagtgcagtggcgtgatctcggctcactgcaacttccccctcccaggttcaagcagttctcctgcctcagtctcccgagtagctgggattacaggcgttcacccccacgcctggctaattttggtatttttagtagagatggggttttgccatgttggccaggctggtctcaaactcctgacctcaggtgatccacccagttcggcctcccaaagtgctgggattacaggcatgaaccaccacgcccagccaaaagcatcttttttttttttttttttttttttttgagatggagtcttgctctgttgcccaggctgaagtgcagtggtgcaatcttggctcactgcaagctccgcatcccaggttcacaccattctcctgcctcggcctcccaagtagctgagactacatgcgcccaccaccacacccagctaatttttgtatttttagcagagacagagtttcaccttgtcagccaggatggtcttgatctcctgacctcttgatctgcctgcctcggcctcccaaagtgctgggattacaggcgtgagccactgcgcccagccaaaagcatctattcttaactgtgtgttttacaattactaagtattgttattaacatattgctcttaacataagtggcatttaagaattacattttttccatatgtccttgtggatagaggaaaaaaaaagaattacattttctttagtcacgcgttgtgttgcatgcctgtagtcctagctattcaggaggctgaggccggaggatcgtctgagctgagaaggttgaggttgcaatgagccgtggtcccaccactgcatttcattcagcctgggtgacagagtaagaccctgtctcaataaacaaataagtaagtaagaattaagttttctgaggctgggcgtggtggctcatgcttataatcccagcactttgggaggatgaattttattttaatcccattaggactccaagtcctggccatgcagcttaatagctatatggccttgggcagggcagttctattagaggtgacttccttgggcttccctttcctctttttttttgagagatggagtctcgctctgtcgccaggctggagtgcagtggtgcaatctcggctcactgcagcctctgcttcccgggttcaaccgattctcctgcctcagcctcctgaatagctaggactacaggtgcgccaccatgtctagctaatttttgtatttttagtagagacggggtttcaccatattggctgggctggtctcaaactcctgacctcaggtgatccgcccaccttggcctcccaaagtgctgggattacaagcgtgagccaccgcgcccagccaagttggttattgtatatattttgcattaaactgaacttcgatgaccaccagataatacaaatgttaatgaactaaacggaaatattgtgccataggaaaatgggttagatttatcagaaaatctgttgagcagtagagaagtgggtaagaaaacaaggtctcgttgcatgttgcaagggatataaaaccctaacccatttaaaaagatgaatgtcagcctgggcaacttagtgagaccttgtctgtaaaaaaaaaaaaaaaaaaaaatgtagccaggtgtggtggtgcacacctgtagtctcagctacttgggaggctgagatgggaggatcacctgagcccaggaggttaaggctgcatgcactctagcctgggtgacagagtgagaccctgtcttaaaaaaaaaaaaaaaaaaaaaccggaaggctgttaaccagcaaaatgcttatgagagaggttttttaatagcataataccaaaaagttaattattatggaataaaagtaaagaaaatcccaaactaaaacctggcgtatagcagaagctcaataagtaattatttggatgaatgaatgcctagggaaaaaagactaaacagacgtggaaatcatcagtcaaaactagtagtgtgagggtagtttggtttgggggtcactttttgttggttttgtatagtttgtgtaattttttttaatgcaaatactttttttcttttcttagattaaagcagaattaccaaaatctggctataaaaatatttaacaataggtgactggttaaattatgatacatccctataatagaatgtttttttttttttttttttttgagatggtgtctccctctgtcacctaggctggagtgcagtggcacgatctctgctcactgcaaactccgcctcccggcttcacaccattctcttgcctcagcctcctgagtagctagaaccgctaattttttgtgtttttagtagagatggggtttcaccatgttagccaggatggtctggatctcctgacctcgtaatccgcctgcctctgcctccgaaagtgctgggattacaggcgtgagccaccgtgcctggccttataatagaatgttgtgtagccattatgtataaaaaatatgttgaaatggcaagatatttgaaacaaagtacaaagaaagcagattatcaaacaatatgtatggtatgatctcgtgagagtaagtatatgtatatattggggaggggactgcgaatttggatataagccagaatgtgtgtataaaacctataggtaggtttctttaagctttctcctgttgcctgtattgcataatttttaaaggaaaagggaatgcagtacagtaggaagtagcactgaaactttctgataaaggtaatgaaatgggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcggctcaccgcaacctctgccccccaggttcaagcgattctcctgcctcagcctccctagtagctgggattacaggcgtggtggaatttttgtacttttagtagagacagggtttcaccatcttggccaggctggtcttgaactcctgacctcatgatccaccagccttggcctcccaaagtgctgggattacaggcgtgagccaccgcatctggccagtcttctttttttttttaaactgtaaagtggtgatactggttcccttcttacctataagtattactcaaattgataacctaataaaactgtaggatattaaagccaaaagaaaatttaagtcatctgtcaatcccttcattttacagataagaaaactaagacgcaaagtgattcacctaaggtcatggatgtaggacaagtgcttatgccttttttgttcttccctagactggctctgaatagtctttgggtttcccagaatttcctgctgcatttgattctgtagctaattattttatacattcattttttaaatctcttttgacagaaaaacatgcatcaatgtgtatgtctagaaaaacaatgtagaggctgtacattaattgctcttgggtgtagtatgcatgtctttgttttgttttgttttttattttttagacagagttttgctcttactgcccagtctggagtgcagtggcacaatcttggctcactgcaacctcctcctgcctcctgggtttaagcagttctcctgcctcagcctcccaagtagctgggactacaggcatgcaccatcatgcccggctaattttttgtatttagtagtgaacggggtttcaccatgttggtcaggctcgtctcaaactcctgacctcatgtgatccacccaccttggcctcccaaagtgctgggattacaggcgtgagccaccgtgcccgtcttacacatgtcttcagtgtgtatttttcagacaacaagagcagtaatgttaccaactttaaaaaagtttgcccacatgtgcaatgatgcattactaggctctgactgaagataatattaaagttcagtatctaataagattttgagcttactcatcttcttaacccaggacttttcagaatccttcaataatctttatgtgataagaacagaacatccttacaggcagtattggttagcacttctgtttttaatgtagtgcacttggaccactgaaagttttcaatttttccaaccactactttttgtttatttgcttaaataaactctaatataacaaatctctggaatagcatggtcactatcacatatttacagaggtatgatacataactcttctataacagaagatatcctaattctttttagtatttcctgtgttttatctcttatatctttctactcctatttaaaaatttttaaggttatgttgagagtataaaataatagtgactcttggtttgtaatttttttctccctgtccccctgttcaacaaagtatttgcttcttcctttgtctttattgtgtcttttgggtgtatataaatatataaccctccctgccctccaccctacccccatgcaatttcttggttatggtattgcctgcatttttttgttgcctatacatgtttgtttcaatatttctaagaagtaaccaagttgacaaattacttgttttaatcatcttggttcaaagtaacattttgaggctgggtgcagtggctcacgcctataattccagcactttgggaggccaaggcaggtggagcacttgaggccaggagtttgagaacagcctggccaacatagaaaaccccatttctaccaaaaatacaaaaaattaggccaggcgtggtggctcacacctgtaatcccagcactttggaaggccgaggcgggtggatcacaaggtcaagaattcgagaccagcctggccaagatggtgaaatcctgtctctactaaaaatacaaaaaaattagctgggcatggtggcaggcgcctgtaatcccagctactcaggaggctgaggcagagaattgcttgaacccgggaggcagaggttgcagtgagccgagatcgcgccactgcactccagcctgggcgacagagtgagactccgtctcaaaaaaaaaaaaaaaatttcctgggcatggcccctgtattcccagctactagggaggctgaggcacaagaattgcttgaaccccctgggaggtggaggttccagactgtgtctcaaaaaaaaaacaaagtaacattttgtttcttttgttgtttaaacttctacatgtgtatctttgttttttcagcctcttttattcttcatagctattcagtaatgctttattatccatatcttatgctgctatactcttttgttgttgttttgggttttttttgagacagggtctcactttctggtccaggctggagtgcagtggcacaatctcagctcactgcaacctctggctcctgggcgcctgcaatcctcccgcctcagcctcctgagtagctgggactacaggcccgcaccaccatgcctgactagtttttgtatctttttgtaaagacaaggttttgccatgttgcttaggcttgtcccatctcttgggtttataggtgtgagccactgtgcctggcctgctacttgctaaagatgtcattttagggtaggtaacttcttaaacatttttttttttttttttttttttggagacagggtctcgctctgtcgcccaggctggcatgatcacagcttgctgcagcctcaaaattctgggcacaagcaatcctcttgcctcggcctcctgcagtgctggaatggtaggcgtgagccaccctgcccagccaataattttcttgattgttgtcgaagacattatattgctatttattattaccacattgctatttggtacaagtatccattgttgttatttaaactgttagcttctgatttaatgttaactttacaggacaacccctttaccaaataaaagttgtcttggttttactaagtagccttcatgaggtgagtcctgggttacagagacatttttatttataaaaataaaaaccatgacagttcaccctatcatgtgtgcccatttctgcagggttttttttttttctttttcccttctttcatgcctacagattgtccttactacctagagattgttaaatattggttgtacccaaaatagaagtgaaacttcaaggcttactctgcttggcacagtggctcacacctgtgataccagcacttagggaagcagaggcaggaggatagcttgagcccaggagttcaggacctgcctgggtgacatagcaagaccccattctccacaaaaagggggaaaaagacaaaagactcattgagtcatacattctgttattgcttatgtgagaattatattagttttgagataggctttgtagtttttttgttgttgtttgttttgttttgttttgagacagagtcacccaggctgggatgcagtggcgtaatcttggctcacttcagcctctgcctcccaggtccaagcagttctcctgactgagcctcctgagtagctgggatttcaggcgcccaccaccacgcctggctaatttttgcattttcagtagagacggggtttcaccatgttggacaggctggtctcgaactcctgacctcaggtgattcacctgcctcggtctcccaaagtgctgggattacagggatgagccactgcgcccagccaggatctatattttttaaagctcaccagaataggtttgggaatcattgctcaggcagcatctgtccaaaattcataaaagtacctgttaggtgttgtgtaaatcctgcattatgtgtgtgtagtttattcctattttgtaatacatttattcaaggtgatagacttgctatagattctcagtctttctcctattccaagtgatgaaaagactgtagggctgctccaaagacggtctaactctgagctgcttccagggatatgggtctgcagtgtggcaaggagggatctggtggtctctaacatagtctcttattaggggaacagaaagtgaagcttaggttactctacaccagcaaaagtgtcatttgggctatggagagcagagagaggacagcatgtacttgggaggcagcctcctgttggtactatggcaccaatgttgactcacagatgagcattatctttgtaaatgttcaataagtgaaataaacaggctacccttaacagagggctctgaaaccacatcaaaataatatatatttttttgatacagattctcactctgtaccccagactagagtgcagtggcgtgaactcagctcactgcaacctccacctcctgggttcaagcgattctcatgcatcagcctcccaagtagctgggattacaggtgcacgccaccacacccggctaatttttgtatttttttttagtagagacagggtttcgctatgttggccaggctggtctcgaacttctaacctcaagtgatccacccgccttggcctcccaacatgctgggattacaggcgtgagccaccgtgcccagcctcaaaataataaatttgaggcctgggtgtaatggctcatgcccataatcccaacatgttgggaggctgaggcaggaagattgtttgaagccagaagctcaagaccagccgaggcaacaaagcaagaccccacctctacaaaataataataataaaatagtagggtgcagtggtgcatgcctgtagtgtcccaactacccaggaggctgaggcaagagaggcacttgatcccaggagttcaaggctgtggcaagctacgattacactactgcgctcactccagtctgggagacagagcaagaccgcacctcttaaaaaagataaataattataataatattaatttgagatggcttaatacagttccactcagttacattaaatttcttctgcacaaaattggtctaattccatacatatttttgttatataccgttcacctgttctgtagtttgtcaggcaaggtccacctcatcatttgatatccagctgtagcaattcctttccttaaagcccttcacccactgaagtcatcctttatgccagggtggtaggaagtatgttaaccgttgttacagtactcatcacactatatagctgctatttgtttttctttctgcctgccagacaaggagctccctaagaactgaacctcgtgcagaagacaaagcttatctgggagtcagctttagcacagtactgattgaagactacccctagtacatatgcttgtactctctctcccttccctgcctccagccccaaatgacgcttcaacacctaatacccgatttcttccattaacttgaaaaagagcctggacgcggtggctcacacctgtaataccggcatttggggagaccaagatggctggatcacctaaggtcaggagtttgagaccagcttggccaacatggtgaaaccctatctctactaaaaatacaaaaattagcctggcatgatggtgggcatttgtagtcccagctactcaggaggctgagacaggagaatcacttgaacgcaggaggcggccgttgcagtgagccaagatggcgccattgcactccagactggtcaacaagagcgaaactccgtctcaaaaaaagaaaaagaacagttagaacttttttttttttttttaaagaagagagttcctttctacagcagcgtcagccaccttttggcgaaagaattattgtctagcctttattattctttgtagcaaaagaactccttcccctcctcccatactagtttcactgttgccattacaaatattttattagtacgtatttcctagattcaaagcttcagtgggctttcttcaagtagctgttagaataattgttttgttttgaccataccctttaatattaacaaatgggaggggagattgttaacaaaatactagaatgctcttaactttttttttaacttagaagaaacattttcatttcccttttaattatttctacacacacacatacaaaaagccctgttattttataattttttatttttatttttttagtagagacagggtttcactgtgttagccaggatggtctcgatctcctgaccttgtgatctgcccacctcggcctcccaaagtgctgggattacaggcgtgagccaccgtgcccggccctaactgttcttttaaaaattggccgagcacggtgatcggccaggtgtgatggctcacacctgtaatcctagcactttgggaggctgaggagggtggatcagctgaggtcagaagctcaagcccagcgtggccaacatggcgaaaccctgtctctactaaaaatacaaatattagccggacatgatgtttggtgcctgtaatcaatcccagctacttgggaggctgaggcgggagaatcgcttgaacccgggaggtggaggttgcagtaagctgagatggcaccattgcactccagcctggatgacagagtgagactctgtctcaaaaaaaaaaaaaaaaaaaaaaatgctggactgggtggctcacacaaatgctgtgattacaggcgtgagccaccgtaatcccagcactttgggaggccgaggcgggcagatcacttgaggtcaggagtttgagactagcctagccaacatgatgaaaccccatctctacgaaaaatacaaaaattagctagtcgtggtgatgcgtgcctgtaatcccagctactcaggaggctgaggctgagaattgcttgaacacaggaggcagagattgcagtgagccaagatctcaccactgcactccagcctgggtgacagagcgagactctgtctcaaaaaataaatgaaaattaatgtcagagaagtgagaggtacagttgtgattaaatagatgagtgctttttcagataaaggctgcttccgttcccagtcactgtgaaagaaatggtcactattatttttctgcttctcagcccaagttattctcccaattcaactcctcctcattctttattgtagtctacaactttcctggtactagttcactgatactttgctttgatgtattttaagctctcagataagatgatggcgtatatgttttcaggaatagcagagtaaaatggttattttgtttaacttttaaacctagcttttactctaaaagagttaataacttttattcgttttggctagtgtcctgcatctagtaaaagttacttagcttttcctttcatcctcaggaaaaactgattactttttttgggggggggcagtaagggcacagagtcttgcgctgtcactcagactggaatgcagtggtgtgatgatagcttactgcagcctgggctcaggcgatcctcccgcctcagtcccgagtagctgggactacagatggatgccatcatacctagctaattttttttttaatttttaatggagacaaggtctcactatgttgctcaggctggtcttgaactcctgggctcaaacgattctcttggctctgcctccccaagtactgggattatatgtgtgagccactgtgcccgacctgatgacttataattgctttttttcccctccttgtcctaatgtcatttaacattctgtatagtgagaataccagactaagcttttcagtcaacatttttctaatgtaaagatctatcgactggacgcagtggctcacacctgtaaacccagcactttgggaggatgaggcgggcacatcacctgaggtcaggagtttgagaccagcctggccaacatagtgaaaccctgtctctactaaaaatacaaaaatttgctgggcatagtggtgtacgcctgtgatcccagctgctcaggaggctgaggcaggagaattgcttgaaccctggaggcagaggttgcagtggccgggattgtgccactgcgctccagcctgggtggcagagcaagaatctgtctaaaaaaataaataaggccaggcacagtggctcatgcctgtaatcccagtaatttaggaggctgaggtgggaggatcaccagagctcagaagtttgagaccatcctgaccagtatggtgaaaccctgtctctactaaaaatataaaaattagccggcatggtggcatgcgcctgtagtcccagccactcgggaggctgagacattagaattatttgagcccaggaggcggaagtcgcagtgagccaagatcgtgccactgcactgcagcctgggtgacagagtgagactccgtctcaaaaacaacaacatcaaaaaaagatacttacagaggccaggcgttggtgactggctcaacgtcagtaatctcagcactttgggaggccgaggtgggtggatcacttgagctcaggagtttgagaccagcctggccaacatggtgaaaccccgtctctactaaaaatacaaaaattagcggggcacagtggcatgtgcctgtagtcccagctacttaggaggctgaggcaggagaatcggttgaacctggaggcaggggttgcagtgagccgagatcgcgccactgcattccagcctgggtgacagagtgaaactccatctggaaaaaaaaaatttatatatatatgtataaatgtttaatatatattttatatttatatatttgtatatcttttttatattttaatatatggtttttaatatatattttatacatataaagagaaaggtgcaaggtatcttctgttctcttaaaattttttacaatttcaacttttattttagattcgggggtacatgtccaagtttttttgtgtacatgggtatattgtgtgattatgaggtttgggggtacaattgttgctcatcacccaggtaatgagcatagtacccaatgattagttttgcagcccttaccccgttttctccctccccctcctaatccctaaggcctattgttatgtttatgtccatgtgtacccagtgtgtagcttccacttgtaagtgagaacatgagatacttggttttctgttcctgccttaattcgcttaggataatgacctccagctgcatctgtgttgctgtaaaggacattatttcattcttttttatggctgtgcgttctctgccttcttatgatgtctgagggttcgtatcaacctctgttaggccatttgttaggtacccttcatgttgactttcagaatttctgtggcttgtgaaagttcatggggtcttagagctgctaatgtatttcttaccaagagaatgcagatagacttctgatctccccaggaaataagttggggtttttagcaatcagttgccccttataatggatagtaagcagtatattaaaaagttgtgggtttagttataaaatagactgctggaaatcattctcttctactgtcttattctcagtacacatggattattcctagtataataaccagtctacttaactgactaaactctgcagtggtgagtataaaaggttgttttggttgttttcctttggaaattgtctgacatatttgctatgtagtcataatcataggtgataaattactaaaccttaatatcttcaaaaattagtgtattcacaattagcttccatttttacatggcaggattttaaaaaatctaacctgtaattgtgtttttgggaatttttatttttctctattaagaagtgacacaggctgagcatggtggtttatgcctgtaatcccagcactttgggaggccacttgagcttaggagaccagcctaggcaatacagtgagatcccatctctgtaaaataaaatgaaccaagtatggtggcacatgcttgtagtcccagctacttgggaggctgaggtaggaggatcacttgaacccaggatgtcaaggctgtagtgagccttgattgtgccactgcactccagcctgagcgacagggtgggaccctgtctcaaaaaaaaaaaaaaaaggtgtaagaattgacacaggctagttgcagtggctcatgcctatattctcagcattttgtgggggatgaagtgggaggatcccttgagcccaggggttcgagaacagcctgggcaacataatgaaactttgtctttcaaagtttctaaactttgcatcactaaaaaaatagtgatgcgtaaaaaaacttcgcatcactaaaaaaatagtgatgcaaagagagcaataaaggtaaattcgtatacttaggctttcacttagcatataaacagtgttttgtttttccatgttcccttcctgctcttgtcctgtgcaggaaccatctatacctgtttcatctgacaaagtcagtgagaattcctgtttgtctaacactgttttgtatccattgctgtagagactacagaaacaaaaggcatagttactgcccttaaaaagctaatactgggggaaaaacacatagaacattatgctacagttaaaacttgtggtcagtttgtactggtcaaggttgagatgactttgatttagaaggtgacttgagctgggaagggacaagacatcagatactgatatagaagatgcccagcaggaaatagtcaaaggtgaggttgggtgggtggaagggaatgggaacaaactgtacagagctctgggagctaagatggagaatttggacctgattcagtcagcatcaccaatcatgaatttttggaatttttgagcctcatttcaggaaggtttaatgtggcgtcaatattctggatagaacaagactggccagcctgcaaagctgttctgtctcttcctaccaccctcccccacccttcctttgactcacctcaaacttctgggcccaagccatcctcctgcttcagcttctcaagtagctggaactataggtacaaaccaccatgtctggcttgttctgtttcttttttactctttctccttcattcctggatttagtcagtcaccagcttctgtcaactgattgtaccttcatcgtacagaaatccagtactttatcagagaagtcatttttgtggggaaaatttatcaaaggtttagataagattagattctaggaatctaattagaaagctaagaagccaaaaaagcatatattgttgagttaaccatgttgaatgtcttcttggctggcggtataaggatacagaggatggcagttggcaccatgcatgtattgtttcattgggtttttatgatagcctgtgaaatgggtaccatttccttattttatagaaaagaaaactgcagcgagaaggtagcatatctcaccccaggtcacaatgctaattagaaaaaccagaattgggatgcacgtctctgactcttaacagtgattccattctgcctctcctgtccgccctccctttttaaatatagaacaaacattttctccatattatgtattaaagcactatttttgatgtctacgattcacaccaccaattaccttcagtagaattgtgctagtttcactgcaccaaggacaacattggggagtatctttctttttttttcttttcctctttcttttctttttttttgagacagagtctctctctgtagccaggctggagtgcagtggcatactttcggctcactgcaacctccacctcctgggttcaagcaattctcctgcctcagcctcccgagtagctgggtctataggtgcacgccgccatgcccagctaatttttgtatttttagtagagacggagattcaccatgttggtcaggatggtctcgatctcctgacctcgtgatctgcccgccttggcctcccaaagtgctgggattacaggcatgagccaccatgcccagtctggggagtatctttcaaaacaaccatagcagtttaacagaggcaaatgctgtcacattattttagtttagcatttcttttactattaatgaggtttggtttttttcttattcatctgccatttgtgtattttcagtcatctatttgtgtcctttgcccagctttttctttcagtgttcatcttttcattgtaaattttacagttatacatatgataaagaggttaatccattgtcatagatgttgcagatatttttttcatggttggccattttctttttagtttttgttcaacatgtttttgtcatacataattttatttttattttattttattttatttatttatttagagacagagtctcgccctgtcacccaggctggaatgcagtggcacgatctcggctcactgcaacctccacctccctggttcaagcaatttccctggcttagcctccctgagtagctgggattacaggcacatgccaccatacctggctaatttttttgtatttttagtagagatggggtttcaccgtgttggccagactggtctcaactcctgacctcagggaatccacccaccttggcctcccaaagtgctgggattacaggtgtgagccactgtgcccagcctggaatttttaattttattttatggtgcttaaaatctcaatcatttcctctgatttctcttattacttaggcttctaagcacaaagccttcctcatttttagaaagctgttcacctttttctttttaaagttttgtgtgtgtttttgtttgttttgtttcattttgagacagggtctcactctgccgcccaggctggagtacaatggcacaatcatggctcactgcagcctcaacctccccaggttcaggagatcctcccacctcagcctcctgaatagctgagaccccaggcgcacaccaccatgcccagctgactttttgtatttttagtattgatggagtatctccatgtttcccaagccaatctcgaactcctgggctcaagcgatctgctggccttggcctctcagtgtttgaattacaggcgtaagtctctgtacctggccactaatgctttttttttttattttgatacagagtctcgctctgttgcccaggctgaagtgcagtggcgtgatcttgacgcactacaacctccacctcctgggttcaagcagttgtctgcctcagcctcccgagtagttgggattacaggtgcccgccactaagcacagttaatttctgtatttttagtggagacggggtttcaccatgttggccaggctggtcttgaactcctgaccttattatccacccgccttggcctcccgaagtgctgagattacaggcgtgagccaccacacttggccctgccaatgcttctttgtttcatacaacagatacattccaaatggattaaagataacttctgtttttttcctacatagttaactgtttttctggtaccttttatgcagtaattctcttttccctactgatttaaaatgacagctttttatttgctaggctttgtttctggattctctcttctgtttaaattgtctgcctatagtagtaacagtaccacattatatgaattatgtagctttatggatatagataatagtgtcgctacttagtgaggttttttaaatgcctcctggaggagtttggggctggaggggaagggttgttttctttttggttttgtttttcttagtttttttttagaccatgtctcactttattgcccaggccagagtgcagaggcatgatcactactcactatagccttaacctcctgggctcaggcgatcctcccagcttagcctccaggtagctgggactacaggcatacaccatcacacctgactaattttttaaagtttttgtagagatggtgtcctactgtgttgcccaggcctggtctcagactcctgtgctcaagcaatccactctcctcagcctcccaaagtcctagcagtcaggtgtgagtcactgcacctggccagtggaagagttttataatcttcaaatagaccctgcacattttcagttcacgttattctttttcttgtatctttttatgtttatgtatattttcctatatttatttaatagattgtatatacactttcaagtttatagcccatcttgttccagaaagaacttgaagaaatatttaggaaagacagataataagtgatataaataaaccagaaaatacaaattataatagaaagttattattacatggtttgagaggcaacaaattaatcaagctgtagccagctaaaaaaatggcaacatgatcctgttacataggtttcacaatgaaagaaaaaaatttccttgaagaaaagcttttccaagtatttaactcccagtgcaatttctcccacatatcttttagtgtaagctaaggcatgatgccaaagtgaaactcgataaaagcaattctgtaggggataaggccgtgtggcccaagtatacccagctttctgatggtctggcataattctgggataaagcctagactagaatgctgaattccacagagaggtcaagtcagatgaggacagaaaagcctcggtggatttaccaattaaaggccattgctggcctcagagcagctccgtaaagtattggggatcagaaaccaaactggtgagtggaaagtaaggaaagaattagagacagcaagtgttaagttgagcgtggtaggaaaaaagagatgacagatactaaatcgtgcattggggttgaggggagttataaatgggcaagatttaagcaacatagagctagctaagaagtggctgaagtggccgggtgcggtggctgaagcggccgaatgtggtggctcacgcctgtaatcccagcactttgggaggccgaggctggtggatcacgaggtcaggagatcgagaccatcctggccaacgtggtgaaacctcgtctctagtaaaaatacaaaaactagttgggcctggtggcacgcgctggtagtcccagctgctcaggaggctgaggcaagagaatcacttgaacctgggaggcagaggttgcagtgagccgaggtcgtgccactgcgctccagcctgggcaacagaacgagaatctgtctcaaagaaaaataagtggctgaagcaagaggaggaagaactgatccatgccccctaaggatacaggcctctggggtctctgtgttggagcctaggcccttgcatcctcacactcaccattcagcaggggcagagaagcattaagatgccagttttccttccttttagcccctcatccccgattgcctggattgttcttcctcagtctggaggaacctcctgttcatcatctacacagaagttgactgaataataaaatttttttatctaagcttcactttttcacctagatgatagagaaacacaataaggatctggtcttaggagctccattttatggtgataccacagtccggacgactaaaccacccactttgccaagctcatttagttggttagtgatggattgggtatactggagtttctgtttattccctgtccagtgtcattgagttgaaggtgacagccaaacattagtagatcctttaggcagtgaaactgggattgcagatatggattggaaagacctctgtgtagaaacagtggaagttaaaaggctagtgtaatgggcggctacggagccttggtgtgctcaggggggctggtgaaagagtactcagagacgaagggagctaagggaggaaagaggcttatgaaggaataggatgagtttcatcttgtcagatgccagagaaactgagatttagaaagagggaaaggcccttgggttgactctggtggttcttgatggatggtacctgtgggccaaacaaaggggccgcagagggctaaggagggagttgagtcctttttagtaaggacagatatttaaatttattattttttttattttttttatttttgaggaacagagtctcactctgttgcccaggttggagttcaatggtgtaatctcagctcactgtaacctctgtgtcctaggctcaaatgatcctcctgcctcagcctcccaagtagctggggttacaggcatgcaccaccatgcctggctatattttgtagagatggtgtttcaccatgttgcccaagctggtctcgaactcctggactcaagggatctgcccacctcagcctcccaaagtcctgggattacaggtgtgagccaccatgcctagcctggctaatgtgtgttttttaaaatttgtttttagagatggggtctccccatgttgcctgtgctgggcttgaactcttgggctcaagtgatctacttcagcctcccaaagtgctgggattacaggcttgagccatcacacctagtcataaggacagattttttgagatagagcaaagccatatatagaagtgtatataaattccatatatagtatgatttcatatatatacaaaatatatacctttaactgaatagctgagaaaacagcatcagaatattaggtgattttcgtaatctggaggaaaaaaaatgtgtcctgtaagtaaattaaaaccgctttgagtgatataaacttcattttggtggcgatattggtccacaaaaaatatttgatgaaacctagaaggcatgggcgactcaagcaagcatagagccaaaaaatatgtaggaattagagtgagtgggtatgttttgtactaagaggaactgagtatttgaaagcagtaaagaaaggagatggattggagctgctagtgtcgggagaggcagctagaagcgcagtccccagggagtggggagaatgacctggtccagcctattggttacttattgattcagaggagagactcccatcgtctggaaagaaagtaaaaggagagatccactgcttgatggaatgcactaaggggtgtgtgtgtgtgtgtgtgtgtgtgtgtgtgtgtgttttgttttgttttttaagacagagtctcactctgtcaccgtgtgtgtgtgtgtgtgtgtgtgtgtgtgtgtgtgtgtgtgtgttttgttttgtttttttttaagacggagtctcactctgtcacccagcctggagtgcagtggcgtgatctcggctcactgcaagctccacctctcgggttcatgccattctcccacctcagccttcccagtagctgggactacaggcgcctgccaccacgcccagctaattttgtttttgtatttctagtcgagatggggtttcaccatgttagccaggatggtctcgatctcctgacctcggggatgctctgagattctgagcagtgtattgagaggctgatggcttgctactttgtgtctgatttttctctattaaaaatagaagctattgctttaagaccgagtagatgctgttgttttgtggactttatgccatgtgttttttttcagtgagacagtactctgtcagctcaacttcttggaagcacagttggtttctatttgtactcttttgtaccacttctttttctacctggtttataattctgtgacctcttttaggttggactcggttgtttacaagcaatttttttttttttttttgagatggagtctccctctgtcacccaggctggagtgcagtggcccaatcttggctcactgcagcctccgcctccagggttcacgcgattctcctgcctcagcctcccaaatagctgggactataggcacctgccaccacaactggctaattttcgtatttttagtagagatggggtttcaccatgtaggtcaggctggtcgtgaactcctgacctcaggtgatccgcctgcctcggcctcccaaagtgctgggattacaggcgtgagccactcagcccagcctgtttacaagcaatttttaacattttaagttttcaaattcacaccagagaccagatagaatttttttccgttgtcttcaagttgtagcatcaaattatatgctacaaaatcctggagaccccaaagattgtttttcctctaccaattttattattgaggatatttaaatagtctgggattatgtagtgactctggcagggtcaccacatttacattcacagcatctcaattttttgttctttgataccttttctgagaatgtcactctgaagtaaattgggctttttgtatgttccctagctccagacatctggattatcattccctttgcagggatactaacttttggggcttttcagggactgaaaaacttctcttaaaaagtttttttctgggggctgggcacggtggttcatgtctttaatcccagcactttgggaggccgaggccggcagattacctgaggtcaggagttcaagaccagcctgaccaacatggagaaaccctgtctctcctaaaaatataaaattagccaggtgtggtggcgcatgcctgtaatcccagctactcgggaggctgaggcaggagaatcgcttgaacccaggagtcggaggttgtgttcagccgagattgcgccattgcactccagcctaggcaacaagagtgaaactccatctccaaaaaaaaaaaaaaaaaaagagaagaaaatcttaatggggaaacagtaatagtataaagttaaattgcaaaatctaattctgtgggtcaagggtgggacctgaagttctgtgtttttaagaagccagtgctgctggtcctcagaccatactttgaataacaagtacaaagttgtgctgtccggtacggaagcccctagcctcatgttgctgttgagaatttagagtttcactggttcaaattaaggtatgctgtaaatgtaagatatagctgggcacgacggcacatacctgtaatcacagcactttggtagtctaagatgggacaataacttgaggctgggagttcaagaccagcctgggcaacacacctctacaaaaaaaaaattacaaaaaaagaaaacattaggccgggcgcagtggctcacacctgtaatcccagcactttgggaggctgaggtgggggatcacgaggtcaggagatcgagaccatcctgcctaacatggtgaaaccccgtccctactaaaaatacaaaaacaaaattagctgggagtgctggtgggtgcctgtagtcccagctactcaggaggctgaggtgggagaatggcatgaacccgggaggcggagcttgcagtgagccgagatcaagtccctgcactccagcctgggcgacagggagactccctctcaaaaaaaaaaggctgggtgtggtggctcacacctgtaatcctggtactttgggaggccaaggcgggcggatcaggaggtcaggagataagagaccatcctggctaacacggtgaaaccccgtctctactaaaagtacaaaaaattagccgggcgtggtgacaggagcctgtagtcccagctacttgggaggctgaggcaggagaatggcgttaacccagtaggtggagcttgcagtgagctgagatcgcgccactgcacttcagcctgggcaacagtgcaagactctgtctcaaaaaaaaaaaaaaaaattagaggccaggcacggtggtttatgcctgtaatcctagcaatttgggaggctgaggcgggcagatgacttgagcccaggagttcgagaccagtctgtgcaacatggtgaaaccccacttttactaaaaatacaaaaaaattagcctggtgcctggtatgaacctgtagtcccagctactcgggaggctgaggtgggagaatcacctgagcccaggaagtcaaggctgcaatgagccatgaccattctgctgcactccagcctgggcaacagaggaaaccccgtctcaaaaaaaaaaaaaaaaagaaaagaaaagaaaattaattgagcatggtggcataaactgtagtcctagctacttggcagactgaggcaggaggatcactggagcccaggagttggaggttacagtgagctgtgatcctaccactgcactccagtctgggcaacagagcaagtctgtgtctcaagcataacaattttttttgttagttttgtttttgttttgtttgtttgtttttgagacagagtctcgctctgttgccaggctggagtgcagtggcgcgatcttggctcattgcaagctccacctcccaggttcacaccattctcctgcctcagcctcccaagtagctgggactataggcatccgccaccacgcccggctaatttttgtatttttagtagagacaggatttcgccatgttagccaggatggtctgtatctcctgacctcatgatccacctgccttggcctcccaaagtgttgggattacagacatgagccaccatacccggccaacaattttttaaattgatgaaaccttgaaatgatattttggacataccaggttaagtaaaatagattactaaaattaatttccccagggttttttttttttttgttttttggtttttttttttactttttaatatgaattttttttacttaaaattacatataatgtggcttatgtttgtggcttgcattatatttctattgaacagtgccagcctagagaatttatattctaaagataatctgtctgaacagtactgagtatataaaattaattatagttaggattatgcttagtcttttacaatcagaggtataaatgggattttttttttttttttttttttttttttgagacagtctcgctctgtctcccaggctggagtgcagtggcgcaatctcggctcatggcaagcttcgccttccgggttcacgccattctcctgcctcagcctcccgagtagctgggactacaggcacccgccaccactcctggctaattttttgtattttttagtagagatggtgtttcaccgtgttagccaggatggtctcggtctcctgacctcatgatccacccgccttcgcctcccaaagtgctgggattacaggcgtgagccaccacgcttggcctaaatgacatcttataataaaaatactagcactttgctcatttttaatttataggtgaattataaagcattctacaaatgttctttgatccccaccttctgcggtaacatttttttatatttgtccccactgtcatggaacagcatagtaagaagcctttgcattggatgttgttgtatttttctcttggttgttgagaacaagggactaatgaaagaaagaaggtaatggaagaataaaccaaactggcaatccaacaacctcgggagtttaccttgagccttgtttttttccaggcagatggtggggtttgctgaatctgtccaaaagtatatgttgcttcaagcccggcttttgcccttaaagagctttcacacccaactgggaaaatagatcgttttgagaaaattttaagtgctaaactgtgtccttattttatcagaaacacatttggagcaaagtagtggccacaagaacctcagaaagctttgttgtgccagggatgagctggtgttgagaggagtggatcagacgtaaagtacagagtgaagacagggagatgacagtaggaactgtgtctggatgaaaagacagcttgactgaaggggagagtgctagagggcaagacataaatctgaataggttatcatggggtcaggtacgaaggggctttgtgagccagaagggtggtaagtgcatcatgtagtttttgcaaaagtagagacacactttttgaggaaattaagtcttcttctttgtgaaatgagtgaatctttacttctctgcccagaaagcataagtggttttccattgccagtcatctgaggtattttgttattcaagaccatccaaactatggggggcaaccagcacatctttcacctgtcttactaccctctcctctgtcctgtgctttaagccagttctttttcttactcataactaattcccacatgtatttattgtacccagaaatccaaacctttcccctacagaatacatcctctgccctccactgtcaaactctgcctttaaatgtcctgctcacgtttcagggttccgttcaaattccacatttatgaagcatttttctatcacacctggttatgttatctttctccaaacctatgtaatttcaccttgaaccattgtgctacctattttgtcctttatgttagacagtaactcctagaatgtaggaccaggcctcccaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaatttggttggcatttattgagtacttaccatcctgggcacagtgttaaagagtaaaaaccgtggctgggcgtggtggctcacgcctgtagtcccagcactttgggaggccgaggcggacagatcacgaggtcagaagttcaagaccagcctggccaacatagtgaaaccccgtatctgctaaaaatacagaaaattagccaggtgtggtggtgggcacctgtaatcccaactactccggaggctgaagcaggagaatcacttaaacctgggaggcagaggttgcagtgagccaagatcacgccattgcactccagcctgggcgacagtgcgagactccgactcaaaaaaaaaaaaaaagtaaaaaccggttgggcgcagtggctcacacctgtaatcccagcactttgggaggccgaggcaggcggatcacgaggtcaggaaatcgagaccatcctggctaacatggtgaaaccccgtctctactaaaaatacaaaaaattagccgggcatggtggtgggcgcctgtagtcccagctactcgggaggctgaggcaggagaatggcgtgaacctgggaggcggagcttgcagtgagcggagatcgtgccactgcaccctagcctgggcaacagagcgagactccgtctcaaaaaaaaaattaaaaaaaaaaaaacgacttgttagatgtggttcttattctcagggaattcctgatctcattgtcaggagagaggtgaatgtcaagttgatggtatgacatgggcagttttgtgcagtgtctacaaacacggccattgcagtctggatctaagttctgagtttggcttcaaaaaacaaggtcaaaaacccttgacagggtggggaaaatggggaattgctgttgagtgggtataaagtttcagttatgcaagatgagtaagttctagagatctgctacacaacatagttcctgtattaatcgtatagcattatgcactttgaattatgttgaggatggatctcatgataaatattatcaccaaaaacaaaatacaaggaaattttggaggtgtatttagtgtttttttttttcttttttgagacggagtttcgttcttgttgcccaggctgcacagtacaatggcgcaatcttggctcaccgcaacctccacctcccgggtcaaacgattctcctgcctcagcctcccaagtagccaggattacatacaggcatgcaccatcacacctggctaattttgtatttttacttaggacggggtttctccatgttgttcagggtggtctcgtactcccgacctcaggtgatccacacacctcagcctcccaaagtgctgggattataggcgtgagccaccacgtgcttaataaagctaccttaataaagctttttacaaaacattggcagacccgggcacagtggctcagtcacatgtataatcccagcactttgggaggcttaggtgggaggattgcttcagcccaggagttcaaggccagtctggaaatgtggcaagaccccataattgcagaaaattaagctaattcatatatgcatcatctcacatccttgtcattttttgtgatgagaacacttaaaaatctgctctcagttattttcaggtatacgttattattaactgtaatattcatgttgtataatagatctcttgaacttattcccactgaaattatatgtcctttaccagtgtcttccccactacatgtgtaagatttaaattagttttgttagtaattctttaatatcatcagatatccagagttgaaatttctaattgtcttgtgtcacatctttttcaccatttattggtttgaatcaggatccaaagaagattcatgcattgtgattgattactgtctctttaagactcttttatctgtatcagagtttctcagcctcagtgctcttgacatcttgggcctgataattctttttttttttttttttgagatggaatctcgctctgtcgcccaggctggagtgcagtggcgcgatcttggctcactgcaagctccgcctcccaggttcacgccattctcctgcctcagcctcccaagagctgggactacaggcgcccaccaccacgcccggctaatttttttgtattttttagtagagacggggtttcaccgtgttagccaggatggtctcgatctcctgacctccggtaatctgcccgcctcagcctcccaaagtgctgggattacaggcgtgagccaccgtgcccggcctggcctgataattctttgtggtggaggactgacctgtgtcttggaggatgtttaatagcatctctagctttcacccacgagataacagtagcacatcccagcccagtagtgacaaccaaaaatgtgttagccaaatgttcctagaggcaaagtcaccccaggctgagaactactgatctactggttctccctccaatcagtcttcccttgtattcttcttgttatctatttgcagaagaacctgagtataatcttgcagtgtttccctcggtatggatttcactgatttaatccctgtagtataatttaacatcctgagtcaccaatttcctgttaattgggttggatctagagacttgattggtttcagagttttggagtttgtttgacaaaattgcattataggtagtggttttttctttttcttttttttttttttttttttgagatggagtcttgctctgtcccccacgctggagcgcagtggtgcaatctcggctcactgcaagctccgcctcctggattcaagctattcttctgcctcagcctcccgagtagctgggactacaggcgcccgccaccatgcctggctaattttttttgtatttttagtagagacggggtttcaccgtgttagccaggatgttctcgatctcctgacctcgtgatccgcccgcctcagcctcccaaagtgctgggattacaggcgtgagccactgcacctggccagtagtggttgtttctttcatcaagaggcacatgtctgttgtgtcttttttaatattaacaaccattgatgcctaattcattcaccaaagggtctttttgttttaaaatgtatatttttatttagacatgctttgctttaaataacaatctgtgttctcccttaataaaggcaggggaaatggaaggtgatgcagtcgaagccattgtggaggagtccgaaacttttattaaaggaaaggagagaaagacttaccagagacgccgggaagggggccaggaagaagatgcctgccacttaccccagaaccagacggatgggggtgaggtggtccaggatgtcaacagcagtgtacagatggtgatgatggaacagctggaccccacccttcttcagatgaagactgaagtaatggagggcacagtggctccagaagcagaggctgctgtggacgatacccagattataactttacaggttgtaaatatggaggaacagcccataaacataggagaacttcagcttgttcaagtacctgttcctgtgactgtacctgttgctaccacttcagtagaagaacttcagggggcttatgaaaatgaagtgtctaaagagggccttgcggaaagtgaacccatgatatgccacaccctacctttgcctgaagggtttcaggtggttaaagtgggggccaatggagaggtggagacactagaacaaggggaacttccaccccaggaagatcctagttggcaaaaagacccagactatcagccaccagccaaaaaaacaaagaaaaccaaaaagagcaaactgcgttatacagaggagggcaaagatgtagatgtgtctgtctacgattttgaggaagaacagcaggagggtctgctatcagaggttaatgcagagaaagtggttggtaatatgaagcctccaaagccaacaaaaattaaaaagaaaggtaaaacgagtttatccatagtggtttcataaaaccattttgggataagcatacaacacagtgcatatgcaagttgttttatattaaccgtatttgtaaaaggtcgttatgtgggtaccgttctttaaaaccagtctaaaataagttttttccagattgaatgctctttttttaatcccaaagaagaaggaaatgtattagtgacatgagataattatgacttatattgggttttgttattaaaagctaatcaaatatatttgtagaaatttaagattaggattaatcttaacactttgaaactctgcagcaagtaagtgttttattttgcacataggtgtaaagaagacattccagtgtgagctttgcagttacacgtgtccacggcgttcaaatttggatcgtcacatgaaaagccacactgatgagagaccacacaagtgccatctctgtggcagggcattcagaacagtcaccctcctgaggaatcaccttaacacacacacaggtgctggataagaatgttgggggctacaacagcaaatgctcagacttcgctttttagtattcattcaagctgactccagcgggaatttaaaggaagtttttattatttcttatgatgccctttttgtaatcatgattttattgtaagcacttggacttagttattatagacaaatgtaaagaaaatttaatgaaaaataacaccctctctcttaaaaaaaagaagtctcaggcaatagatgcctggtactatgaggaagaatgttagaaatagaagtgaaatcccagtgaaaccctgtctctactaaaaatacaaaaaattagctgggtgtggtggtgggcgcctgtagtcccagctactcgggaggctgaggcaggagaatggcgtgaacccgggaggtggagcttgcagttagccgagatcccaccactgcactccagcctgggcgacagtgcgagtctccgtctaaaaaaaaagaaaagaaaagaaatagaagtgaaatcctacctttatttaaaaaaaaaaaagtggccgggtacagtggctcacgcctgtaatcctaacactctgggaggctgaggtgggcagatcacttgagattagaagttggagaccagcctggccaacgtgacaaaatcacatccatctgtactagaaatacataaattagccaggtgtggtggcgggtgcctgtaatcccagctactcaggaggctcaggcaggagaatcgcttgaaacctgggaggcagacactgcaatgagctgagatagtgctactgcactccagcctgggcgacagagtgagactccatctcaaaaacaaaccttaacattttttgtttctggttgtttcacgtcaaggaagataattcataatttcagaatggaaaagctaaggcaccattctgataattcaaacatttatttgagcatcctacttactttagtgttcagatattctgatattagcttcatgttggctgtggccaggttccctgaggtctctaaagtagagggactctgtgcactaaacctctctttaagctttcctgagctatttgttatcccagtgtaggaagttggttgcaagtcttctcacatggtttttcatgcagaataacttcatttcatatgacaactcttgtttttgatttttaggtttttaaaaatttctaatgacaacccttgttttagatttgttgtgctggttgtcagatgaccatgatcaagtgggtgttaatcataaacagtatgctgcacatgggcacattcttcactaatgtgacttacttttaaacatctccctaatttctactcagacacttgataatatgttttatttgatactttgaagacactaggatggggcatatgactaaataaaagtaactgggtaatcccagcactttggaaatccaatggggggtagatgacctgaggccaggagttctagaccagcccggccaacatggcaaaaccgcctctgtactgaaaatacaaaaaatcagctgggtgtagtggcacacgcctgtaaacccagctacttgggtggctgaggcaggagaatcacttgaatgcgggagacagaggttgcagtaagccaagattgtgccaccgtactccaacctaagtgacagagcaagactctgcctcaccaaaataaataaataaataaataaatggccccataacaggacttcccaagatgggtgtgccttggtgtgggcattctctatctggtcttcagctttgaaagtaagaggtacagtctatctggttactcagcagatttggcaagactgattcataccaacaaaacccataagagcagatgcatacaccaagagtatcagtttatggtgaggagtataccttttcatgttccagatgcagttgcattgcattctagggggcgcctttgcctctgttacgatgctgtagcagccgggcgccgtagctctcgcctgtaatcccatcactttgggaggccgaggtgggtggatcacctgaggtcaggagttcaagaccagcctggctaacatgacgaaacctcgtctctactaaaaatataaaaattagccgggcgtggtgacgcatgcctgtagtcccagctactcggaaggctgaggcaggagaattgcttaaatccaggaagcagaaattgcagtgagtggagatcgcaccattgcactccagcctgggcgacagagtgagactccatctcaaaaaaaaaaaaaaaaaaaaaagatgttgtagcaattgaaagctaacttggtgaggatgagccttgatggctgggcatggtggctcacacctgtaatccctgcacctagggaggctgaggcgggtggatcacttgaggtcaggggtttgagaccagtctggccaacatgatgaaacctcatctccactaaaaatacaaaaattagccaggtggccgggtgtggtggcttacgcctgtaatcccagcactttggcactttgggaggctgacgcgggcagatcacctgaggtcaggagttcaagactagcctgaccaacatggggaaatcctgtctctattaaaaatacaaaattagccgggtgtggtggcacatgcctgtaatcccaactactcgggaggctgaggcaggagaatcacttaaacccaggaggcggaggttgcggtgagctgagatcgtgccattgcactccagcctgggcaacaagagcaaaactcggtctcaagaaaaagccaggcatggtggcccatgcctgtaatcccagcacttcgggaggctgaagcaggcggatcacaagggcaggagatcgagaccatcctggccaacatggtgaaaccccgtctctactgaaaatagaaaaaaaaaatgttagccaggtgtggtggcatgtacctgtagtcccagctactcaggaggctgaggcaagagaattacttcaacctggaaggtagaggttgcagtgagccaaaatcatgctactgcactacaacctgggcgacagagcaagagactccgtctcaaaaaaaagaggatgggccttgagtgaagggatgtaggtggtcatgtggcacagcctaatggaactccctgccccacagcagtgtccacttctttgctaattgccacgcttatgcaggcctttctctgccctggatagtactaggtaaacacgagcatttattttttagcttactttgttctaaaagaagaccaagcatggtggctcacaacctgtaatctcaggactttgtgaggccgaggccggaggattgcttgagcccaggagtttgagacaagcctgggcaacgtggcaagactccatctctacaaaatagaaaaaattagccaggcatggtggtgcaagcctgtagtctcagctactggagaggctgaagtaggaggatcacttgagcctgggaagtcaaggctgcagtgagccttgatcctatcactgcactcccactgggtaacagaggaagaccctggctcaaaaacaaaaaacgaaaagaaaattggatgccacttttcttctcttgttaattgttttacttcttatccataccaccagactatacactttcacaggaagaactctgtgctttaccgttagatccatagtggttctaaagaatcgaatgaacaaatgaacattccttggaattgcttagtttttattatactccagtcactcttcctctccagcattctcttcattctcaaagagaatcatttctgcagatggctggttctattcattacattgtggctcttcctaattgtatcctcaaaggcagccttcctttggttttagtgtttgatactaccttgctgtcaccccttacctgctgcccacaattacagatggtcactagtctgtgaaactagcactgcattgtgctctcagttttgtctctaagattccttcagtgaaagacaagaaatgtagagagtatattattcatgttttatattggatgaattgacattcagaatgatcacagcatattagacatggatgtttgaaaatcatttgtttaaatcacataaaaggaaatactatgtaaagcctgtgataagcctctgaaattccttatcaagacagatacatgtggaaaacaagttatatgtttgtgtttttaaaagaaagttgcagaatatggacagcccaatggccctatatttatagtcataatacaacgagatttgagagacaggatcttgctatgttgcccaggctggtctcaaactcttagcctcccagagttctgggattagaggcatgagccaccaagcccggtctctattaacttttaatccataatgaccaggatattcacaaaataggaataagaaggtttttattgtattcaaaggcagcggattcagatgggtaattaagagaaactaatttggtatgtgttataatatcctggtgttagtataaattcatccaggccctcccatagttttcggagctgacttttgtatctgctttcaagctactgcagttgatgggatgaatagggttccagtctcatagcagttctgtgccacacattgaactctgtcattaactgtgcccttgatcttgctcttcctgttactccatcctttctctaggtactcgtcctcacaagtgcccagactgcgacatggcctttgtgaccagtggagaattggttcggcatcgtcgttacaaacacacccacgagaagccattcaagtgttccatgtgcgattacgccagtgtagaagtgagtgttcagctttttgttggtatctctcttaggcagaccatgatttatttcaatacaaagctataactactacccaaacggacttaagatgaggtagaaaaatgttagtaaattattaacactcccacacaacaccgctcccccaaaaaacttatgatgattgtgaaagatttacttgttaaaaagagtcaagtttctggctgggtgcggtggctcacgcctataatcccagcactttgggaggctgaggtgggcggatcacctgaggtcgggagttggagaccagcttgaccaacatggagaaacccgatctgtactaaaaaataaaaaatttaggctgggcctggtggctcacagcctataatcccagcagtttgggaggctgaggtgggtggatcacaaggtcaggagattgagaccatcctggctaaaacggtgaaaccctgtctctactaaaaatacaaaaaattagctgggtgtggtggcaggcacctatagtcccagctactcgggaggctgaggcaggagaatggcgtgaaccccagaggcagagcttgcagtgagctgaaatcacgccactgcactccagcctgggcgacagagcgagactccctccatctcaaaaaataataataaataaataaataaatattagctgggcgtggtggtgcatgcctgtaatcccagctacttgggaggctgaggcaggagaatcacttgaacccgggaggtggaggttgcagtgagccgagatcgtgccattgcagtccagcctgggcaacaagagtgaaactccgtcttaaaaaagagtaccagtttcacatgttaatacaggcaaattctgtcaaactttgaagaaaaaactgtacccagagcattttaaaatggtaggtttatcaattttattatttgaagctacactgttaccaaaactgggtcagaaaactaccaaaaagaaaacttaccctcagagagaagcaaaaattctaaatgaaattattagccaatgagccaacctaatttagtaatacgttctaaaaataagtgatactgaatatatctgaaacacaaagattgtttatcattgggaaattgctgatgtatattacattgaaggattgaagaaaaaccatattatttctgtagatgggatgggagctaaaattcagtaatcattaattactgtttaatgtcctagcaagttacgtataggagaaaacttctttaatataatgtgtttaggctgggcatggtggctcacgcctgtaatcccagtactttgggaggttgaggtgggcagatcacctgaggtcaggagttgaccagtgtggccaacatggtgaaacaccatctgtactaaaaatacaaaaattagctgggcatggcagcatgcgcctgtagtctcagcgactcgggagcctgaggcaggagaatcacttgaacctgggaggtgaaggttgcattgaggcaagatcgcaccactgcactccagcctgggtgatgagtgagactccccctcaaaaaaattttaaacagcatatataccagaaatgtataataaactcatcctaattaattctgaaacattgaaagtatttccattaaaatctggaatatgacaagatattcattcttaatgttactgtttcagctttgtactggaaatcctagctaatcgaataaagcaagaaatgaattattaatggaaagataaaactgttatttcttgcagagagatttgcttacagagaaaatctaagagtatcagaacaaaaacttagagcaataagagttcagttcactggccggatataagataagcatacagaaatcagtaacgtcaatagtgataggaaggtatgaaatggattctaatagcaataaaataactgagggataaactgaacaacaaaaaatatctatgaaatgtacatgaagaaaacctcagtaacttttccagaggacctgaataaatgaagaaacattacaagttgattctaactttcaactggaagaataaatatgaatggctaagaaaaatttgaaaatagaatgaggggcttgtgccattggattttgtaaaactatagtaaatgaagccagtgtgatattgcagtaggaatagatagctcattggaacagagtaggttctggtacatattgaaattaacaggttaaatagggaaatcttgaaggaaaagaattagtaacgctgttaggatagttatcgacttatgtgtgtgaaaacttggtgtgtaacacttatgagtggggccaggcgcggtagctcacgcctgtaatcccagcactttgggaagctgaggcgggttggtcacctgagatcaagagtttgagaccagccgggccaacgtggtgaaaccccgtctctactaaaaatacagaagttagccaggcctggtggcgtgcgcctgtagtctcagctactcgggaggctgaggcaggagaattgcttgaccctgggaggcggaggttgcagtgacccacaatcgtgacagtgtactccagcctgggcaacggagcgagatttcatctcaaaaaaaaccaaaaaaaactcagagacatttatgagtacagtgtttttttgttttttgtttgtttgtttccttaaaattgggatactttttaaatttttcaaaacaaacattgaaacattagtgaatgttcaaaacgctttttggagcagggggtgcgtggcagacagggtctctcactctgtcgcccaggctggactgcagtggcgtgatcatggctcactgtagccttaaactcctgagctcaggtgatcctcccacttcagctgctcctcacgtagctgagactacaggcatgtgccatcacacccaactaatttttgtattttttgtagagacagggttttgccatgttgcccaggctggtctcgaactcctgacctcaagcaatcgcacgccttgggcctgccaaagtgctgggactacaggtgtgagccaccgtgacctgccctcaaagcacttcatagaatcaagtttgaaagtcactgttttagtataaggtatcctgcaggggactaaaggatggataatggtgaggatgatagaagagaggcccttcgagcctggcctgtctaggaaacgctaatgataggaaaagaggatgagtggaattaaaatatgtactcagtaacacaggatttggaacaaattgatctgtaaataggcatggattatttttaaactattatggaaaatttcaaacatgtagaagtaaagattgtaatacatcctcatgtgcctaccacccagcttaaacagttactagtaatgcgcagtctttttttttgagacagagtttcgcccttgtccaggttggagtgcagtggcacgatctcgggtcactgcagcctccacctcctgggttcaagagattctccagcctcagccttccgagtagctgggattacaggcgtgtgccaccatgcttggctaatttttgtattgttagtagatacggggtctcaccatttggccaggctggtcttgaactcctgacctcagatgatctgcccacctcagcctcccaagtaatgaccaatcttggcttatctatacccgtattcatttacccacttctcttagataatgatatggattcgagaagcaaagtttacaaataatgaagagggaagaaggttatcttttagacttctgtattctgaacttcagtgccccaaagctaagcttttgtgcctaacctactgtgctcttgttacagtctgtgttaacagaagttaaagttcggttgttttcgtatttcaggtcagcaaattaaaacgtcacattcgctctcatactggagagcgtccgtttcagtgcagtttgtgcagttatgccagcagggacacatacaagctgaaaaggcacatgagaacccattcaggtaggacttctccactccttactgtattaatgagcttcttttcagtgaatcccatgggaccctgtggaccactgtgtgtccccattgtttatatgaatgaagactggcatgaaaatagtatggaattgataatgcttctccggcatatcctctgaattcgttgttcagaaaacacattagaaaatagtaccttttgttttgttcaacttgaatctgcctacaacaagaaaaattttaagggagaaattaagttaaaatggacagattttaattttaaaagtctgggtagatttcctaacctaccttattcagttttcctggatattgtcttttcctaaaaagaaaaacttgtgggttctccattcagtctcccccaaaggtaagcattgctgtaatgtggaggattccagagtagagctgggcagagcagaggtggccagcagcagtttaggacttggccatatctgaagatagacaagatccgggaactgggactgagcctcagccttcctaagacctgtagattctctgtggtgtagcatatctgccacctgagttaccctccagttaaattacagtatttattcatttcatttatgtgttcattctgtattttctttaaaggggaaaagccttatgaatgttatatttgtcatgctcggtttacccaaagtggtaccatgaagatgcacattttacagaagcacacagaaaatgtggccaaatttcactgtccccactgtgacacagtcatagcccgaaaaagtgatttgggtaagtagattaactagtgagaagtgaaaaaaatattttgaaggatttatatttcgaaatatggggatcaaaaataacttcaccttctgactctcataacattttatgtataggaatggcctgtcacttagtttagtaaaagccattgcttagctgctttttttttttttttttttctatttcttccttttcttactgtagtcaggccacaagattctgtcctgagtaaaactcatctataaattaatgggagctgtgatgggaggagacagagtacacctttaattagtagccttccttccccaaataggaaagtaacatagtgtgattcaaactcaggtcattctattgtatttttttgagaacgtctgtactttctctaggtaatgggactgttttattggtttagtggtaactgtatttctgtgcatagttaaactagagtttacatgcagccggagtttattaataatatttagtgtaggccgggcgcggcagctcacacctgtaatcccagcactttgggaggccaacgcgggtggatcacgaggtcaggcgatcgagaccattctggctaacatggtgaaaccctgtctctactaaaaatacaaaaaattaactgggcatggtggtgggcgcctgtagtcccagctactcgggaggctgaggcaggagaatggcgtgaacctgggaggtggagcttgcagtgagcagagatcacgccaccgcactccagcctgggtgacagagcgcgactctgtctcaaaaaaaaaaaaggtaacgagtaaaaagtgagagccatcctctcccttacctcatatctactcccaataattagctctctttaagtttagtgggatatcacctcagttgatacaacttgtagtaccgtaaatacataaattcatgatcccaaatgtagctgggccctcactgctcctagctgttccagctgtttgttcttgtcaggtgtgctccagttctttatgagtgagcgaattcattccacagtgtttggtgcttatatagagttgggcaacctactcttactttttttttttttttttttgagatggagttttcctctcgtcacccaggctggagtatgatggcatgaactcagctcactgccacctgtgcctcccaggttcaagtgattctcctgcctcagcctcctgagtagctgagattataggcgcataccaccatgcccggctaaatttttttttttttttttttttgtattttttagtagagatggggtttcaccatgttggccaggctggtcttgaactcctgacctcaggtgatctgcctacctcggcctcccaaagtgctgggattacagacatgagccaccgcgcccagccctcacttgcttttttttgtgacaaagttttgcacttgtcacccaggccagagtgcagtggcctgatctctgttcactgcaacctccgcctcctgggttcaagctcttctcctgcctcagcctcccaagtggctgggactacaggtgcccgcccatggctaatttttgtatttttagtagagacagggtttcaccatgttggccaggctgctctcgaactcctgacctcaagtgatctgccctcattggcctcccaaagtgttgggattacaggcgagagctgctacaccagatcccctactcctattttcttataacctctaattttccttcttttttctctcccctcttggtctcagtaaatgacttctcttcctacttaaaaaataaagacaaagggccaggcgcagtggctcacgcctgtaatcccagcactttgggaggccaaggtgggtggatcatttgagcttaggagttccggagcagcctgggcaacatggcaaaactccatctctaccaaaaatacaaaacggttgtggtgaggtgcacccttggttccagctactcaggaggctgtggtgggaggatcacttgagcttaagaggtagaggttgcaacgagccgagatcgtgccactgcactccagcttgggtgacagagagaccccatctcaaaaaaaaaaaagaatcttagccagacacagtggctcacacctgtagtttcagctattcaggaggatgggccaggagttctagaccaacctgtgtgatatagcaagaccccgtctcttaaaataaataaaaatatagccgggcacggtggctcacgcctctaatcccagcactttgggaggctgagatgggcggatcacaaggtcaggagatgaagaccatcctggctaacacagtgaaaccccatctctactaaaaatacaaaaattagccgggtgtggtggcacatgcctgtagtcccaggtacttgggaggctgaggcaggagaattgcttcaatccgggagggggaggttgcagtgagcggagatcgcgccacggcactccagcctgggcaagagagtgagacactgtctcaaaaaaaaaaaaaaaaattatatatgtgtgtgtgtgtgtgtgtgtgtgtgtgtgtgtgtgtgtgtgtgtgtgtatgtgtgtgtatatatatgtgtgtgtgtgtatatatgtgtgtatatatatatgtattcatatatatatgtatttttatatatatgtatgtcttcaccctctaggtttaactcttctctccttcccagccagcctttatgaagagttaacatccctcacagtcttctccccctcatctttccctcttgtctggcttattccccatcactctggtataatgactgttgcttaaggtcatgaatgaccccactctctgaatgtagtgaagactcctttccactcttcttcctaagagatgacttgatctgttagcagtgttcttcatcgttgacagtaccctcttcctttgaaacactttcttcccttggcctctgtgacactaaatcctgttggttttcttcttcctcttacttctttaaactttctcttattttaacctttttttctctcactggccttaactccaaggtttttgtttttgtttttgttttttactggagactgtcttgctctgttgcccaggctggagttcggtggctcagtcttggctcactgcagcatcgaccaggctcaaggaatcctcccacctcagcctccctggtagctaggaccacaggcacatgccacgatgaccagctaatttttttttttagcttttggtagagacagggtttcactatgttgcccaggctggtctcgtactcctggactcaagcaatccacccacctcagcctcccaatatgctaggattacaggtgtgagccaccacacctggcccaactctgagacttctttgtgtgtatgtgtgcttgtgtgctttgtgtgagagacggagtttcactctgtcacccaggctggagtagagtggcgcgatctcggctcactgcaaccaccacttccctggtttaaatgattctccttcctcattttcccgagtagctgggaccacaggtgtacgccaccatgcctagctaatttttgtatttttcagtagagacgggtttcactatatgttggccaggccaggtctcaaactcctgacctcaggtgatccacccacctttgcctcctaaagtgctgggattctttttgagatggagtctttgtcgcccaggctagagtacagtgcagtagcacaatcttggctcactgcaacctctgccccccaggttcaagccattttcttgcctcagcctcccgagtagctgggattacaggtttacaggcatacaccaccacgcccagctaatttttgtactttttagtagagacagagttttgccatgttggccaggctggtcttgaactcgtcacctcaggtgatccacctgccatggcctcccaaagtgctaggattacaggcgtgagccactgtgcctgccaactcttagacttctcaaagcatgacccattctttttattttaattctactttttgccttggtgatcttatcagctcccatgggctcaaattctaacaactctttgtggcattggtggtacagtgataagcatagctgctttcaaatcctaacaacttgtacatttatattcctactccagatctttcttttgagttagccttatataactgtgtatcccttgccatcccacccctgcttttatatctctggcatttcaaattcagcatgtctaaaactgaaggtctaaaacttctctgtcccctatgcccccccaccccccgaccctgaaaataacacatacaacttggtcttaagccctcttccactattcttgtctcaataaatgaccccaacagctacctggttttccaggcctgatacctactttattcttcactctctacagtcactaaatcctgttgattcaactgcttccatctctcatcagttcttccccttccatccacacccattgtcatcacccttgtcccagccaccatcttctcccacctatcctgtttgaacaatcttaattgttctccctgcacctgttactctgccttttcattcattttctgtatagcacccagagtaatacttaagaatcaggagaaatgggctgggcgcagtggctcacacctataattccagcattttgggaggccgaggcgggcagatcacgaggtcaggagattgagaccatcctggctaacatgatgaaaccctgtctctactaaaaatacaaaaataaaaaataaaaaaattagccgggcatggtggcgggcgcctgtagtcccagctactcaggaggctgaggcgggagaatggcatgaacctgggaagtggagcttgcagtgagctgagattgcgccactgcactccagcctgggtgacagagcaagactccgtctcaaaaaaaaaaaaaaaaaaaaagaatcgagaaatgtattagtaacttgttaaaatgcttgtttgtgttttcacattaccctgggctttttactgtgctttcaggtgtccacttgcgaaagcagcattcctatattgagcaaggcaagaaatgccgttactgtgatgctgtgtttcatgagcgctatgccctcatccagcatcagaagtcacacaagaatgagaagcgctttaagtgtgaccagtgtgattacgcttgtagacaggtaggaaccttcattgaaagttgttggtgctttctcggtgtctggtgttatcagagggcatttacatatctagtacagtggctgtttttaaagatagtattttcaaactgtggattatgaggaatgtcaccaaaatcaaaggtcatgctccttgtcaattgtgtcatcccggtgtccagatgatgttttattcagtcacagcttacctcttccttaagcagacatctttctgaaaactgtggaaagtaagtccaggacttgagagaggggaagaatctcatgcggggacatgactgttgggagggagccaaagaaggagctcagcaggaataagcagctctatctgtgctacaattatggaagcagttgtgcaccacactaaaaatacctttatcaagccgggtgcagtggctcacacctgtaatcctagcactttgggaggccgagataggcaacagagagagaccccatctctacaaaaagaaaaaattagggccgggcgcggtggctcgagcgcctgtaatcccagcactttgggaggctgaggtgggcggatcacttgaggtcaggagcttgagagcagcctggccaacacggtgaaaccccgcctctactaaaaatacaaaaattagccgggcatggtgatagacgcctgtaatcccagctactctggaagctgaggcaggagaatcgcttgaacctggggcggaggttgcattgagccgcgattgcgccactgcgctccagcctgggtggcagagcgagactctgtctccaaaagaaaaagaaaaaattagctggggccaggcacggtgactcacacctgtaatcccagcactttgggaagccaaggcaggcagatcatttgaggttgggagttcaagaccagcctggccaacctggtgaaatcccatctctactaaaaaaaaaaaacaaaaaaacacgaaggtcggccgggcgcggtggctcacgcctgtaatcccagcactttgggaggccgaggcaggtggatcacaaggtcaggagatcaagaccatcctagctaacacagtgaaaccccgtctgtacaaaaaatcagctgggcgtggtggtgggtgcctgtagtcccagctactccggaggctgaggcaggtgaatggcatgaacccagtgagccgagattgcgccactgcactccagcctgggcgacagagtgagactccatctcaaaaaaaaaaaaaaaaaaaaaagtcagctgggtgtggtggcaggcacctgtaatcgcagctactcaagaggctgaggcaggagaattgcttgaatccgggaggtggaggttgcagcgagccaagatcgcgccactgcactccatcctgggcgatagagcgagactccgtctcaaaaaaaaaacaaaaaaaattagccaggcatggtggctcatacctatggtcccattttgaagctgcagtaagccatgatcacaccactgctctccagactttgcaacagagcaagaccctgtctctaaatatatagctttatcatctcaacaagccgtgtggagtctagacctagcttgggtgagaaatacctgttggccacatgcatgcaggtggcagctggggcagtagccccatgagcaggctctgaggcctttccccctatgccgtttcaggagaggcacatgatcatgcacaagcgcacccacaccggggagaagccttacgcctgcagccactgcgataagaccttccgccagaagcagcttctcgacatgcacttcaagcgctatcacgaccccaacttcgtccctgcggcttttgtctgttctaagtgtgggaaaacatttacacgtcgggtaagggtcagaacttcactttgcctgttatgatactgaatattggatttttggtcttcctctgcagagcatggtagtttttttcactgaggttataaacagagatgctccattgtttggaaagggttagtcatccccatcttgatgtttctatccatgtgtgaacccttccactgatggggaacacagtatctttgaatagattgattgcataaagaaatttcctggccaggcgcggtggctcgcgcctgtaatcccagcactttgggaggccaaggtgggtggatcacgaggtcaggagatcgagaccatcctggctaacatggtgaaacaccgtctctactaaaaatacaaaaaattagctgggtgcggtggcgggcccctgtactcccaggaggctgaggcaggaggatggcgtgtacccgggaggcagagcttgcagtgatccgagatggcaccactgcactccagcctgggcgaaagagcaagactccgtctcaaaaaaaaaaaaaaaatttccttaggtggattgaaacctgcaccccaccctaccccacccttagctagctgtagcctgttctgggtcttctcttgggggctctgttagatcttgacagaactaagagctggtctgatcctcccccgtctctgtctgcaggctgctgagcctccccttagagaacccagccttatccatttcccctgagcagagacagcgtgttcaggacacacttagcagatactagaatttttaggcttaatatggattttattaaagtaaataacttccaatctgatcttagcttttttagtggtgtgaaagaggattttgttctttttgttagaataccatggcaagacatgctgataattgtgctggcccagatggcgtagagggggaaaatggaggagaaacgaagaagagtaaacgtggaagaaaaagaaagatgcgctctaagaaagaagattcctctgacagtggtaagtgacttgttccttgatttgcttactatggcaggctttggagcccagtttccagtgtgtttatgtatggatatgctgggatatagaggcgggcacacactcttcctttctttaaacttctcatctcctaacgtctatttacaacagcagttagtgtttttctggggcatattttcttttttcttcgtggcattccgctcattaatgcccttttttttttttttttttttttttttttttttttttttttttttttgagacggagtctcgctctgtcgcccaggctggagtgcactggcgcgatctcggctcactgcaagctcagcctcccgggttcacgccattctcctgcctcagcctcccgagtagctgtgactacaggcgcccaccaccaggcctggctaatttttttgtattttttagtagagacggggtttcaccgtgttagccagaatggtctcgatctcctcacctcatgatccgccctcctcagcctcccaaagtgctgggattacaggtgtgagccactgcgcccggccattattaatgccttatacgtaatcttgagttaaagcaaaattaatatttttattcagtttattcaaatttgtgatattctaaggccagcagagtttcttttcctatgttcttaacttttacatttaggaagctggtctagataagagcagtgaatctaatggacatgaagaaggttgtttaagcatcttcacttatggtttgactgcctgtgtcagcctaaccttgagaggtgctgatcaagtcagtgaaggtcagcctttctcttcctaccttaatctctccatttaaagtttaaaatcttgcctattttcctaccacaggtactctttggagtgttttttgcctctctagtcatgaaacccaggcaggaggttgtgcttagaagtgccaagcctcggtcgggcacagtggctcatgcctgtaatcccagcactttgggagacaaagatgggcagatcacttgaggtcaggagttcgagaccagcctggggaacatggcaaaaccttgtctctacaaaaaatttaaaaattagccaggtgtggtggtacatgccgatagtcccagctactcgagaggctgaggtgggagaatcacctgagcccgggaaattgaggctgcagtgagctgtgatcacgccactgccttccagtctggtggtcgaagtgagaccttgtctccaaaaaaaacaaaaagtgccaagcctcacaaagagggtggaggaacaagagtcttggtaacttggaggccacatttaattacacaaacatgttcagagtgttagattctgtagtgtggatatctaggttgctggcatccaggtgggaaggcacctctgtaactaaagacttaaggtatggatggaaaaggtggtagagagtttggttttaggaaatggacttcccagaagcaccattaaactggagagattatagatgatgcctgatagtctagggattcttcatattgtgttttgcactggttgtcagtagaaatagtggggaggggttgagatttttgaagaaggaacatattggagaactttagtgactttattgggctttttttgttctttgtttgttttttttttgttttttgttttttttttgagacagtgtctccctcttgttgcccaggctggagtgcagtagtgcgatctctgctcactgcaacctccaccttctgggttcaagcgattttcctgctcagcttcccaggtagctgggattacaggcatgccccaccacaccctattagtttttgtatttttagtagagatagggtttcaccatgttggccaggctggtccagaacccctgacctcaggtgatccatccgcctcggcctcccaaagtgctgggattacagatgtgagccactgtgcccggctgtttttttgtttttaaatagagatggggtcccactgtgtggctcaggctggtctcgtaactcctgggctcaagtgatcctcctgcctcgacctcccaatgtgctgggattataggcatgagccactgcacccagctactttatgggttttattgtaaaactttctcatgaaagcactaagctgtttatgtttggatctgtaacaaggtcccccccacccccccccccttttttttttcctttttttaaatggagtatccgttttaagtagcatcttcttcagtcactgggtgttaagtgtatgcctcctttaagatgtcaatttgcagctggtcatggtggctcacgcctgtaatcccagcacttcggtaggccaaggcaggcagatcaccttagctcaggagttcaagaccagcctggggaacatggcaaaaccctgttatctacaaaaaaatacaaaaatcagcagggggttgtggcctgcgcctgcggtcccagctacctgggaggctgaggtgggaggatggcttgagcccagtaggttgagctgcagtgaactgagatagtgtcactgcactccagcctgggtaacagagcgagaccctgtctccaaaaaaaaaaaaaaagggaaaaaaattattgcactgaactgttgggggttttcagaaatgttaggagactcccagatattaccagtgatcagataatcttaaccttggggatccctatagttgttcttagttgcaaagccgcctgctgccagactctgtcctatgtcctgctttctcctgatactgccttgttcacttctgtggttcatctccaggaagaccagcttctttccctaattgtatgtaaccagaagcatctttagtcaaaagagattattgatagcttctgatagatttctacagttctgtgttctgtctgctgctggttagtagagcatggaatttggttccaggccttatacctagtgactctttatctcccccagaaaagggacgtcagcctgggctccatgccactgttggccatgcagtcttacttgtcctgacccagaagttctgcctgtcggctgtctacagagattgaccagcagatggtctactgctgttttcaaggctttttgctgaaataccaccaagccaataagcctttgatcctgttagcctgcttttgtgtgcttttccccccaattctgactgaacttgtttagttttctaggcattgggccaacttaggcaatagagggcttgaagaagttcagcagggaagcatctctcgttcttgacacactgccacctatctatatattccccacgttttcacttaggatttcagtcacttgagaaataaggcattttatctggaagatcaggagtttacccacagatctctaaatttaaacattttgttccagagaaagagagtgcatgttaataacccgtgctttctagaggaaggcaggcagtgtacattttgtgccgcagccatgggggagggataacaaaagctctttggctgcctgcagatgtgggcgccagaacagccccagactgagggcagaggtttgaattctacctgctgtgacttagctgtgcattgcagtcacttagtttctcactttttctataaaatgagggtaacaccctcattcaatgaagtactgaagcctaagtggaaaatggtgaatttttaaattgtgatgtttgctataagtaaaagctgtgtttgtggtagactataggttacggagcaggattaaatgagttccgtgagtcctgttgatccccaggtgtcactattaaatggagtgagaatgttacagaaattactcagggaaactgagtctcagctggtcagatgtcccaggtcacgtacctagtaagagatctgagactcagccttgttgcctggctcctcgtcagtattctttatacaatagtttcctcactttcatgtaccacttattttaccacgaatggacaattgtggcattagggaggagagcaagagggttggaaatgacacattgggtctagtacagctgggaattaagtccaaaaacttgaccttaaaagagaatcaataatagtttcaaaagaactcttgctacttaccttagtaaataggacctcacaatgcgtaagaatttctggccaggcgtgatggatgaagcctgtaatcctaacactttgggaggtcaggagttagaagctgcagtgagctatgaccgcaccagtgcactccagcctgggtgacagaacaagaccccgcctcaaaaaaaaagaaaaagaatttccgtcttgtcccctgacacacacacacacacacacacacacacacacactctcactcactcactcttacccttcctgcccacttagagatgagcagaaccacatctccaagggtccatttccggcttagtgtcctgctttatcctggtatagtaggtagggggatcatgagaatttgaaattcggtattgtgttgagtcaaaaaagggtctaaagctaaaaggaaaaagtaatagccaatcccacataaaatgtgaataatagtattcaagtcgatttgcttcattctgctgtaatacctgtttattatattaatcctgatagcaaaaattccagcaaaagcatttttatttattattttttggaacctcacaccctgctcccctaaaagcatttttaaatgggcttttgttttgtttttagtttttatttatttttgttgttatttgtttgtttttcccagacaaagtcttactctgtcacccaggctggagtgtagtggagtgatctcagctcactgcaacctccgcctcccaggttcaagtgattctcatacctcagcctcctaagtagctaggattacaggtgcccgccatcacagctggctaatttttgtatttttagtagagatggggtttcaccatgttggcctggctggtctcaaagtcctgacttcaggtgatccacccacctcggcctcctaaagtgctgggattacaggcgtgagccaccatgcccagcctaaatgggctttttttttttttttttttttacacaggatctcactgtatcacccaggctgaatacagtggtgaaatcacagcacgctgcagcctctacctccctggcttaagcaggcctcttgcctccgtctcttgagtagctgggactacagacacacaccaccgtgtcctgctaatttcttcctttttttttttttcttattttttttccttgagacggaatctcactctgttgcccaggctggagtgcaatggcgtgatctcagctcactgcaacctccacctctcgggttcaagcaattcttctgcctcagcctcctgagtagctgggattacaggtgccgccaccacacctagctaatttttgtatttttagtagagacggggttttaccatgttggccaggcttgtctcgaactcctaacctcaggtgatccacctgcctcaacctcccaaagtgctgggattacaggcatgagtcactgcgctgggtaaattttgtttttgtttttgtttgtttgtttgtttttttgagacggagtcttgctctgttgccaggctggagtgcagtggcgcaatcttggctcactgcaacctctgcctcctgggttcaagtgattccactgcctcagcctcccgagtagctgggactacaggcatgcatcatcacacccggctaattttttgtattttagtagagacagggtttcaccatgttgacgaggatggtctcgatctcctgaccttgtgatccacccgcctcagcctcccaaagtgctgggattacaggtgtgagccaccatgcctggccaccttttgtttttttgttttttttaaagtagagacggggtttcaccatatttgccaggctggtctcgaactcttgacctcaagtgagctgcccaccttgccctcccaaagtgctgggattacaggcatgagccatcacaccgagtcaatttcgtttttgttttttgtttgtttgtttgtttttctctggagacagagtttcactcttgtggcccaggctggagtgcagtggcggatctcagctcaccgcaacctccgcctcccaggttcaagtgattcttctgcctcagcctcccgagtagctgggattacaggtatgcgccaccacgcccagctaattttatatttttagtagagtcagggtttctccatgttggacaggctggtctcaaactcccaacctcaggtgatacacccacctcagcctcccaaagtactgggattacaggtgtgagccaccacgcccagctgccagtttcttattnnnnnnnnnnnnnnnnnnnntattcatctttgttgttgttctttttttttcttttactgcatgtgtcattgtctgagacagcacgacacctttgctatgtctttatctttgttcttttcttcgtctgtgttctgcttctttttcgttcatgtgtcgtgtgtttcttctgtttctttcttgggggtatgtgatcttctttttctttgttttggcctttcttcggttttgttgtgttctctctattttttcttctcctgtgccgccctgtcttggcctatcattgtttttttcttgtttttgttgtcactgtttttactctctgtgtcctgatgtcctgttcctgctgttcctccgcgtcatcctcgtatcttgctggtaattccttgtgtagtccgccttgctcgtgccctttcttgttttttctgcttgtctggctgagcatgctggctcacacctgtaatcccagcactttgggaggccgaagcaggcagattgcctgaggtcaggagtttgagaccagcctggccaacatggcgaaaccccatctctacaaaaaatacaaagattatctggattggctgggcacgttggctcatgcctgtaatcccagcacattgggaggccgaggcaggtggatcacctgaggtcaggaattcaagaccagcctgaccaatatggtgaaaccccatctctactaaaaatacaaaaatcagccaggtgtggtggcgtatgcctgtagtcacagctactcaggaggctgagacaggagaattaaacccaggttgcagaggttgcagtgagctgagatcgtgccgctgcattccagcctgggcgacagagtgagactctgtctcaaaaaaaaaaaaagaaggaaaaaaaaattacctgggcatggtggtgcgtgcctgtagtcccggccactcaggaggctgagccacgagaattgcttgaatctgggaggcagagattgcagtgagccgagatcgcgccactgcactccagcctgggcaatagagtgagactgtctcaaaaaaaaaaaaagaaagaaagtgtatatatatatatatatatatttataaaacaagacttcaaataatatataattgttttctttcatcttccaccacccttctccttgccccaccacctgtgcttcctgatttcatgaaaagaaaatgctgaaccagatctggacgacaatgaggatgaggaggagcctgccgtagaaattgaacctgagccagagcctcagcctgtgaccccagccccaccacccgccaagaagcggagaggacgaccccctggcagaaccaaccagcccaaacagaaccagcgtaagttgttcatctctgctctggaggctggcgtcttctccgagcatgtgggggagccagatgggtccttgttctttggggatgtgggaactaagccatgagaacaagttaagggcatgtcgagaacaaactctcaggaaatggctttttaggagtttttactgaggaacatctgaggaagtctttagaggcctgttacatttcaagaagaagtccagagtagaagggtacttgtgttctgcaagatgggtactgttaatgtgggcgggttttgaaaaacaaccaaagtcacagtcagctggcagaatggatgcggtaatgaatataaaagagccaaatcgtaaaggttggagagggaaagcagtttctgcactgagattgccccttctaagaaactcagggtcaggcggtggctcatgcctgtgatcccagcactttggggggccaaggcgggaggatcacctgaggtcagtagttccataccagcctggtcaacatggtgaaaccccatctctgctaaaaatacaaaaattagccaggcgtaggggtgggcacctgtagtcccatctactcaggaggctgaggcaggagaattgctttaacccggggggcagaggttgcagtgagctgagatcatgcccgtgcactccagcctggtcatagagcaagactccgtctcaaaaaataaaataaaaaataaattgactgtctctggaccgctatctaataaggctgtcctgcattgctgacatcccgttcgctgtcagtctaaaagacccttgtgattcttggggctttaatggaccatttgttctgtctgtgctcttctttgccagcaacagctatcattcaggttgaagaccagaatacaggtgcaattgagaacattatagttgaagtaaaaaaagagccagatgctgagcccgcagagggagaggaagaggaggcccagccagctgccacagatgcccccaacggagacctcacgcccgagatgatcctcagcatgatggaccggtgatggcggagccttgtgcgtcgccaggacttctctgggctgtgtttaaacggcccgcatcttaatttttctcccttctttctttttttggctttgggaaaagcatcattttaccaaacataccgagaacgaaaacttcaaggatgatgttagaaaaaaatgtgatttaactagaacttgctgtctgatgttagcaaatcatggaatgttctgagtccctgagggtttactgtgaagtgctgaggacagtgttgacaactaactcgttttcctagatggaaacggagacattgacccctccctccatgtggtaaaccactccagaatggccaccaggcttcccagagttctatggtcttcttcccaagagagtttttaattgtaaatgcatacttgggaaggacttagagttttaaactgttttttgcttttgcttttccctgactccctttgcttggagtcagctgcacaccagtagtatggcatgctacgatcaggttctgtcctgaaagctttgcctctttcttggcaaagtttctggtatggtcaagcttgtaaataactttttttacattttaatcttttccattaattaagaggttgaaaagaagtgcagtgtaagaaaacccagcattttaattacttgcaaattaagttaccacagactctgtagtgtgtaaatgttgacaaggaattggatcacaatcatgtagcagaatggcacccagaccactgcccaccagtgacggacatgcacgtggcagatcatgatttccagcccacggagccagcatttgaaccttgtataattaactttcagttatgatttcccatcgacattttctttgccctgtttgtagctgattgttgtgttttataaatcttctgttaaggcagaagggtgattatgagtggttcacagcagcccttataagctgggccagaaaatttcactaggtcagtaatttaaaccttggatcttcaaaaaataaaataatgtgaagcaaaaccaactaaaaagtgattcttgcacatgaactgtcacatgtttaaaaatgtgttttttagagagcctcagtcttactgatttcaaacacttttttcttctgtgtattgcttttaagagagccatcagttagctatcagactctaggttgatgcattttgtacttagctgtactgtgtgatatttttcattattttaggacgccaacatgagacctgtaataaaatatgtaatggggttgaaagctggggaggaggatctactgctgtacagctaataaatcataacggattaacaagtgctccaaagactccatcttgcgtgattcctgcctgcttgagggaggctggggggctgcatacatggttccaggctgtgcaggctgctgcctttcacaggcaacctctgttccctgggatggtactttctctagcagatgggacgatatgatcttggcgggtgactggatattgagcgcatcctgctgtaactgtttttttgttttgttttgttttgttttgttttgtttgagatggagtctcgctctgttgcccaggctggagtgcagtggcgcaatctcagctcactgcaacctccacctcccaggttcacgccattctcctgcctcaacctcccgagtagctgggactacaggcgcctgccaccatgcctggccaattttttgtatttttagtagagactgggtttcactgtgttagccaggatggtctcgatctcctgaccttgtaatccgcctgcctaggcctcccaaagtgctgggattacaggcgtgagccaccacacccggcccctgctgtaacttcttaactccccaaaatgtgtgtctaagtagacaggtgagtagatggacagcagccagcttccatgatccacttgaggagtaagtgccccatgcacagagtagatggggcgtagagctgcttagagtgaaaggggctgaggggaagctggtctactcaggctctcagctcaaggaggcctaggatcagatgtacctggagctctgccaggtgtgagggaacagagaggagctgggcccagtctgccctagagaagttcatttgaaaggagagacagatgcacaaccaccgagtagtgaagagaccgtcttagataatagagctgcctggtagcacttcaggaaggtggttggaaagggagttgtgtcgtgtttggaatcttaggcgtgagtggaaaattatcttgctgctgctgccattcctaggcagattgctttggcaaacccacttgaggtgaaagcttaaaccacttgagttttttaacctaaattccaacttaggagttgtcaattagaagtaacagagcaaaatgtgtgaagcttttagctggctagtgctgtccacacagatgggtctcccaggaaaacgacccagggcctcctggggcctcgggactcagccaggcagttaactcgttggtctgaaagttagtggtctcaggctgttggagcttgagttctctatcccatccacgggtttacccgccagggtaccccctaccagccagccaaaactttttttctttttttcttttttttttttgagacggagtctcgctctgtcacccaagctggagtgcagtggcacaatcttggatcacttcaacctccacctcgggttcaagggattctcctgcctcagcctcctgagaagctgggattacaggcacccaccaccacaccttgctaatttttgtatttttagtagagatggggtttcaccatgttgaccaggctggtctggaactcctgacctcaggtgatctgcccgcctcggcctcccaaagttctaggattacaggcatgagccaccacacccggccccaacttttttttaattccaagttttttttgagacagggtctcactctgtcacctaggctgggatgtggtggcacaatcagctcactgtgaccttgaactaggctcaagcaatcctcctacctcagcctcctggatagctgggactatgggccatgccatcacacctggctcatttttgttttttttgtttttttagggtttttttttttttttttttttttagagataggatcttgctatgttgcccaggctagtctcaaactcctggactgaagtgatcttcctgcctcagcctccaaaagtgctggattataggcatgaaccaccattcccagccacctaagcatatataacctctttgcagaacaatgaggctcagtttttctgtatcttcattcaacacagcctgtcattcctgattgtatacattctgtttg

SEQ ID NO: 15113 - DNA, 19389 bp, Human
tgcctgtaatcgcagctacttgagaggctgaggtgggagaatcccttgaatccagaaggtggaggttgcagtgagccaggatcgcaccattgcactccagcctgggcaacagagtgagactccatctcaaaaaaaaaaaaaatgtgaggacctgtaagtatcggtggtagcttatgcctgggggccaggctagagggaagggtcgggtgtctaccccatggtccactcagggaggagcatgatgagtgggcaacatggggatgtgctgggctgcctggggaccttcctgtggcccttagaggatagatagtgtggaaacagcctgatctcccagggttgctaattcttagaaacttattgtcacatgggaggggaagaaagaagaggcagattttcagttgccctcttccttggtcctccctggtttagcttctagagagtatggtatgtgcctgtggagaaaaagtgaaggacccgattccagtgccttccccactggacactggggtttcaaagatgaatctgacaattccagtcctcgaggatttcactgtctcataggcagggctgacagaaattcagtaaatttacacaaatttactgaagttccgtggatgccagacactggggatagaacagggatgcacagtgcaggcagggccttgctcacgtggggctgccatgctgggcctgtgagactgaccatgaggaaggaaacctcagagagaggatggaaagaaaagcagaaaagaaatggagagtgattatggggctactttgggctctttgtcaaaaaagaccttgcctaaaaggtgctatttgcccagtcagctgaatgtgaaatcagatgtgggaacatggggtcctatttcaggctgggaactggcagaagaaatggctctcaggcagcaatgaacttgacttttaacataagaagttttctagtaataaataagttaaaactctgggctttcagtatgctccaagcatgtaagttctaagcattttacatgtaattcatttcatcctcacaaaactatgaggtaaatactgttactgccattttcaggtgaggaactgaagcacaggccagttaacttgctcaaaattacagagctagtatgtattggagctgcgattcaaacctggagtccagtgcccttcagtttctccatttttagatgcagtgcattgggttcattcattcactcaaatattgatgtttcctacataccgtcactgttacgggcgcaggtgacaaaacggacgaagtgctgcctttttggcattcacaagcactaagagtaaactaaatacaagaatcgtaagaactaagggaaaaagcgggagagaaggataaggcatggggctggagttgggtgaactgaaaatagaatgaacggagaatgcttcacaggaaaggtgattttttttttttttttttttttttttttgagagagtcacactgtcatcccggctggagtgcagcggcgcgatcttggctcactgcaacctctgcctcctgggttcaagcgattctccggcctcagcctcccgagtagctgggatgctaccacgaccagctaatttttgtatttttagtagagacggggtttcaccatccaggctggtctcgaactcctgacctcaggtgatccacccgcctcgacctcccaaagtgctgggattacaggcgtgagccactatgcccggccctgaaaaggtgacatttgaaaaaaatacaaaagaggtgattgatctcagattctggaacctcaagacccatctccattctgggcgctgcctcacgctgcaccactcaaggcccctgcctagtgctctggcgcctccttcagatccgcgcggccgctgcaaccagaagcggaactgcaaggccggaagctccacgtccgcacccgccccttccgtttcgcttccgcctacctcgcccaggctgccagaccggaagcgctccgctgtacctggatcctgctcctctgggttgaaacccgggcgccgccaagatgccggtgagggttcgatccacggtgtggggagacagcggggattgcgaagagcagagagaaaccgtgtgtgtgccgagagaagcgggcggcggaaggcagagaggaagctggggcccgagaaggagggaggcgaggggaggggaccggttgctgaaggattggggcggcccgggggtgccagtcgtgggaggcgggggcgcggcaggagtgggccaagggtccagggtgtgtgaggaggcccttttctctctccgtctactccttccgactccggcagggttcccaaagcctcactagagagcgaagccaagggctgcgctttttatttttcatatttcaagtccaggggtctagcttctcctttttctgtcaggcccacttcctcctccgccccggggtcaggctccctctgctgtttgtcatttgtcagaacccacttcccggcagcggcggccatcccggagccagctgggtttagggccctcacagactcgttcggcgcctgacttccaaagatttcctttttcgtgtgccatcagagtgggagtaaaaaattatgacggcctggttgtacttaatttctgacagccagtttgtggggtagatttatcaccgtcatggtctccattttgcagattcgggaaaaggtggttcagttattatgtgattgttcacactttttttgttgtttgttttttgagagagtctcgttctgtcgcccaggctggagtgcagtgaggcgatctcggctcactacaacttccaccaccctggttcaagcaattctcgtgcctcagcctcccgggtagctgagattacaggcgcgcgccaccacgcccagctaattttttgcattttagtagagacggggtttcaccatgttggccaggctggtctggaactccagacctcaggtgatccgccccctcggtctcccaaagtgctgggattataagcgtgagccatcgcgcccagcctgctcacacattatttttaacaaacgttaacgagcacctgctgcctgccaggctgtatttacagcagcaaataagttcaacaaatccctaatcttaaagaatgtacattcaaatcgggagtcgagacaataaaagtgtaaacataataaaggagatacatacggtagtgtcaggtagtgacaaatgctataaagaagctagatgggtggtcaggcgcagtggctcacgcctgtaatcccagcactttgggaggcctaggtgggcggatcacgaggtcaggagttcaagaccagcctggccaacatggtgaaaccccatctctactaaaaatacaaaaattagccaggcgtggtggtgcgtgcctgtaatcccagctacttgggaggctgaggcaggagaatcgcttgaacccaggaggcggaggttgcagtgagccgagaccgtgccactgcactcgtctagtgacagagtgagactctgtaccaccaccccccccccccccggaaaaaaagaagctagatgggtaacaagacagttggtgagagggaaggcggaggctgctttagataaagcatacctgtgatgaaaaggagcaagccatagttgcaaatacattttttttttttttgagacagggtgtgaccctgtctctcaggctgcagttcagtgacacaaactcggttcaggtgatcctcccacctcagcctcctgagcagctgggactacaggtgtacgccaccatgcccagctaagtttttgtgtttttagtagagacagagtctcaccatgttgtccaggctgatctcaaacttctgggctcaagcagtcctcctgcctcaccctccctaagtgttgggattacagacatgagccacctcgctcagcctcacaaatgcatattttatgaatcccataattaccatttgactcctgagctctggggtacacactttataaattatcccatctaatcctcataacgaccctatgaagtaggtaccatgattcctgttttacagaagaggaaacggagcctcagagaagttaatttggacaaggttgcctagtaatggtaaaaccaggttttaagccaggactctaggctgggtgcagtggcttatgcctgtaatcccaacactttaggaggccaagatgggaggatcacttgagcccaggagtttgagaccaacctgggcaacataatgagaccctgcctctacaaaaataaaaataaattagctggatgtggtagtgcatgtcctcccagcctctcaagaggctgaggtgggaggatcacctggagccaggagtttgaggctgcagtgagctgtgatcctgccactgtactccagcctaggaaactctgtctccaaaaaaaaaaaaaaaaaaaaaaaggactctaaatccctgtactggttccaatcgcacatagagcaccctggattcactctgttgggttttgtttgtttgtttttttggggggaggggtttgtttgtttgtttgtttttgagacagagtcttgctgtgtcgccaggctggagtgcagtggtgccatctcggctcactgcaacctctgcctcctgggttcaagcgattctcatgcctcagcctcccaagtagctgggaatacaggcatgcactaccacacccagctaattttgatatttttagtagagatggggtttcaccatgttggtcagggtggtctcgatcttctggccttgtgatctgtccgcctcagcctcccaaagtgtttggattacaggcgtgagccaccccgcccatcccatcctgtgattattttctgtctgtcttctctactcttcaaggaccagaatcgtactactttgtatattactatatcacagtgtcttgcacatagaaggtgcttagcaatcatttgatgaatgaatgaatatatgaatgggacccatgttgacttataaaaagccagacatcttgtaaaaagcagaactaagaatcagcatacaaaatgctctcataaatgtgattttttttatcccttcctttaacacacacctacccactgaagggaatatatatcttctcattttacaaatttggaaacaagctaagagaagaagaatgatgtcttggtcaaaagcataacgccatgaagtggcagagctgaaaagatagtgcttgggtcttggtttagctgggggctgggtaccctgatttatatgatgtttgtctttctgtagtggaaatactttggccagataccaatgtgatgtcaccgaacatagaattggaagagatgcacagcagcaccccattatttagtatttcgtaataataaccttaagaacatagacaatagtaaaatgtaatttttaaaaattaggttattgccgggtgcagtggctcacgcctgtaatcccagcactttgggaggccggggcgggtggatcatggggtcaggagttcgagaccagcctgaccaacatggtgaaaccctgtctctactaaaaatacaaaaattagctgggcgtggtggcacgcacctgtaatcccagctacttgggaggctggggcaggagaatcgcttgaacccaggaggcggaggttgcagtgagcagagatcgcgccaccgcactccatcctgggcgacagggcaagactccgtctcaaaaaaaaaaaaaaattaggaagtaggccaagtgcagtgcagtggctcacatctgtaatcccagcactttgggagggcaaggcgggcagatcacctgaggtcgggagttcgagaccagcctggcgaaaatggagaaacatcgtctctaccaaaaatacaaaattagctgggcgtggtggcttatccctataatcccagctactcaggaggctgaggcaggagaatcacttgaacccgggaggcggaggttgcagtgggccaaggtcatgtcattgcactccagcctgggcaacaagagccaaactctgtctcaaaaaaaaaaaaaaaaattaggaagtagccaggtgtggtggctcacacctgtagtcccagccctttgggaggctgaggcaggaggaacacttgagcttaggagtttgagatcatcttaggcaacatggtgagactccttctcaaaaaaaaaaaaagaagtgatgaatacttaagcatcattgtttttaacattatttactttttttttttttttgagacagtcttgctctgttgcccaggctggagtgcagtggcacgatctcggctcactgcagccttcgcctcctgggttcaagtgattctccagcttagcctcccacatgtctgggactacaggcgcacgccgccacgcctggctaattttttatattttagtagagatggggtttcactgtgttgcccaggctggttgcaaactcctgagctcaggcaatctgcctgcctcagcctcccaaagtgctgggattacaggcatgagccaccacgtccagccaacatcatttacttaattgtaagtttatataatttgatttttgagaagagctgtgtttaacaaccagcttgaaaaatgcctcaaaatttaacaattggttttcttgagccagaaagaaccagccctcgcacctcaatgctgctatcccttctccctcccctaattaatcttgggtggtttactctttttttcctttaagggaaggttgtttgccacagtgacatttgctctttttctgcttctgtgttcttcctgggcttgccattacaggcttaccactcttctctcatggatcctgataccaaactcatcggaaacatggcactgttgcctatcagaagtcaattcaaaggacctgcccccagagagagtaagtctaaacccattattttcaaattttggtacgaaatgcctaacaatcttctgaaatgatcaaatcagaaaaattcttagctcagtcttctctctcaaattgcccttgtactttgcttggtagatactgtggtctagacctttcaagatagtggttatatgttgcatttaataggaaattgtattatttcttctgacttctccaggaaactcttttgagaaaatggaggaaatgtgcttaattctggacactgtttatcagttctttcaaacaaatctaatgctgttacgtctagaatgccacatgcccatcctttctgtcatcaacctggaaaagaacaacaacaaatattttaacctcttcctcgtctaaatctacttcctttattcattcttcaagatcttcatttttagcaatacctcaatcttaaatctgaagtgtactatgtaacattacttacgtctattcccgcttttctgaattttatttcagaaagccgcaatatttttcagacactgtctgagactcttctgatgctttctgagatgttctcccaacagtataatttgtattatgttagacatggtttccctgtaccctgcaagggtctgaactgaattccattcatggtttccaagaccattattataattaccaatttggtacttatccagtccccatttctctgccagactgtttgacttgaccttttttaaacttaattttgttttcaacaccatttgaaagctcagtaaacttaatgcatatggtgagtcaccacagtctctacttgattctgaggaaaaggaacaaggaagaagacagcctgggaaagaagaaaaataacataaaagaaaatcacaaggctgggtgcggtggctcacacttgtaatcccagcactttggaaggccaaggcaagtggatcacttaaggtcaggagttcgagaccagcctggcaaacatggcgaaaccccaactctactaaaaatacaaaaattagctaggcatggtggtgggcacctgtgatcccagctactcaggaggctgagacaggagaatcgcttgaacacagagggtggaggttgcagtgagccaagattgcaccactgcactccagcctgggtgacagagtgagacttcatctcaaaaaaaaaaaaaaattttttttcactgcaaaggccaggcgtgatggctcacacctataatcccagcactttgagaggtcgaggtgggtggatcacctgagttcaggagttcaagaccagcgtaaccaacatggagaaaccccatctcaactaaaaatacaaacaatcagccgggcatggtggcgcatgcctgtaatcccaactacttgggagactgaggcaggagaattgcttgaacctgggaggtggaggttgcagtgtgccgagatcatgtcattgcactccagcctaggcaacgagcaaaactctgtttcaaaagaaaaaaaaaaaaaaacctgaattggaatggaggcctgtgctgtgagctaaataacagcattaatcacactaattcatttatattcaacaaatatctgtagaatgccttttatgtgccaagtattcttctaatttcagaatcctttggcctttgccccctcctgtcattgcatttagaagaactagctggtttttggaaacaatattgagtcctccaagacagttttctttcacagataagaaaacagattgcagccaggcatagtggctcacgcctgtaatcccagcactttgggaggctgaggcgggcagattgcctcaggtcaggagtttgagaccagcctggccaacatggtgaaactctgtctctaccaaaaataccaaaattagctagctgtggtggcaggcacctgtagtcccagctacatgggaggctgagacaggagaatcacttgaactcaggaggcggaggttgcactgggcctagattgtgccatggcactccagcctgggcgacaaagtgagacttgatctcgaaaaaataaataaataaaaaatagggcgtggcgcggtggctcacgcctgtaatcccagtactttagcactttgggaggccaagacgggtggatcacgaggtcaggagatcgagaccatcctggctaacacggtgaaaccccatctctactaaaaatacaaaaaattagccaagcgtggtggcgggctcctgtagtcccaggtactcgggaggctgaggcaggagaatggcgtgaacccaggaggcagagcttgcagtgagccaagattgcaccactgcactccagcctgggcaacagagcgagactccatctcaaaaaaaaaaaaagtaaattgcaaggaacacaagtctagagttagagttctgttgaaattcttccacagggcaatgagctgggatgaagacaactgaattgcagagtatgaaagcttcaagattactttgcatttctgctgtgcgagaacgttaacagtcatagacaagaagtataagtaactgtctcagcactgctgaaaccaactgccagatatcaagaccctgggattttgacctttttaaaataagaagaagaaaaacaaaaaattgccaaacaaattgtgtcatgagatctgtctttgtcaagacagtatttctggcttttgtccgtctagagctacctacaacagcttgtacaagtatattttaagtcatagttttcataaaaagaaagatgtgtatctgaacctcaacatgttctaaataattgagtttttttctgaaactataatatgtaaattcaaataaaattatattgaatactttttattttatttaattatatatattttttattattacttttttgagatggagtctcgctctgtcacccaggcttgagtttggtggaatgatctcagctcactgcaacctctgcctcctgggttcaagcaattctcctgcctcagccccctgagtagctgggattacaggcacgtaccaccatgcccggctagtttttgtatttttagtagagacagggtttctccatgttggccaggctggtctcgaactcctgacctcaggcaatccatccgcctcagcctcccaaagtgctgggactacaggcgtgagccactgcgcccgactgaatactttttatttttaggaagcagttaaagttagtctatgtctcagtgtttttttataaatgcattgagagacgtcttgaataatgttcaccaaatgctaatggtagttatttttggggaaatgggaattaaggtgacaattaaaaattttttttttgcctggtgctgtggcttatgcctgtaatcctagctactcaggaggcaggaggatcacttgaggccaggagtttgagaccagcctaggcaacatagtgagactgcatctctaaaaaaaactttttttttttttttggagacagagttttgatctcgttgcccaggctggagtgcaatggtgcaatcttggctcactgcatcctccacccgcgagttcaagcgattctcctgccttagcctcccgaatagctgggattacaggtgcctgccaccatgcttggctaattttttgtatttttagtagaggcgcagtttcaccatgttggccaggctgctctcaaactcctgacctcaggtgatccacccgtctcggcctcccaaagtgttgggattacaggcgtgagtcactgtgcccagccatctttaaaaacttttctttaaaaattttatttaatttttaaagaaaaaaattagccaggcctcatggtgcatgcctgtagtcccggctacctgggaagctgaagcaggaggatcacttgcgctcaggaattcaagtctgtggtgagttataattgtaccactgcactccagcccgggtaacagagcaagacctctctctaaaaaataaaactgttttgattgaatttcattttctaatgagcatgtataagttttacgaaaacaataaagctgtaaaaataaaccatgtactacttttctataaatattttctgaaaatccgggggtggtggctcactcctgtaatcccagcactttgggaggctgaggcaggcagatcacgaggtcaggagttcgagaccagcctgaccaacaaggtgaaaccccatttctactaaaaatacaaaaattagccaggcctggtggtacatgcgtataatcccagctacttgggaggctgaggcaggagaatcgcttgaacccgggaggcagagtgagccgagatcatgccatttcactccagtctgggcgacggagcaagactccgtctcaaaaaaaaaaaatttggccgggcacggtggcttatgcctgtgatcccagcacgttgggaggccgagatgggcggatcacgaggtcaggagatcaagaccatcctggctaacacggtgaaaccccgtctttactaaaaatacaaaaaatatagctgagcatggtggcaggtgcctatagccccagctacttgggaggctgaggcaggagaatgccgtgaacccgggaggcggagcttgcagtgagccaagatcgcgccactgcactccagcctgggcgacagagtgaaactctgtctcaaaaaaaaaaacaaaggctgggcacggtggctcatgcctgtaatcccagcactttgggaggccgagatgggcggatcacgcggtcaggagatcaagaccatcctggctaacatggtgaaaccccatctctactaaaaatacaaaaaattagcggggtgtggtggcaggtgcctgtagccccagctactcaggaggctgaggcaggagaatggcgtgaacccgggaggcagagcttgcagtgagccaagatcacgccactgcactccagcctgggtgacagagcgagactctgtctcaaaaaaaaaacaaataaatattttctaaaaactttgtatttcaataggatcattttattttattcaactccacaactgttgacagttgtatgtgttttccctttatggctttgatagttgttatgttttgtatttggctaatgttctctgtgctccttcccttgtgtcctgcttagcaaaagatacagatattgtggatgaagccatctattacttcaaggccaatgtcttcttcaaaaactatgaaattaaggtaaattacggagcttttaatatttaacttagttttctcatagggataataccaaccttgctatccagattgctgtgaggagaaaataaaatgaaatcagcatgtaatttttaaattcgagagcagtgcttaatgttagcttttgtataaatattagtttctttttttttcctccaaattctataccaggggttggcaaactctaacctgagggccacatttggcccactgcccctttttatgaataaacctttattggaacacagccacaaccatttgtttctatattatctatagttactttcacaccaaaacagcagaattgagtagttgtgacaaagactgtatggcccacaaaacctaaaaatactgcctgccttttacagagaaagtttgccaaccccttgctagaagtatctttatttattcaacattagttaagcagcacctactatgtgccagccttttgttttgttttgagacagggtcttgctccgtcgcccaggctagagtgcagtggcacaatcacagctcactataccgtcaacctcctgggctcagacagtcctcctgcctcagcctcccaggtagctggaactacaggcatgcaccaccacacctggctaattttttgtatttttagtagagacggggtttcacaatgttaggcaggatggtgtctcgatctcctgacctcatgatccgctcacctcagcctctcagtgtgctgggattacaggcgtgagccaccgctcccggccctaaaatggaatttcagcccctccttgccaaactctgaacttctggaatcaaacaggttgtgaattatttatttgtagactcttggtgtacaaattgtagtctaaacattctgtgatggtaatagaatgttttctatatctcatgtgtgggttaagtttgtaacagttataaatgttacaattctctgggcacattgcttgagttcaggagttcgagaccagcctgggcaacatggcgaacccccgtctctacaaaaaatagaaaaattagtgcatggtggctcacgcctgtaatcccaacacttgggaggctgaggcgggtggatcacatgatgccaggagtttgagaccagcctggccaacaaagcgaaaccccatctctaccaaaaatacaaaaattagccaggtgtagtagtgcatgcctgtaatcccagctactcgggaggctgaagcacaagaattgcttgaacccaggaggtgatggttgcagtgagccgagatcacaccactgcacccagcctgggcgacagagcaagactgtctcaaaaaaaaaacaaaaaactctgccacatttcatttgttcccagatactatattgtcttaaaaatagggaaatgtggctgggcgcagtgcctctgcccgtaatttgggaggccaaggcgggcggatcacctgaggtcgggagcttgagaccagcctgaccaacatggggaaaccccgtctctactaaaaatacaaaattaactgggcgtggtggtgcgtgcctgtaatcccagctacttgggaggctgaggcaggagaatcacttgaacccaggaggcagaggttgcggtgagccaatatcacgccattgcactccagcctgggcagcaaaagtgaaacactcaaaaaaaaaaaaatatataggaaaatggtgtggtttgggggtaatttttttgttgtttttttgttttgagacagagtcccgctctgtcaccaggctggagtgcaatggcgtgatctcggctcagtgcaaccctcgactcccgggttcaagtggttctcctgcctcagcctcccaagtagctgggattacaggcacgcgccaccacgccaagctaatttttgtattttttggtagggacagggtttcaccacgttggccaggatggtctcgatctcctgagctcgtgatacacccaccttggacttccaaagtgctgggattacaggtgtgggccaccgcacccggcctttttttttttttttttaattcgagacagagtcttgctctgttgcccaggctgcagtgcagtggtacagtcttgactcattacaacctctgcctcctggcttcaagcgattctgtggccttagcctccctagcagctgggattacaggcgcacgccaccatgactggctaatttttgtatttttagtagagacggtgtttcgccatgttgcccaggctggtctcaaactcctgggctcaagcaatccacccacctcaacctcccaaagtgctgggattacaggcataagccactgcacctggcctaaatttgtgtaaaatttgacccaaagtccataccacatttgatcaacattcatttgtcttctccacattttctttttggttaggtcaagacattgagattatggagttctttgggagcaagtcaaatgtgaaatagttgcttcctcctttagagtaatgactatttctgttctcggcagagaccctgaagggaagggtttttaaaaattagccaaccatatggagcagttcaggctttccaggcagctttgttacttcttcctatacagtgaggggctgttgacacagatccttgggaaccctggggcaaggggagccgagaaaaacaagagagagcagccactcagccgagcgtggtggctcatgcctgtaatcccagcactttgggaggctgaggtggacagatcacttgaggtcaggagttcgagaccaacctggccaacatggtgaaaccccgtctctactaaaaatagaaaaattagccaggcgtggtggcgggcacctgtaatcccagctactcgggaggctgaggcaggagaattgcttgaacctgggaggtggaggttgcagtgagctgagattgtgccactgcactccagcctgggcaacagagcaagactccgtctcaaaaaaaaaaagcagctgcacatctcagagtggggcttgtgccttcctcccaggggcagacggaaaaggagactgaggagactgtgcatttggagaatgggagttttgatgtgatagtggctgtcctaccactgcattcagcagataatcagaagacaaagatggaatgcatacattgcacatcattgttatgttttgataactgtttttaagtcttctttttctccctgtagaatgaagctgataggaccttgatatatataactctctacatttctgaatgtctgaagaaactgcaaaaggtaattaaacttggatgattgtatatcaggaaaacaaattgctgagaggcatttaccctcccagtcatctgggatttgttgagactttaaagacaagtagaaaatatttcctctgacttacagcatggacttaagagaaaaatttgaatttagttacctgaacttgtagtataattgactgacacaaagataaaagtagtggtgttttaaggctttgaatatattttctcaagacagaaatcttgacagaggaattccttttaagcccttgactcaagggttcttaacctggggtccaaggatagaattcttcttttccctgtaaaatatgtgtgtgtgtgtgtgtgtgtgtgtgtgtgtgtgtgtgtgtgtatgtgtgtatatatatatatatttttttttttccagtgcaattccaaaagccaaggtgagaaagaaatgtatacgctgggaatcactaattttcccattcctggagagcctggttttccacttaacgcaatttatgccaaacctgcaaacaaacaggaagatggtaagaacaggtctctatcctcactctgtgacacaagaagattttctccatttgacttcctaccacccctctttttcttgccttgattcatgtacagattgagagtgaaatcataggaagtacattatcttattagtcactctcacaaacgattcttggcaacaaggatgacatgcagaaaatcttttgaacaaaaacaaatatagttataaaactatctggactgtcatttctattttgtatcctgttcaaatgtataaaaatgtattaccacagtgagcatccagagctgcaaccagtacatttgggatgtatttgcaaatacagttttttttaaattgttctgttttagaagtgatgagagcctatttacaacagctaaggcaagagactggactgagactttgtgagaaagttttcgaccctcagaatgataaacccagcaaggtaagaccctcttcttgcctgcttaattggtaaatcaccttttatcccatagccaccattgaacacactaaggtcttccattgcaagaatatttttaatttctgcattgcaatgttgcttaacttccagtatatgtctagtatgtaatatgagttcactgaatcacactaaataatgaattgcaggccgggcgcagtggctcacgcctgtaatcccaccactttgggaggccgaggcgagtggatcacttgcggtcaggagttcgagaccagcctggccaacatggtgaaacccccatctctactgaaaatacaaaaaattagccaggcatgatggtgtgcacctgtcatctcagctactcaggaggctgagacaagagagtcgcttgaacccaggaagtggaggttgcagtgagccaagatcatgccattacactccagcctgaatgacagagtgagactttgtctaaaaagggtttatggccaggcgcggtggctcacgcctctaatcccagcactttgggaggccaaagcaggcggatcatgaggtcaggagattgagaccatcctggctaacatggtgaaaccccgtctctactaaaaaatacaaaaaattagccaggcgtggtggcaggcgcctgtagtcccagctactggggaggctaaggcaggagaatggcatgaacccaggaggcggagcttgcagtgagccaagatcacaccactgcactccagcactccagcctgggcgacagagcgagactccgtctcaaaaaaaaaaaaaaaaagtttataagagattccagactaatgtgaaattttattattaaataaatgcaaattctattgtaatttgaccccgctgttcattctgtgttgttctctcttgttagtggtggacttgctttgtgaagagacagttcatgaacaagagtctttcaggacctggacagtgaagggagcccgggcagccaccgtctccagagccctgggcagcattttccagcaagatgtacacaatcttttgcctttatttcgtaaagttttatacagaagagagaagagcatgtctttacttgaaaaactcttgatcaagaatttgggtgggagaaaagaaagtgggttatcaagggtgatttgaaattttctgcagcattaaagctggcgcttaataagaataagtaataataaagaaatttctaacattccatgtcagaaaaactttattgccagtctttgacattcacttacaatttgttttgagataaaattcacattccataatgcccttttaaagtgtacaattcactttttttagtatatacatgaagttttacaaccatccccagtaaatccagagcattttcatcaccccggtgtagtgaacctgcactctttagcagccaccccaccccacattcctccccaagccccctgtccctcccacccctcctcccagtattaatctactttctgtctctatggatttgcttattctggataattcatgtaaattgaattttttatacaacatgtggccttttatgtctagcttctttgacttaatgttttctaattcatccatgttagagcatatatcagtgctttcttttctctttttcttttttttctctctgtgtatatgtatgaaataaaatatactaatatggccaggcgcagtggatcacgcctgtaatcccagcactttgggaggcccaggcgggcagatcacctgaggtcgggagtttgagactagcctgactaacacggagaaacctggtctctactaaaaatacaaaaaccagccgggccgggtgcgatggctcacgcctgtaatcccagcaatttgggaggcccaggcaggcggctcacctgaggtcaggagtttgagaccagcctgaccaatatgatgaaacaatgtctctactaaaaatacaaaaattagccgggcatggtggcacgcgcccgtaatcccagctattcgggaggctgacacagaagaatcgcttgaacctgagaggcagaggttgcagtgagccgagatcgcaccattgcactccagcttgggcaacaagagcgaaactccatctcaaaaaaaaaaaaaaaaaaaaaaaaaactcagctgggcgtggtggcgcatgcctgtaatcccagctactcgggaggctgaggcaggagaatcgcttaaacctgggaggcagaggttacggtgagccgaaggttgcggtaggctgagatcgcgccattacactccagcctgggcaacgagtgaaacttcgtctcaaaaaaaaaaaacggccagacgcggtagctcacgcctgtaatcccaacactttgggaggccaaggcgggcggatcataaggtcaggagaatcgagaccatcctggctaacacagtgaaacctccgtctctactaaaaaaatacaaaaaattagccaggcgtggtggcgagcgcctgtagtgccagctactcaggaggctgtggaaggggaatggcgtgaacctgggaggcggagcttgcagtgagtggagattgcaccactgcactccagcctgggcaagagagtgagactccatctccaaaaaaaaaaaaaaaaacctagagtttatggtagtacttgaatgattagagtatttgcattttgtttttacgggtgaatatatgattttaatatgtgggttaaatgctcttgagcatctgtttaaagacttgaattacaagctagctaaataccacagttcacacagcaaaaggaatggatatgtgaaaacctactccatagataaacagaaggacagtcctgaagccaaaagagtggtggtggtgtgtcgtggggggttttgtttgtttaattaaaatttgtttgtttgtttgtttttgaaacagggtatcactgttgcccaggctggagtgcagtggcatgaacacggcccactgcagcctcgacctcttgggctcaaacaatcttctcgccttagcctccccagtagctgggactacaggcacacatctccaggcccagctaattttgtatttttggtagagatggggtatcatgtttttttgtgttttttgttttggtttggtttgttttttgctttttttttttttttttgagactgagtctctctctgtctcccaggctggagtgcagtggtgcaatcttggctcactggaacctctgccttccaggttcaagctat

SEQ ID NO: 15114 - DNA, 8546 bp, Human
  misc_feature (1)...(8546): n = A,T,C or G
acacacttcgaaggaaatctaattaaaaggcaaggaataatccaggtgatggatgaatcttctgtccccagaaccctaaatattaccctctttgtttcttttttattccaaagtcagatatcctcaaaggaacagcaaaaagagggactttaggatatcttcaatggtgtaaagaaaagaaatatatgaaagttcccgggagaaagagactaaaataaaagcactgggcacatggattacataaaacagaaaaggggttgtaagtatgtgattatgactagaaacacaaaacaatcgacttcattttttatttaattttaatcacaaattattaaccttgcaaagttttaaacattaaagatctaatctgcctcgatcctactgtgtccctaggattgacactttggtgtgtagctttccaaaacttttctgtggacctacaaacatatttgtcagtagaaatatgcactatcaggaaggagatatttcttgaacgcctttccatgacagtacatagagatttctcccattcgttctaacattttaacagtcttcctaaagaagcgacttctgaaagtattatttaaaaacaaacaaacaaaaaaaaacaactcctgttccccaaacctcaagtggtgagggggcgggggaaaaatgctcaagtcgaggaatacaggagcaaacttacgctttcaaggaggtgtatgggactgaggcctaaaggcttcgttagagaagtcatcgtggataaaacatccaccctcacacgccattacaggcaccgactccccttcctcacaaccccaaatcgaagacctccctcttttggagagccgattggacgactggtcccagcgctttccttaggctgtccgtctactggttccagattcgttccatccgtttaaccgcccgatcccgcattccccattggagtcaaaccgctgcctcctggagaagcccaacctaccgcgcgcttcctgctcactggctcagtgagacgctgctcagaaggggaaaacccgtctcccacattccgatggcccaagggccgatcagtcggcagctcaaggcagacccaattggcctatacacaagccagtcaaagtcttcggctgcacagctccaaagaacctacggggattaaaacatcccgccccctgttcttctattggttggcccgacccaccgctgccccttcactatccccccaccccgccgtccattcatttcacacaataacgggcccaaatggagtcagttcaagacctactatgggtagataagactgtctgccacttacccgggattgagagtgatcactcacgctaacgtctgccctgttcctgtatggtgaggccgcaccacaagccaccaccgccgccgccttctgcgcaacgccaaccgcccgccaaaacggatccttccctgcgcctgcgcaaccaatcctgggaccggaccttttttctccgcccactacgcatgcgcaaagctaggacaaactcccgccaacacgcaggcgccgtaggttcactgcctactcctgcccgccatttcacgtgttctcagaggcaggtggaacttcttaatgcgcctgcgcaaaactcgccattttactacacgtgcggtcaacaagagttcattgcaaaaaaattgttacctcctggctgcttgtctaatacatagtgttaatcatgctttgccaagcgacttgactgtaatatttgcgcgtggaagattaaaaagatgttaaacacccaaggtagattcaaatgtgaatgattggtcggttggccaatcagactggttaacaataacattactcgggaaccaatggactccaaggggtggagacggcgtagaaacgaccgaaggaatgacgttacacagcaatgtggcaccacaggccaatagcagggggaagcgatttcaagtatccaatcagagctgttccagggcggagtctaccaatgccgaaagcgaggaggcggggtaaaaaagagagggcgaaggtaggctggcagatacgttcgtcagcttgctcctttctgcccgtggacgccgccgaagaagcatcgttaaagtctctcttcaccctgccgtcatgtctaagtcagaggtgagttaggcgcgctttcccacttgaattttttcctctccctttcctgaatcggtaagatgctgctgggtttcgttccttgcaccagcccattctacagttccttcggtcgctgccacggcctacccctcccaaagttcaagtcgccattttgtcctcttgatcgccatgaggccgctctccgccaaccatgagttatcatgcgggactcgttactcgtagcaaaattcttaggcacacaggatctttgtctttttttaaaccttgccttggtgagcgagttttctaaagagcgattagtcccattgtggagatgcacccctaccgcccaagcctttgttgcgcgtgcgtcggaaggcgactagggacgcatgcgcttgcgatttcctagcactcccaactccagcatacggcctcccttgataggcagaagcacgtgtcttgttgcgacctgaacgaacaataagtgctaggtacacagttggtgtctagtttttcttttcctcgatggaaattgtttcgtgttgtagcccatttaacacttccccctccccccactctagtctcctaaagagcccgaacagctgaggaagctcttcattggagggttgagctttgaaacaactgatgagagcctgaggagccattttgagcaatggggaacgctcacggactgtgtggtaagatttggaagggacaaagcagtaaaacagccgatttccttggcttatcttggtgcagtcttctccgaatgcttatgaaagtagttaatagcattatagttagagctttgttggcaaaggaacgtcctgctttgattttaaaagctacctcttaaatctagggtagtgggaaactggacgactttttataaaaggctggtgtaaagtttcctattgccctattcaaagttaaaatgacaaaagcttttgcggtcagactttgtgttacataaattaacactgttctcaggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagtgagtgggttttttttcttcttcttcttaaacttacttggatatgtgctgctatggacttaagattcgggagttttctaaacttaccaaaattttttattcgagtataggctttgctaatctaaacctatggtttttctcctattaggattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcagtaagtatcagatagtggcatttagtaagggttccacaatctgtatggcattctaaaccctgataccatgttgtatctatgttttttttttagttcagaaataccatactgtgaatggccacaactgtgaagttagaaaagccctgtcaaagcaagagatggctagtgcttcatccagccaaagaggtatgcttgttgcttaattaaaccttaaaggtaactttgagttactccagtatgaatgatttaatgcttaaacttcatgtcttaaggtcgaagtggttctggaaactttggtggtggtcgtggaggtggtttcggtgggaatgacaacttcggtcgtggaggaaacttcagtggtcgtggtatgtatggtttatctacatgtagttctgacttctcaccatctttgctatgaagattttacagtacgggaactgcattcagaatgtcactttaagtccaagtcatacttaaaacttgaaactttttcttacaggtggctttggtggcagccgtggtggtggtggatatggtggcagtggggatggctataatggatttggtaatgatggtaagttttttaggaataagtagagaaaaattcctggcaacctggatctttagaataggttagtagagactaaaattctggtgcatgtcaaactcaactttgcccataacacgcatgctgtgagcaggccttcagccgttacacttgcacaagttttcattgtcaaatacttttgtcttattgagaagaattgtattcttgtaggtggttatggaggaggcggccctggttactctggaggaagcagaggctatggaagtggtggacagggttatggaaaccagggcagtggctatggcgggagtggcagctatgacagctataacaacggaggcggaggcggctttggcggtggtagtggtaggtatccagtgatccaagtacttggtgtgacagctagattagccttttagagcttgggttctggtgctgttgaagcattgtgtggtacactgcatggtatattaaaaacaaatgggcttgctatgctacctcctcctagctttaagctggggccgcctcactcccaaatagtagagataagtggatagtgttgtctttgagttagattagtatcatagaaggatttagtattttaactcctttgggaccttaggcgcttagttgatgtatccaagatacttctgcttgctgtggccctggatccgtgaaggccttcaaggctgaagggtatgcttgtgccactctgaaaatctctttattttatgtcatggtgagttaggccagttttctttgtattactggattattcaactgaatgcctttcccagagaatgaaatgcaaagattggagtcaccatagtttgggagaaaggaaggctgataactcaaccttattttattctgactgctaaacagaattggaaactaacatcatcctcaggtaacagataaaggccctctttcccattcataggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtatggtatctatgtaattttggataatgtcaaaagagtgtctgtagctactgctgggaagaaagccctttaactgctatgtctgggcagcaaaacgtttatagtttagaaccttcagaaagtgataatttgatcacaaattagaaaaatcatgggacctctttaccacctcccttgtagtagggccatttttaaatggccagacacttgaatttaacttttattatcccaaatatgaaaacattactgttggcactttgaaactttaaaagaaaaattgtacttttcaggtggctatggcggttccagcagcagcagtagctatggcagtggcagaagattttaattaggtaagtaagcacctttttgtgtgttgacataattttttaaattgctgatgaacccaataaccctaatgtagctgagcagtgcaacatagttaacattataattgcagtaattgtggatataaagttaatattcagatcagcaaaatttgtgggaaacaaacttgatattggattgtagccttgagtcttaatatgtttagattaacaactttattccatattgttcaacaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgttcatccattatcatgtgtaatcaataaacgatttaattctcttgaatgaaatgacaactgtatggatttgggactggcagagatttggactttccctacccactccccctgataataatgttgaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15115 - DNA, 42395 bp, Human
ctgctgcagataggactttctctcccattctttacttttttattagccaatcaaagtggcttccgaaagccatttgtgatttgtgaaaaatagtatctttcaaaatgctgagttgaagcatctcgctcattgctccttgaatttattattctaatctcaaccgtagagctggaataatgcagctattaagttggggggcaaattcgtttctctggattaaattttttttcctccccactccctcattgcatcagccaaggaaggtgcggacctgcaagagatctgggggtgggtgagagaggtagtgagcgtcctgaagggctccttgagggacccttggataggcgagtggtttggtctccccagtcttatcttccccagataagatgccctaatgactgcctgctggctgggaaagttaccccgcccaattagggagaattcaggacaggttgtgccacagtctagaagtaaaatttccggtgagctgcccgcagcgccgtcccattctccccgctgcccattgtgaaaagctgggccagcgcttccttgtcgtaatttttaactacctgttataaaatttatgggtgggtttgtgaaaagaaacgaggtccctgcatccggcctagggaactgcttttcttactatggaggaagtctggggaaggcatgaggtatcccctcttggtcagggttgaggcacccaaccattgagattcccatgccagcttgatgcgggaccaagtggagagatgccggccttcaaatctcgagcccgtggggagagtgacctgcctgcaacccctcccccggcaaatagtctctatgggggaatttattctggactcaccttcaaaattaggggtctggaaaaacaggctgctcgaaattttagcacagaaggtggaattcagggcagtaaaaggttattttttcaggcctcggtagtacatcccagctgcccagacattgaatcaggaaatttttctgagaaaggcaggtgggtatgggcaatctgacacgatccaaaaggcttactgccttgcacccctccccgcaaaaaggaagtagagaccaagatcttgggctttaattttatttttaattgtaaaaagatttcaaataagccaccatttgaactgggaagggaaactagggatggtcttgggggaaaatgtcattctctctaagaaagggaccccggggatgtgggtcgttttgagggtcctagaagttgaccccaattctcacctctcctgctgcactgcaggattgcccagggtaggtctagtcccctaggttcttcagaccactccaggtcaggtttggttgggtggctgccagtggtcttccactactgttcctgtctagggtggagtaggagctttcaggggtacggcatagaggggatgttgttctcttactaaaaaaaaaaaaaaaaaaaaaaggtaggggtagggaggcaccctttcaatccctgcaattcaccagccatcactgcctcaaggccacaaatctttgcaaagctttgaattccgcctgatccaaccttaatgcccccatttattaaggacaatatttaaaactcggcaagccaggagaggcaaccgaccctcagtgcttgaagctttctttcgcctgggcgtccgccctcagctctttctgcgctcgcctgcagcagcctggcccgtggggagtgggcggtgggtgggggtaggggtggggtgggggtccggggatgctccctctatgagagaattgggtaaacatggcgaccgcggcgcccatttgcacacgctacacaaatgcatcgcattcccggttgtttgcagaaaatttacagctgagtaataaaagtttacgatcgactcacaagttggattggccacaagaagtcatgtggattccatccatgaacgtgaactttttattgtggtttgtccgttccgagcgctccgcagaacagtcctccctgtaagagcctaaccattgccagggaaacctgccctgggcgctcccttcattagcagtattttttttaaattaatctgattaataattatttttcccccatttaattttttttcctcccaggtggagttgccgaagctgggggcagctggggagggtggggatgggaggggagagacagaagttgagggcatctctctcttccttcccgaccctctggcccccaaggggcaggaggaatgcaggagcaggagttgagcttgggagctgcagatgcctccgcccctcctctctcccaggctcttcctcctgcccccttcttgcaactctccttaattttgtttggcttttggatgattataattatttttatttttgaatttatataaagtatatgtgtgtgtgtgtggagctgagacaggctcggcagcggcacagaatgagggaagacgagaaagagagtgggagagagagaggcagagagggagagagggagagtgacagcagcgctcggtaagtgtttccttattggttcaaatatgtaactaatggtccgtggcggtttcaagaataggacagcagcggcttctcttggttagggagaagagggggctggcgagagggtgggcgcgtagttaattatggggaggaaaattggcggggggagagaaacggggttaaactggaataccggtaactggtagtggggcgattgtgttgtcctgatgtcactgtgtgccaagttgggggtggggaggcaagggaacagcacctgtggggctcaagccggcggtctagggcgccagctctctgctgcccactgtgtcagtacctgcttattatagatcttcggtctcttggctaatggaactgggtcggagcggaactggaagctcaagctccaggcaggagagagaacttagaggctgtgcccattgccccctaagcaaagttagccccccaacccccaaacaaactttccagcttcccctccctgtctggcagccccctccctcccagagagcgcgactgctagagctcacacatgcgcagtgtgggcccagggccgggccgccgagcaggaagccggcgcagctaggcggccggcggggcctgttaattggcaattaggggggaggctggtggctggtgcgcgtcagccgagaggagagcgtctgcccaccccctgctcccgcccccactcgggcggatggaagggtgggaggtgccctgcgttgggtggagggtggaggttgtagggtgggggtgggggatgctgtactcaaaagccatcttgtgctcagagaaaagaggcctaccggctttcccttccggggtccggcgcccctcacccccagccgcggccatcccagccgggatgcccactggaccgggatgcccgctcgccacgcatggctgctctgggctaggacctgcctcgcctcggggggaggtggaaatggggaaggccctaggctgggcggggacaggcccagtcctcctggtagagtctcctaggtgctgtggaggcagtgaggattccgggggctgctggcttatggggtagaggcgtcagcctggggcggcgggagggtcctgggcactcgggatctctctaataattggtgctaatggcctgttgtatagtcttaacccgacgcatatggtttcataacacagtggcttaatttcttccaaatgtacgtggccctgaatgtgttgcagtttgatatatgaccccgccctgctccccggcctgggtccgaggctccgaggcggccccataagtgtgaatttctgtttataaacggcgacgcacacgcaaacgcctacacacccaggcagacacacccggaggcgtgggggaacatattccagacgaggtccgagagaacctgggggccagacttaccttaatctaagccaagacaccccctctacccccaccctctcccagaggcgcgactgggattctgcgccaagtcccagtgggggaggggatcgctccacgatttcctgtttaaaccctgacccgtcgcctgtgggggggcggggatgggggaagaaacctgtttttatcaaatttttaaaaatacagtttgcattcagatcaaaccgtttgggccagagctgacggtgaattttatctcccctccccccacaacccccttcccttccttttctgcccccgctaaattcccctttcgcagccatcataaaggcctctgaggtattctcccgcgggaagaaatggcattttctctccccctcccccacccccccacccccagtaggacttgtgtgtcggcagaggcgtctgacgaggggctaatttcgctttccttgtttacgatcgagaaaagcgcttggctctccccaaatgggcccagcccgccgcctgctcaggctgccgcgcgctctcccgccgctcaggcacggcccagtggctgatgccccgcggatccagcctgcggcaggccggaacccggagtctgtgggacctgaaaagggcaaagggagtgcggtgggacacaagaggggcccgagaggcccgaaaaagggagcctttctcctggagtaatgtgggaatcgccgaccggtgaggcctctatttctctctttcgcctgcattttgtccgcccccgcccctgtggatggccgctgatgggggggaacacaagtgtcctttgtccgtccccgaaagaaaaccttttccagagaaggccattcaggccagtggagattcacctagaatattagaagggccccctcccacccgaggggcgggcctgggcgaggctgaggtatttctcttaatcctagaacgacctcactgagtgtacccacagcgagatttggaggtgctagagttcgaggttggccgcttaacagcaccatcctgaggtgtctttatataatattttaattgattttctgtcccttcctggctacagccctgcagctcccccacccccatcctatgcccttcacccctagacccatccttacaagacagaggcaagcagagaaggcatagcagcagcgaccggcgctctgttttcattttccactctggccaggggataaactggaccccagtggactccaacaccaactctctgcttcccagttactttcgattttctttcccttctccttctttctctccctctctggcattcaaacagaagcacaagaggacccaccagtggcaactctaagcctccttgcaggccacattccctgctgacgtggtccttcctgcaggagagcccttctgtgattatctaataatagccagggtggctgagaatagaatctggctcaaggactctgcacacccggggcagagacactgaatctgtgggtcagggcctggcaacattccttggagcctccccctctgagcccactctttgggcacccttaggcttgcctgccccccttataaggggctttgtcagccctgccatccgctgtatttcatgtgctggttcctagctaaggagaattgggcagagcaaaccctttctcaccctggtctgacagttgtgatcccgacagaatgcgaccttgtttggagaaggcgaccttgttgggttggctgtgttctgaaaccaggcttgggagtgttatatatttattatatacaggcttaaatatacagactcaggcttatgcatgaatatatacagactcatatttccttggtggttaattgtatattaccatgcctatattcgctcaaacaccattttatgttcatgcaaaattttgttagtcctcactagatgagagtgggctcatggaggcaccgggtgcactgagcaggccctctgtgcatgctctgctggaaatatgtgctcactggaatcggagtatgcgggttccagtaaccaatggatgccataaaggctttctcagaccttattgcttttgttgcccaagcagctggactggggaaatactaaatcccttctgctttctctccacacctcctggcaaactctcccaacttagaaattattttacaagggagaccagttgtcttgaaattgagttctgcgggattcttttcacgggcatggtggggctgcaagcagttcggagtagtcagggccctggcgctggaagcctcactggagcgatgaagggatcagagtggttaataaggtggcctctggacagtgatctggggcagctgctggccagggtgcttggagaagcttgtggaaaaggcaagccaaaaggggtagggatgcagtgaatatctgtttctccccctgcttgccccagccggccgctcaccccgccccagcccgatttgcctgcatccgtggcggcagattgggagttctctaaggtcccccaaatacccagatctggttactggatgaactgcgttttaatcctcgtcgctatctgagccaggacaagacctggtcagggagacggctggtccgggcagcacgggagaggacgctggacccgctgcctgtggcctggagcactgagtatgggctaccaaggctgagaattgatgggcctcctttcccagcctttttcccttccagagacacaaaaagacagagcagaggggaaatatcaatgtcagtggaaaaccccataaaagaaagcagggaccagagcggggctggaggggttttccgctactctctctaggtgatcgggttcctcccaagactcttgtccagacaggctgcaccaagaggtgtgcagctttcttccaccttcctcccgcccttcaaggagggcagccttaggctttctgggccttggtcaccccaggcactggggtgacattactccaggattgtgcccctcgcccagcccacggcctctgccacggcgccgcagccgctcctgtttattgtgtctgtgagttgtttacttgttttgtctgctgccaccctgcgtcagaaacccgccaaaccagcgaactcgcccaggagaacaaagtgctgtgctatccccggactccctcccctttccagcaaccccctcctgccctcacaagctcctgcattctccctttcggaggggaggaagcagaaatagtcttaaaacagggcagctgtttatagggtcaggggaattatggggacaccataaacctctgggtgtccctgtggtggacagacttctgagcagcccttcccttgcctaggcttttcttccttcccctggtgaccacttggttaagggggccacactcattgagaaagttgagcccacccccatcaacccagtcccccactaccccactcctttctgcaggagtttccctgagacacaggttgttgggttttaaatcagggtaatgttggtggattcataaagctagatatagcatgtcattcttctcccacactccctctcctcagccccccaaaattgcagtgaatttaagcaaatcctacaaaattaaattgcccctttgctaaagatcctatatgtctccaatcctgccaggtgtagagtcagatagttggcttttggcctttaattttgctgctagctattaaatttaaaagagtatcattgaagtaagtaatattctcatttctgaaattaattttcccctcccagtctctctctctctctttttgccagcacagattaaatggttctttcagatctgcaaacaataaaggataaaattatttatagggaaatgaggatgctgttttattgttggcatattgttccagaacataacaacattttattttcaagcaggagaggttagaccagggggagaaagagggggaaaggaaaaaacatgaaaggagggcaggaacccacacacaaaactcctgccatgtataactggtaggacatttacaatttctatatgacaactcactgtgatgtcataataccgagttcttgaattttataattctcatgaacctctcaaatgggtccaagcagtgcttcatgtggaggggtatagaagaagccaggaggctggggatcctttgacccagtgcagagcagcacaccccctattgcggcttcttcctcatgtgacatcctcttgaggccctattctgggggctgaaaatattctggatattctgcattttaatttttctcctgggccaagcagggccacttgctttgcccccctcaagtgtccctaggcatctaagctctctccccattcccagatcacagagagctgtgtccccaggctctccccaagccccctcctcagctaatactcagctgcttggaatagaggtgggaggcttgggcaccagcccccaaaaagccagaaatgattttttccagatggagctggaagggggctcagggctgagcgtgatggggtagagatgtttgggacctattttacgttttaaccttaagtcagagaagtgaattgagaagccaaacaaatgccaatgtgagagtttgtatctgctgatggtagcagcaataagtgaagtgctggtaaggaaaggtcaggcagaaatctggaaagagagagggaggagaggaaatgtgacatgagttagcagagcccttccatatacctttcttctccgtttaattgtaataaagcaaaagcagctcgggtagcctctcaacctcttagctcaaaagaggaatcaccagcgcaggccttggaggtgtttgggggcagttctcagcagcttaacatgcccaatctgccctcttcctcctttccccctccctgctgatccccagctcccttcaactggtcagcccgggccctgtccccaaaatattagcacccccaaatgatatccatttctgtgttaggtgtgtcaaatttcacttctctccatgcctaaactttgaaaggaggagtgtacctttttggaatgcggtgtgtgtagcgggggcaggtatgtgctcagacagcttcccccatcatatctatgggaaactggaagccccttaggtgagccatgctttggtgttcccaaacagcattccctgcattcaggttctctggcagaccaggaggctctttgcgatctgatcctttgactaggagttccatggagatcaaaggagcttatttatacacaaaacaccaggcatttggagtagaatttattttttaatttctaaataaaaaagtctaatcatagaccaatcgggccaactgagcagtcgctccagaacagcaaagccttaaccaaatagtgtgattatgaggggagctgagcaattactgaaactcggctttctccgtaagagggattttagccctcgcccagtggcacaaaaggggccagcggggcaaccgttcttctcttgctcagaaaagtgagacttgggggtggtgggggcagggtcgggcagctgcggtcgcgtccaggcagctgagcacccaggccaggcgctgaggctgagcactgagtcctgaggctccagtgcttgggtccccgagcagcctcaggaggcaccgagctgtagttgcagcgcggcagtcaggaatggagtatgtgtatctgtgtgcgagggttggtgagttacaaacatccgcgcagagttaggggatctggggagagagaggagacagggagaacacaactaaggaggacctctggaaaatattgtccccaaataaaaattccagatctcatccctctcacttcaaatatccctccccaggaaattaatatatttcccagagctgagtggaaagcaaaggccagcaaggtgaggcctgcccacgaacttcttcaggctgggtccagtcccacccaccctttccccagttcagagctcacatgcccccagcctttccctggcctaaaggggagtaaggctggagtggtagcatttaacttgcctagggaaatccccaagtgcccaggctgcaatgccacccttatccttggggactccaggccagtgactgcaccccactcaggtccaaggcgcaggcagtaaatttctctcctataattagcgctatcaaaagcatgtgttttgcattggagaggactggagaagcaagtggcaatttttcccttgtattctttttctgtgttttttgaattctgtttttgaatccactaattaaagcttctctgaaagtgaaaatctgctcttgacaccaagccccttccgaatgcctgatttgggaggctaaggggccagagcagtagcaaggagacctgcaagcctgatggggttggggggtagtgttctctgatttctttaggctcgttttatagaaacaaagaacaagttctctcccctccttcccaagacttgtgcatatttacagagcacaactgcagttttaataaaacatctgttcttgcttctgctgatgagtttccataattgttttcagacaaatttaacaggaaaatataaatatatttagaaaaatctaagtcccagctttccccctatagacagccattcttttgccaaaaaaataaaattaacatgaaatgggaaaaagaaaatataatccaatgtagggaagatcgggctcatctgacctgctctccccccttggagcgaatcctttcagcaaatttcagctgcataattaaagatctaagagaaagaagagggcttcttctttcctcaggaatgaaaggtaattggggggggggggggtgttgaaaattaattttgccaaaggtctttaagcagtggaggaatttatttgtatttctgtttccccttctctcccccttccagcatttctgcctttttcacccagcagctggtttctgttcattataaatcggcgagacctttcagtctctgccctctgtttagggacgtcataaaacacttaactttctggggctgaggctcacattctgcctctcaggtcgccaacctccctgagcccaccgactttaggccccaatagagaatctccccaactttggggcccctttcctctccagacatggttgaggaggggctcaaggaaacctaggcatccttgctgggggctgtagtccatgctgccccagaagccccttctttcttccaaggtccttccctcccccacccagacataaaagagatttttaaatacatagaaaatcaacactcattgaaagtgaaacctcattaagacatcctatcttccatcattcaatttgttgtacattgcaacaatttaatatcttgaaggaaatatcactgacatgatttatccctctagcaatctctctctgaaattggagggggggacagagttactctctcttccggcctcttctacttgttacaccactacccttagggcagaaaggaggctgggaactctgagagaggctacttgtgtccaggggtgcactgacttgttccctagctcagtccccagagtactcctgccttgttgtctctcccccacctcttgccctccagggggcctgaagcctcagccagctgttggaaacctctgctcaggcatgccatgaattcgaggacagctggattctagggcaaaaagcaactcacattggtgtctatgtttgtgtacctgccaagtcaccccaaaaatgagataactcatctaaaattttttttcttaatttaaaaatcctcctctaccctttccccttcatttccttggggagaagaaagtgtgatctagaaggaggaacctttataattataggagtctttccccttcccttccaaataccgacaaatttctgtcctttctggaggattggggctgtattttctaaaaccaacacaaattgtctggcaggaagactcttcaaccccctaacgaggttcatgtattaactaacatgttgtctccaccagctcctgcacactgtctgcttttgggttcgaaactttatttttcccccctagcgacactccagggaaaccttaacgttacagaagatgaataaacgagttttttctcagcatagtcccgtttatggctttattgctacccattgattactccgctttgttacacagaaggaaaagatcataaaatccggcgacatccgggttcttgttatagccagctttccccccccccaacccacccaaaaatggtggggggggggggatatgagctttctctgctccccgcacactccccaccacccttctttgtcaactcaaggcattttcagcctatatcacgatatcaaattaagtttggactaatcaggagaaaacccccatctgcacactttccgctgtttcagttcgcctactgcggctccctcacaagcctcggattcagctgccttttcgtaaccgtctcttccctttttttagccccaagatgggggaataaaatgggcgttgaggttgctgagaggcccatccccaccacgggtgactggcacttgggtgagagctccttagaacccctttctgaagtctccaagcctcatagctcaggtccaggggcgcctccactggcggtgccctgagtctggagggggcaggggggcttctgaccaaggcaggggcttgagcctgcaggaagctaactgtccatcagagccccaccagccttctctttctggctggatcctatgtgaattaccccacaggccctcactggctccaaataataaattctcaccaacataaacaggagttgatgtctctagaaagattctcagagttttcgttcttcctctctctctctttctctctgtctttccccctccggtgccacctccctacattttacttctttttctcctttttctattgcattttttatacattttcccttttaggcaaaaatgctggaagagttttcccaacagaggggtcctgagaaggaggcagaagggagccaggaggcaaaggagagcagatgcgtggcccatttgcccactccagctctgccactgtaccctgaagtcttgcccctttagacctagttgttccccacatccctactacattcaagactctcagccacactctacttactcaggggaacaggttttatgaaatttctttctacttttgatttttttttaattattggtgaaaaaaatactagtttagtgatgggactcactccatggagtgtcaaaacaggatttcctgcaggatttctagggacccccctcctgtgctgggagggagttcttcccttggagaaatcaggatgtaattttagaagggggcagatataaaacatgaaaccagattgaaaatacaggggtttctctagccctggctctggccacagcacagcaaagttagctggggctgagagatttcctggtagtacagctctccttccctgagtcccaaggccctgctcagggacatgcacccctccttcaccaccaaaccagttcccttacatatatatatatatatatatattttttaaaagaaatccaagtcttactttcaaagcacacacttagtctcaactagggaatcaacagaagcagaagcgatttttttcccccttcctgacatctggcttgcgattggctgggagggggtcagctgactttgtcattttgtctgtcctggattggagccgtccctataaccatctagttccgagtacaaactggagacagaaataaatattaaagaaatcatagaccgaccaggtaaaggcaaagggatgaattcctacttcactaacccttccttatcctgccacctcgccgggggccaggacgtcctccccaacgtcgccctcaattccaccgcctatgatccagtgaggcatttctcgacctatggagcggccgttgcccagaaccggatctactcgactcccttttattcgccacaggagaatgtcgtgttcagttccagccgggggccgtatgactatggatctaattccttttaccaggagaaagacatgctctcaaactgcagacaaaacaccttaggacataacacacagacctcaatcgctcaggattttagttctgagcagggcaggactgcgccccaggaccagaaagccagtatccagatttacccctggatgcagcgaatgaattcgcacagtggtgagttttacagctccgagatataaattaaataaactgaactggctttatgaccggcttccctagaagaacgggcggagagagttttttatggccccataaaaacaatcacgctcgtctcctcaccgagacagggccccctcttctgccccctcagctcgcctctcgctcgcttgcaggggcctggcccccttggcccctgacggattggagggccccaaggcgggctgagggggcaggaacagggcaggggatgaggggagggagcagaagataggggagccccccaaagtggagtcagtctgaggagaagggagggggagaggagaggcagataagtggggagaagtttccaaggaactaggatgcttggggagatgggggagcccagtccttgagaaagggggccctcatccccattatctgggatttttcaaaaatctgcttttagacttgcagctttctgtttgccttttgccccgcccccccgcccccccccccaccacacacctttctttgggacacacaggtcccaccttataggaggtctgaagttggggtcctcgctgtacccccagtgggggtggggcaaggcaaaagggagaaggctagagccctaaggaggctgtgagctgctggccaggttgggagggtcaggactttgctaggcgaaacagtctgcagaggacgctttgctgattgcttttagtgtgttttgtgcccggatctttaggggtcggctacggagcggaccggaggcgcggccgccagatctactcgcggtaccagaccctggaactggagaaggaatttcacttcaatcgctacctaacgcggcgccggcgcatcgagatcgccaacgcgctttgcctgaccgagcgacagatcaaaatctggttccagaaccgccggatgaagtggaaaaaagaatctaatctcacatccactctctcggggggcggcggaggggccaccgccgacagcctgggcggaaaagaggaaaagcgggaagagacagaagaggagaagcagaaagagtgaccaggactgtccctgccacccctctctccctttctccctcgctccccaccaactctcccctaatcacacactctgtatttatcactggcacaattgatgtgttttgattccctaaaacaaaattagggagtcaaacgtggacctgaaagtcagctctggaccccctccctcaccgcacaactctctttcaccacgcgcctcctcctcctcgctcccttgctagctcgttctcggcttgtctacaggcccttttccccgtccaggccttgggggctcggaccctgaactcagactctacagattgccctccaagtgaggacttggctcccccactccttcgacgcccccacccccgccccccgtgcagagagccggctcctgggcctgctggggcctctgctccagggcctcagggcccggcctggcagccggggagggccggaggcccaaggagggcgcgccttggccccacaccaacccccagggcctccccgcagtccctgcctagcccctctgccccagcaaatgcccagcccaggcaaattgtatttaaagaatcctgggggtcattatggcattttacaaactgtgaccgtttctgtgtgaagatttttagctgtatttgtggtctctgtatttatatttatgtttagcaccgtcagtgttcctatccaatttcaaaaaaggaaaaaaaagagggaaaattacaaaaagagagaaaaaaagtgaatgacgtttgtttagccagtaggagaaaataaataaataaataaatcccttcgtgttaccctcctgtataaatccaacctctgggtccgttctcgaatatttaataaaactgatattatttttaaaactttataccgggaattctgttaattcgctcgcccgccggcctcagggtgagagctggagcaggctccaagcgctcccgcgcctgccggccccctgcaagcccccagccctctgcactcgccttccccggagcccaggcgcccggccccggccttctgttcgttctcgcgatcgcactgaggggctgggaggcctctctgggctccctgcgcggagcaacacacacaccctgcgggaaaaagccgcgtaggattttgttgcggggggagctgggatcagtcggtttgggcaccaaccccacgcaggcctttcttcctgcctgtggcagccggtgtcctcggcgtccgaaccctgaggcgccccgaaagaccagtaaagaagcactatccaggcaccagggtctcctccacccactcccgggagttggaggcggggggcgccgtgagagcaagccccaggcccgcgccaagctggctgttgcgaaacgtagcggaggcggagagcggagggaaagagaagaccgcgggactggagccctgtcggcagggattgagcgattcaaggacatctcgagagagaaagcctggaaactgagctctcgcctgctctggtactcctgacgtggccgggacaaaattccttcttcattacagctccagccgggctggttccttacttttctctcctcaaacgggtgaagaggcgggtgaggagcgcagccggaccctaaccatttatcaaccctggccttctctctccaagcctggccagagaaacctgagtgggcctacagggagaggtgttgaggagggtctccggagggaaaaaatccgccagagttttccgggcccttcagattccctccagcgcccccaccctcgcctccagtgcctccaccagtgaggagggggccttctcctggcggggcggagatttcctgggaagaagcaggcagggaagtatgagacttggggctacgggggaagaggatggggccgaatggctgcagataccctgcgaaggctacccaggcgcctgccctgcccaccccccaggtccgccccattcctcttggtagctcagaaattgctctcttgtgaaccttatggattcaggtccctggaaagcctagcccagagaccttttccccaaagggcacataacgggccttttcctctgccatgctcacgtaatatttgtggaggcttcaatcttgcttctccatgtcctcaattaacatctattttctgtctaaaacctctggcataggtaccacataaggatcgcacacagggaaacagagcagtcctctagaccattgtctggctctgtccgtgtccacacacacacttgaaaattgccttgttgccactctggggaccctagcatggtgaggtctagccaactccacctggctcctcacctccagatccatcccaaacagcctgcaacaccctcagcttcatgacccccctatcttgttctgaccactcaggatccctcctcctgggcgtcctgtctacctcttcagaagctaattctactttctcttgctgataggcacctcttcagcagtagtggagccttagggcctgagaggcaagggacttctacctttggtttagggaacctaagttaaaccccattggttctccagcctgggcataggccaccttacctaacttaatcccctttcctcagccatttttgaagattggaagaccctggaggttgggagaacgggactttcattacaaaaagcactctgtgcgttataagtggggcctcgtcttttcccaattttaaatagaatttaaaaggctagctcaggggttgccccaacaaccagcttctccttcacagtgtaggaaatccagccaccggaaagcaagctggcgctccaggatgcaattcccccacataggcaccaggtgtcgctgtgggcttgttgtcccggctacccccaattccaagaacctttttttttttttccctcccccttccctctttctctctctcactccctctcccccttggttgggctttgccaacatatcgagatgcttttcgccggcttccatcactaacctcccggaggtcatcaagccaaatttatgagtggccgctcgagtcacgtgactctatttaaggctcccttatttgggaagagcgcataggataaagaaagagatatctccacctataaattgtccactttggagaacaaaaaacccctcaacttcaaagagtcacaaatcacccttaatcaaaaagggtgcagaaatttttttgggccctccccgccatgagctcctacgtagccaattcattctataagcagagccccaatatccctgcctataacatgcaaacttgtgggaactatggatcggcctcagaggtgcaggcatccaggtactgctacggcggattggacttaagcatcactttcccaccgcctgcgccttccaactctctccacggggtagacatggctgccaacccccgggctcaccccgaccgccccgcctgcagcgccgcggccgctccgggacacgctccgggcagagacgaagcggctcctctgaaccccgggatgtacagtcagaaggcggctcgcccggcgctggaggagcgagctaagagcagtggggagatcaaagaggagcaggcgcagacagggcagcccgccggactgagccagccaccggccccgccacagatttacccgtggatgaccaaactgcacatgagccacggtaaactttaggacttcattttgcgctctcgggtccgcctgggttttataggccatgcggggcaaataaagaaaaaaaacctgcggccataaattttacgatccaggcatcaatggctcgtaaaactgtccactaaaaggcttagaggctgtgtgcgcccaaatttacgacgacataattggatcataggaacaaaacgtgtataaaaggcaatattcaatttttgggggagagggagggagttaaaaaaatagagggatctgaagggtgaggagcgcggggctccagagcggggatccccccgcggctccctccctccctcccctgcggagccggctccgccggcgcttgcggctccggaggattccagcgactcgggaggggcgggaggggggtccccggtgctcggatctcgagggtgcttattgttcggtccgagcctgggtctccctcttccccccaaccccccctcagcccctccggctgcagagtgaaggctgcggtggaaagtttcctgcctgggcggaggcgcctctcccggggctgggctgggctggcccgcctgcggcccgcgtggcctgtcttgcggctctcgcctcctctccctccggccgcgggtgggggcctgggctggggtggggacgggggaacgctgcaagctattcaccccttcctggcttggggtggggtttatgttccagagacggacggcaagcggtcccgaaccagttacacgcgctaccagactctggaactcgagaaagaattccactttaaccgctacctcactcgccgcaggcgcatagagatcgccaacaacttgtgtctcaatgagagacagatcaagatctggttccagaaccgcaggatgaagtggaagaaagattccaaaatgaaaagcaaagaggctctttagaggcagcgggggaggcccgcagagcgcgcccctagccggttcctgtccctgcgcctttccttttcgcctttcctctctatatttcgggtcgggggcaggtgctggagcactgggctcccgggccccacagacaaaagcgcttttccttggcattccgcatccctaccgacccagggttcccgcggggctgtcggcgctgccccatctcccctcagctcggctcagctcggtacccggggcccagggcaagctccgcaggacttccccggagggctgcggcgtacaggctggcgcagaacgaaccttggcctgggccgtatctccggctcccagcctcagcgcggccctcccgagttaaggtgggcccggcccgcgccacaggaccctcgccggaccctctaacctcgccctctcctttgttcccggctggacgggttagacagccaaaggctggcgagagtctggccctagactcggggtgcttccttgtagcgactaaactagattttcacttatgaatgatttgcatatgaaaggagagcatcggcctagggcccccacagttgctctatgctttccaaaccttatctccacaacctcttccccccaaaacccgggaacctccccagcctgcgcctgctgcatgccctctcaggccggcagccccagcctgctagctagctcaactagtggggtttcctggcactggaccccagcaagtggtcctagaggccctttgctgtcccatagtccctgccacgaatttctgtgccctcctgacccattgctgttgtccaactatttattgactctgggtccttcctgaaactatattttgtcatatcaaataaagagagaacaggactaaagatgcagtggctcctgtctgtttggggcatgtattgggtaaaattgtctaaatgggctgtgagatgtagaaggagacccacaaactttaagccacccctttaaaaaattttctagcttctaggggcagtgagtagagggaggtgaaattgagctcctttcctgttccttggctgcaacaagagcctctgggggaagagaagggcacctaggcctcgagtactggcttttcccatgctgtggctgtccaaggccttcacgcctctgcactccaggaggcctctggactggcagcagcccccactgtgtgccaaagctgcggtgcaggaaccagtggctccaccgtgctcagccttaggaccttctgggcctctgaagatctttcctgggcctaggtggtccctgagaggccttgctggacatagagggagggctgagccctcactctagggacccatttggtctcataagggcctctagagggaggtggtattgcttggtaagggggtgttgggagagttggaggaggtgtgcctcagtatctaagatactggggaagagggagcagggaggacaatctgcagtgtgtatcagcctggcaggaaatgttcagactgtttccaccaccttctagggcctcgggctatgcaggacaattaactgggaaaggagctgcatagaccagtgctggagtcacgtctgtctgccatcatttatctcagtctctgggattttgtgtggaggggaggatgggttaaaagtgggggtgggaggaggcagataattcaggtagtgtctgaggatcaggtccttctccaggctcctgggatgggctgggggaggaagcactttacagtagaaacaaatgtgggaagggtccataaaactttactgcatttcctctcccacctcccacaacagggtgatttcctggagccaagcctaggccccccacactggtggggtgagggtctggagcttggctaagggattgcaccagcagccaagaagaaaggggagcagaggggctctggggaggggcaggggaatatttatgattattaatgctgatgctccttggatttattataaggactaacttcgctgcatcccactgcctaagctacccatcagtcattttttaaaagacccaagagcctttcctcaccccatgcttggcacataggcagtctcaacaaatgcttattgaacagtgcccacaactaccacccttccccttcgcactgcactcaggccaggttagggcgcctgttgtctctcctcaacttgcacacagcagttaacccagaccagtgctctctctctctctctctgaaataaaatgtgtaattttcttcagggagttattttaattttttctccatgctgagtaaaactattgagtgagcagtgaagcgtggagaagcactggcgtctccggtgggtaacagttaactaagaaagaggctgtggcacccgcacccacctgttccagcctcccaggctgcccaggccctgtgcttcctccccaggggacaggcgcaccaccccaggggaaaaccaagggctttgtcatagataggggcaatgttggttagagctgccaggcagggcacaccagccccaccgtgcactgactgcctcctcccggcagggtttgggcctctccttccctggaggagctgaaggtctgactcattttggcttgggtagacacagagtgcctgcctgccctcctccttcctgtcacaatctgcaggtctgcccaggcaccagccttggcttctgcagcatcgtcgggagtcagcggcggcaaccaagccagaggcctcgtacctacttccctacgctgagggtgcataaggcccagatccctgatttctccctgaacaggggcttctgctttggggcctggggtagtttccccaccagccagcctcctagaacatatttccaggtaacagggtctggcattgctctgggggagtttatggaggggtcttctgggttgcaagcagagactatggagcctgcctctccactttgccctggaacccaccccctctggcagcaagaaagaaggggaagaagcatgacttaccttcccgggggagtgggaagaggggggacacggcccactctgagcaattagaggaaagaggaggaaaaaataagaggacaaaaagatcaacacgacctcgaaggcgacaggtccttatggaaataagtaagtaaataaataaataaggatccaccctctcccccctctccaccctgcaagggggatgtgggggtggggcaaaggaacagcaccagggctttttagtgtaactgagcattagagaaataggcatgcttctatgtgaatttaggagtttgaaacttttggaggttatttatgtgaatagcctgaaggcaagcccgtgagtggctcttgggggaccacgtgatatcattaaaccaagttttatggtgtagggagagctgacaaacccacaatatatttacatcatatataatcttaactgtccagccacgcagctgctggtgaggtttaatgctaggacagagggcctggcagttagaggggattacggcgctggggacgatggtgagagaggttacatcttcgcaaatgaatcccaggcgaacgctgtgagttaattctctctttctctctctcagaccctttctcccatttacctaaccacccccctcacttgatagaaggcagctcccacttattagggggagggggaaaaggccttcccaggctggggtgggagaagagaagaagcagcagaaaaagctgctgggaagtaggaagatgggggagcttgtctaccctgagcagccctccccttcccactccttattctctctgactgcaagtcaactggggtagagaggccttggttgtttagagatttgccaggtcttcctgaccctttcagttgagaagaaagcaagcggcagcaacaagggtgtttggtgtctgtacgggtatgtaaactctagacacaagctcaaaatgcctctggggcccactgttccagggaggggtgagttcagcccttggccagtggcccaaggtgggaaactggggagaaaggcagggaaggagggttttgtggcttctacgcccacaggctactgctgcctgaactggcaaaagtatctcaaaggtggctgtttgaacccagaggtcccagagtgccccctccctccctcactaccaggcttggatgggcagctgtctcagcctccgtagtttggcatcttagtccgtctgaagccagtgtggtttcatgcttcctcctctccttctagctgcttgggtcttcctggcattcccagcccttgcctgagataaaactaggctctaagagccctagaggttcctgctgtgagtggagtgtaattgtgtgttgaatgggtgagggagcagaggcaatgtctttgctaggctgggaaagtaagtcccccaaccttaaggacagagtagcccctcggggatggagctagcagggcccaatatgagcactgcaccctggggtcaatcctcaggctagggcgcccttcaggtttctaggaaggagcagcagaagcgttgggcatgagaggcacatgtcttccacacctgcaattgctatccctccctgtgcgtcaccgggagctaagccaggaaagtgacaacatgtgaattcaggctcctgtactggccagccatgaatagccagggctttggaagcagggctgaatgccagcggacccataggtgcaactcctccaggctgggagaaaggggtggggagcagagggagtgagccagatatgcaccttccagaaggggagcatgcctggggagcagcggtgtctgggcatctgctttgtggagaggtgctgttgggggatgaggagggaatgctgttagcctcgcccccgctgctcaagggactggggaagaagcgagaagcaggcagactctgggagaaggaagggggcacagaggcccaaataaatggggagtcttagctgagccccattcttcagtctaggggtctctcacttgcatgaggagctcgggaacccgacatggaggattcccttgacgccatccctcagggcctcagtctcggccaagattcagcctcccccaccctcctccctgatacctttattttcctaggatcccagggaattctctccagcaacgcattggaaaaaactaattatcagtttctcccttcctcattacccgtccttcttggctctctccttccctctagtctgtgattttgagagtttctggaaactttcctatccaagcagcggagacatgggagtttctcttggtctgtaacttgactcttccccaccctccagcctccccagggctctagggagcgagtgcagtggtctttaaccgggaatttagccagggccgaagtcccacacccaggcaagactccaccctgacacccgccctgactctcggccaaatctcagtcccattcccttcctctctgtgtagacgggcattcgagggtgtttaaagatttacatagcgtcccttgagccctttgatgacttcttcacccccttttctgttctttaggctcaaaagttccatttaaataccacccctcttcctgtgataattgattctccttcccctcaaatagtttgcctcagttttttactgttttctaaaaagtttctagttccacctggaaacagggcaaacgcaaaggaggcctgaaattcttggttttcccacccactaccccaaaccctaatttggagtgtctctggagcggagggtgggcaggcaatcaggtgccaagctttccagccaacccgggaagcttttaattttgttcctaggactttaacccaaggagaggtcaagcaaccaatcagaaatgcactaagcagggtcacatggtccccaccaaccaatcagcaaaaactacttgggtctctgtctcgctcttcccatccggccctgttccttcctccctccctcccttcccaccacagccttagctcctgggtttatcctatctcagatttggaaggctggagtgatacccagcatattctagcctcctctgtcagtccctgaaccaactctgaggagtctttggcttgtctcctcagttgcttacaaagttgtatctgggagtcaatctcaaatgcacaaggatgtgaagttgtgggggcatcctctggattattcccacgttcgccagcgtgattctacccaattttctgggtgttgtagttgtagactctaaattagactatagagcaaatacagatatgaactccagccctgaattcaaattctggctgtgattattccccatacacttacaagtattcattctcttctgattttcatgagggcaggtggggtgagaggagagcccttttgatttctctttctggaaatgctccaatagccattagctttatcagactgcctcaggcatggttagggaagggagcaaaagtggagattttttgaaagttctgattggtacctttcgtttgtcgaataactttgagctagttaagggttctggaaaggaatgagcacagagaattccgactttcctcactctccacattaaatagttgatggatttgtttaaaccccttcccttccattcttttaacaggatataataatagtaataataataatagactaggtgatgatcctatgtcctggccaatagccatcaaaaggtacagccactgaaggtgtggatttcagtgtttgagtttacatggattaggccaagaacaagcaataggcgagaaactattgctgagtaagagcatctgatggcacagggagtgcacagctatgacagaaatgcttgtgtttcctgaacacttgggctgggccctgagccagtccactgctgggtccagacccaggtattctcccccagccacttctctagagctttgtttcagagtgaattttctggttgggttctcctccccttctcttcctgatctcttgccctctttgagctaaggggcaggagttctgatggactgtggcacctggacctctaagcacccccctgggggcattaagagtacaagaatgggaaggatagtccggactgagctgggctttgtcaacaatcccctcattgtttgtcttctggatggagctggtttggggacaatgccacaggccaggtgggaaggataaggatgagaagccagaaaaagagcagctcttctcagaaatcattgagccctcacttttcaagttaccttcaaccacactgctccatctgcttattttgagactaagtttcactcttgtcgccccggctggagtgcaatggcacaatctcggctcatcgcaaactctgtctcctgggttcaagtgattctcctgcctcaacctcccaagtggctgggattacaggtgcccaccaccacacccagttaatttttgtatttttggcagagatgagatttaatcatgttgcccaggctgacctcaggtaatccacacgcctcatcctcccaaagtgctgagattacaggtgtgaaccaccgcgcccagccttttcttttcttttcttttttttttttttttttgagatggagtttcactcttgttgcccaggctatagtgcaatggcaggatctcagctcaccgcaaactctgcctcctgggttcaagcgattctcctgcctcagcctcctgagtagctgggattagaggcatgcaccaccacgcctggctaattttgtatttttaatagagacagggtttctccgtgttggtcaggctggtctcaaactcctgacatcagatgatccgcctgcctttgcctcccaaggtgctgggattacaggcatgagccaccgtggccagccccatttgcctcttttatgagttagaattaaaggacacacttattcttccccagtgaatggtgtggcagattgttggagaccaactctcaccctcaatgtggacttctcacactggggtaccagatctcatgaagagttaggaaacaaagacagggggagattggttctatccacacaggcactgggaaaagagattttgtgagtgcctcgacccctccttgtgagtgcctcaaaaaggtaaactttctctttttgactgtcgttctctgtaactgctttggactgagtttttgagagggggaatgctgaaacatcattgttctaggatttaattaggtcctttttgctgagaagacaagcaccaccaccctgagcctcttctttagtgggactagggcccctgaagccctttgaggtgaaggagaaagaaaatctgaaatcagggtgccaaactagggttttggggtgaatgattcaatttaaggagaagacgatgctgtttgagagccaagaaagtcacatcctttcctacccctcccaacttttattggctccttgtgacccacattggtgtgtctgtactgatactatctctgctagcagctttgatggggctccaggagcccaaggaattgccagacaaggtctgggttgaggaacttcggtgatacaaatctctttatttttgaggcctacacaacccttgtaatcatctccctctcccaatcctaaggttcactgagaggcaaaaggggaacagagatacctcagaggaagcggtatgggtgtgcaatgtgggacttgggaaaattggactcggttatgcaggaccttgttcagcctctaaggaccacattttagcagctatgagaagaggttgaacacttgggctgggccctgagccggtccactgctccaggcatgctggggagcaagtgcagggagaaggctgcttctctgcatctgtacacatgtacagagaaagttctacagtgatctgcaaccccatatgggctgggtgaaatgtgtagcctggtcacctaggatcctttcagttctgcaccacaggtctcagagaggcagttcaggcttggttctgccctctaaagattctcatttaccccagcccctggccctgaacaccagaatacctgaacacacagaaacacatatatgtgcccaaggatggtatggtagaggtcagaagcctgggctggacacagtaaccagcatggaaccaacttcccactcctccctcccactccattcttcccgtcagcccagcttggaaaccatttgtcctccccaccccacccccacccctcaagccctgcgcagctgttgagtttccttccttctgcctttctggaaaactcaaacgctagagctgactccagggatggtggcagccaggctttctgtgatcttcagtgttgtgttggcccagattgagttgtcaggagttgaagagacatggagggtccaaggaggccagaatcttatctgatctaatccccctctccttctgttccaagctcaaactccaaactcctcagggctcccttgctcagacattagagataaatcttgtctagtaaatacttcttttaaaagtcaactttctggctggaaaacacaggctgtgtgtgtgtgtgtgtgtgtgtgtgtgtgtgtgtgtgtgtgtgtgtgtttagggagtagtaagggtcaggtctttcattttatgttgtgtctctccccatcccctgggtggaggatgggggcacaggctgaggttttattgagggtgcttttcctgttgggagtaaagacagggtcataaacgcctagagtagggtgttttgatctggtgacttctcaggaagtagcatctgaggttttgctttgtaaatcactctcccccaaagctggcttggcagattggattgcacttccccaagcccacctgaggcccctcctttcctcccttccccagtaaactaaaggagaaatataacagagcatctggagtcttcaaaatcctctgactccaatttcttttttaaaaggctaattggtgatttttttttccctcaaagttttcccctaaaaaataatgcaacgtttcatttccttttgcccatgcagtccctggtcccccaacccctcagtcacaaaggaactaacattgacagtaaatagcctcagagcctggctgtagatatcaggactcttctgttctggggctgatctctccctgtcactctttccccaagccccaaaccccctttgacaaggtagaacttcagatgtataagacagagttcataggagctaggaataagaggagatggcagcggggcataggggaaccccatcgtgtaccgcatgaatggaggaaactctgcagtctgtcactgggtttttttgtaattaagatgggtgcaggggtgtgtgagtgtgtgtgtttgtgtgtgtgtgtgtgtgtaagcccccagccttctcacatctctatgtaccaaacaaacaatatattttacctaaataactccatttcctaatgataatgagtcttcccctcctaaggatcccccaccccctggctggcaagtccctcccttgtgcctggggctacagagctgaaggaaaacaaagttaagagccctctaattcagccttagttcaagccagatcaggtcaggaagctttcaggcccaggcatcagggcttatattcattgccagcaaaatgcccctatatgctggaaatatgtcatagattatatgagttccgggccctcttagcacttgcgaagtctctagtccaccctcatttctttctcagagaagcctgggctgggataccccaaacccacaagcactagagattcctcttcattcctaggactccatgcaaataatcttcacagagagctgagcgctcccatagttatatatgtgaaaacgtatttatagatcgttctatgtctatatcaggatgtatgttttatattcctttttgttccacatttaaatgcagatttatagatccatagtgaacataacagtcctcggtcaaattcctgtgtgcactttaccaatctttctatagtggttggatgtatatgctaggatgtattggtacagctctcttgaaacacctaagtgaatatttggaaatttttttctttgttggaaagaactatgtgtgtgttcaatgtctattttgaaaattttatctagatttatgcaaggatcctaacccataaaatagctacatattgaagctacatatttagagatctttacagtctttgcatttttgctgaaaaacttacatgtttgaacatatgtttagagatggtttcataatgcatgcatctgtgtataggggcatagatctcccttctagaaggacttaaacttactgcatctctctgtctccctctctatctctgtgtctatgatataaaaagatattaggtgagtgggggtagggaacaaatatattttggatgtttggcttattaaagcaagtaattctgtctctatttctaaggccatctccaaaatctagtcccactaagttatctgtccctcgaaaacctactctaggggtcatagactgcctccaggctgcctctgtgacctgagatccaagccgaagctccctacctctcaaggtagccactaaaaagaagggggagagaagaaaggggagagtcctccagcccagttcctgttggatccccagggcaagaggctgacaggggcttgtatatctccctacaccccccactgggcctttgaaatgtgggggaaaaagggatcaagtccccaactgtttttatagggtgcccaaatgatgccagggttactgcacaacccataggttcctcctccccagttgttctcggtgcccagggcccaattaagcggccgccttgcgcccagcagccccgctcttatcggctgggattgatgcctccgcgtctcctgtatatcatttccaagattttttctgtccaactcctcggctcctttggcttccgcggctttgactaatgattgctacagatgccaacgtctccagaatcctaatagccaggcaggcggactcttatttacccggcaacattgctgtgggggagggggcctgggggacaagtattggggtgtcgtaggtcaggggacagggagaaggttgtggccaactcaagtgtcactgaacttcttcccagtcagaaagacattcccaatccccttctctccttgagggaaatatatatatatatatacacagttaatggtaactcattgctgcctcgttagaaaagatcaaagaatgaacacaacgtggtagaataagcagagcaatgtttatttgttgtaaataaatgagagaataagtggaaaaccagcagtttggggaggaaaaagagaaagggaaagaagtcagccacagtgggagaaggggctccttttcttcatttcttgtcttcccctttctctccccaccctaagtctacccttctcatcaatttctcccctctttcccttccttcgcctcaccttcaatcccttgggtggaggggctgaacagcgtgttcccgggcggaggtgcgcgcagccaccccaggctgctgccaggtgcccgctggggctgccagggcgaggaggcctctgggctgtggagcgaaagtcagatccaccgcctactgcggggtaggggccgcagtggggaccgccagccctgtggtccctctcgcgctgactggcgtaaagttgtggccgaattcgcatctcttctggtgcttctcgcccgccagcgcagggcccaggtgtttgaggcgaaggggctctagctccccgcaagcctggagccaggcgtcgcgcttcctccgggcttaatccagacctttcaacacacacctcattcgggggaggagaaaagcacaggaccgcggagagcccagctttgaggccaggcctgaagggataacccacacagggaacgttttcctatcagagaataatggagcacaaaataattcagaaagcgaatgggcaggaccacagcctgagagtcccgcgccgcggggccgctgcagagccggtctcccgagcaccgcggcaggaccatttcgttggaatgtagggcgaggccgaagcccgccccggacccaggccgcgaggtgcgcgccggccgccgaggggccgcctgtaaattacagcccgccgggaggactcggaaatacacaaaaggagccgaaagatttaaacagtcggaggcagaggcgtcccgaggcggccaaagcggaaatcaatcacgtaattaaaacagggaggggacgaagcccaaggctgggggtcccgggttcggaggaggcggccaaggtgcaggccgaggctggcgagcggcttagggacgtggctcgcccgccaggaccagagcgcgcggaggggcttcggggaagtttataacacatcgctattgattcccgcttggctaggaagagcagactctggtgccctctcccaggccagaccctgaagcctccgatggccccttctccgactttcccgtttttgtggggttgagacgcgcagttgcagttgaaggccgctccccagatcccactggtgccacgattttgccaaggcaagtttgcgaacccaaatggcatcaagatgctgcctttgggtttgaggggatggagggaggtgacaccccagtttcaggcactaagaaatctctctcggccttgattcctccaacccaggattcaaagcatgcccggaaagactctgatctatgggccgaggcttggaaggggtgtgcgaggcagacggggttattaaagggagagcttggggctgagcaaactggacccctttgggctggaaaggagaaagaacagctcctggaagagaaaaaaaggcacaccgggagctgtgttttgtgaggggaagatcttattattgaggttaatcatggtaatgatctggtatggctgggtcagcccaggagaccgcgctctccaaagttctttctcacagaggtttctctgggggagtcaagggttccccaacttcactatggttggggaaaataaaataaagacctccaatcctctcctctgccttttcctctccctcccttaaaaactccagaaaaagggaaaccttataaaatctccatcaccccacttatttttccttggctctctccagtttactaaaatgcacggtctttgggaattgagtttttctggagcacccttcttgtgaagcaacagaggtgacccgaccaagtcctcatgaattctgatgctgaccctggagaggacccaggattcccttgcctactgtagaattctctctctatccttagtttttcccagtctctgccttctttggtcttgggtgcataatctcatgggtctctggcagttcagaggccaagaacagattaaggcactttgagataccctcataaactcttaaaagtgtttccagcttcctgtcatctctttaatactgggagtaccaggccagggacccctccataaactaacctaaggccagcctgatttctagatcttttcaagccacatttaggttccttgaaaaataaaagtccccctccccagcaagaaattcaggtcaccaacctgccgcacagcaaggttcctgcatccacacatcagaattttcaacaacaacaattttcataataagaagtaaagcttgcatcaaagttagcaagggacaccccaaaccaaattttaaaaaggatatcatccagcagtcttgaagaggggtgggggtcaatgaggctgggatgagggaggaaggtggtggggaacccaacctctaactaacaatttctccagcataaaaatgaaacatcagattcgttagcccagggccttcatttttccccttccacattataactagttattgaactcgctggaagatctaaaggccatttgcgaagagacaaatttcaatggagtttccccatcaataaccccatggcagtgaactattggaacaagtcaaacacccgaggtgaaatgcaggtcactctgtctaaccaatattaaaatgcggccactttttaaaaagccactttaaacgagatttgaggaaaattgaattccaaggaaggcaaggcaaggcaagagaaatccatgagaggaccttgcctaaggtctccaaacaaacaagagaaattcatctttaatattttaaaggggggcaaattaacattccatgattgcttttttttttttgagactataagcgattccaggagaagaaaaaaggttgagtattttctggtgacacatccaggttattaaaatcattttagaccaattcattacttttactgacaagagatttaagaaaaaatcaattaagatttgcatattcttttgcatacattagccctggctgccggcattagaaagggacaaacacatacacacacacacacacacacacacacacacacacacacacacacacacgaaaaaaatgggctatgagccttgatttagttttgggttttcaagttgcccaaaggaaaaaaaaatcaaagtgaaatgaattgcctgattgcataccatctaaaattcaatttatatgagtgaaaggaaacagaaatgttgcaatttttaatccctaaaacaacaacaacaacaacattcacacacataaaccctgcatttcaaagagtagggaaaggaatgaccctcattttccttccctttgccctccaaatcctgaattggttcacccatttatttttctcccttggaaaaatcagagaggggtacgattttaatgcagcagagaatctatggagccgctgagctctctcagccggcagcttgttactggggaggggaggaatatgggttatccaacggtcagtatggtaatccaggcacaataaggcctcacacacaatggacacatatttttcttcagcgatgtcagaagggaagcgctttgtactgaaacgtgtttccgaaagagaaaccaaatcgagatttagaaaggagatggggtggaggggcaattgcagagagcatttggatgctggcaaaaggtagtcagaaaaaataaaaataaataaaactggggcaaagtgaggttgaggacagggcagaggtgcagcccctgggccagcaaggcgggaggcaggagggtgaaacacaaaagaagacaggaccagatacaaggattcatcacagatgagagctgctttagtacccccaccccctcccaattaagccattgctaagtgcaaaagcccttccaacggattttatttctgtgcttgtaataatatccaggtgaaaatgtttgtgtgtatgtgtgtggtattttacccatgtgacaggcgacttccttgctattaagctataggagcccaaagagagttgctgttgttgttttgtaaatgatgtagatgagtgtgggcacatttgggggaatcttggagatttcactttctggatgtgcatgttgaattagctgcacgaacctggaatgaaaactctacatatttatagctgcataaagaggcatttaatatattaataaatattaatagtgtgcacgcatatatgttaaccataataaccaaagacagacttgacattcagttgggggcatctgaaccctctgtgtctactacttatactggcccaaagtcagtctccttgacccccctgcagaagctcagaaacctggcgggggtgggatgtgacaggcaacatattggggaggactccttaacaagtacaggagggtgaagattgaagaaaagagggttagcgtcagggcacggatggtaaaaggtgagtgtgagggctgagaggatgagagtcaggctcacagctcacctttccaggtgaggcagccgcatccaggtacaggcctagaagggagactgggagtggggccgggaaggtttcctccctcttcatcaaccctctccacatggcaccaaagtttgctgagctttggacttcccggtggagccatctgggactacagttcagacttaggtactaggattcagcactggtttccctttgccctcttccagcaatttataatgaacccacccccaccaccaatgattaagacaaccccacacaacccaaaccactattaaccaagcagtagccttcctccgccccctcactcacagtctcaacttcctctccaaccaaaccagcctgtcctcacatgcagagagttccggacaagagtgggcaagggttctcagccaactctgagaatttgggaatctccattagaggtgttcagcctctggggaactcctgttccttcacctggcctggttacagtggggatgggcactgtcctcttggagagagagtattcagggaccaccaagcaccagctccttgggagctaagccctggccctgctgagcctggggtggggctgggggcctaagcattggaggagggaaggcaacgagggcccaggcgggaatccgcaccctttgggcacggctgtgggtccagcttccctctcattccagccctttggggaagccctaatttggaagtggggaccctctccaacatcccaaaggtgatgagaaaaggattggaatctcttgccttcagtctccctctcacaagggctttattttttttttccctttcccctcctcattcccttaattgcagatgttctaattaaaccctcaaatagttgttatgccgttttaaaaggtacttattcaagtgtcaaccaggctgggctgggaggaggtagcgtagggcggcgaattaaaggtagattgactaatcacggcggcgatcataataataaaatcagagggaaaaaaaatcacattacgacttttcgtggaaaggagggagcaggcagccagcggccgccagccctgcgccgccgccgacacaaagagtgcgggcgattccgcgagactgatttatgacgttttacagccctataaaagctgtagcgacgaggcaagcgctcctaccaccgctggcagatttagtctaataaataaaacataaacagttaactttatgtgtcacttttattgttatcaagtaaaatatagctgagccctggcaagctatgattttaaactataattgttatcaagtacaacaaggggacccggctccctccctgggctctcccctccgctaccccccgcaactctgagttatgggcgatcagttaattggaatcggtggcatgacaggaccacccctagctggggggggggggtggtggttaggaaagcagcttttcctggccccctccctcctctacggccctgtcacccccctccatcagagtattactgtgagtgggtggcagagagagagcagggggtgtgaatgggctggagaccccaaaggctggccgtgcctccccaacttggtgagcttagccttccgtttttggaaagcagcctggagctggcctttaggaattcgtgtttacatgtaaacacacgtgttacatggatacagctcctagccagaagcaagcaggctctacccacacaggcctccctcttagctaggtctgccctctgtggggacagagaaagaactctcaggatcttggctgggcaccatcacagggcactgactcctggcagaaagctctcctccttgccccagctccttggagataattgtcagaaaatagcaggccgggctgaatggggagtggaaacagaagccagcagtagaagagatcctctgctctggggctggggcagggagggtcagtgggtagcaggggaaggcgagacttctgaactctgcttttgccaaccacttcctgtctctcttcagcgggggctcaacccccagacctccagaaatgacgtcagaatcatttgcatcccgctgcctctacctgcctggtccagctgggaccctgcctcgccggccgcatggccagagggttgggtgagtgtgtatggggaagaggggctggactctggtatccttggatggggggcactccaggctctccagcctcctcggctcagcctgggcccctccccatccaacatccactccagtcctcattcaacttcctcttcctgcgaaagaggggcgctgccccgtgacctacacagactgagacacgatcgccatgaatggagacctctggaaaagctcaggagccgaggcccacggggcccagcagaggcctgaggggagaccctgggcgggggctgaatcactgcctcccgacagtcccccaatgcccgggctttggaggggagccgggagcttcccatctccttttgcaggggagggttgtcagtctggcgggatgtgcactgggggcactccaacctctgctagctaaccccacatcaccacccacccccgcctcccagcaccaccaccaccacacacacaaaaaaattggatacattttgaataaagcgattcggttccttatccggggactgggttgctccgtgtgattggccggaggagtcacatggtgaaagtaactttacagggtcgctagctagtaggagggctttatggagcagaaaaacgacaaagcgagaaaaattattttccactccagaaattaatgatcatgagctcgtatttgatggactctaactacatcgatccgaaatttcctccatgcgaagaatattcgcaaaatagctacatccctgaacacagtccggaatattacggccggaccagggaatcgggattccagcatcaccaccaggagctgtacccaccaccgcctccgcgccctagctaccctgagcgccagtatagctgcaccagtctccaggggcccggcaattcgcgaggccacgggccggcccaggcgggccaccaccaccccgagaaatcacagtcgctctgcgagccggcgcctctctcaggcgcctccgcctccccgtccccagccccgccagcctgcagccagccagcccccgaccatccctccagcgccgccagcaagcaacccatagtctacccatggatgaaaaaaattcacgttagcacgggtaggcaactttgctttttgctccccccctccctcccttcttccctagcgctccccaccctcctcggccccctctggcccccgtcctcctttctctccttccccctctctctccaggagcgactctgggttagcacaattgaactggatttacgagcgagaatgggtaattacatcccccataaattttatggcttagctactctgggcagtccgagccatgtgctacgatctgttatgtatgtgtgaaaactatgctcgctttctaagggcgcataaataattcagtgtcgttacaatgaggattcccctcttattacactacaaagtcttcagcttccttcaacttctttataacccatttaagcttgatgactttatttccaccactccctcctcctgtttctcagagctgaggatggggtgagggtggggggcggggagcctgctgcctctgaaccccactatttgcttttcccctccccccagtgaaccccaattataacggaggggaacccaagcgctcgaggacagcctatacccggcagcaagtcctggaattagagaaagagtttcattacaaccgctacctgacccgaaggagaaggatcgagatcgcccactcgctgtgcctctctgagaggcagatcaaaatctggttccaaaaccgtcgcatgaaatggaagaaggaccaccgactccccaacaccaaagtcaggtcagcacccccggccggcgctgcgcccagcaccctttcggcagctaccccgggtacttctgaagaccactcccagagcgccacgccgccggagcagcaacgggcagaggacattaccaggttataaaacataactcacacccctgcccccaccccatgcccccaccctcccctcacacacaaattgactcttatttatagaatttaatatatatatatatatatatatatataggttcttttctctcttcctctcaccttgtcccttgtcagttccaaacagacaaaacagataaacaaacaagccccctgccctcctctccctcccactgttaaggacccttttaagcatgtgatgttgtcttagcatggtacctgctgggtgtttttttttaaaaggccattttggggggttatttattttttaagaaaaaaagctgcaaaaattatatattgcaaggtgtgatggtctggcttgggtgaatttcaggggaaatgaggaaaagaaaaaaggaaagaaattttaaagccaattctcatccttctcctcctcctccttccccccctctttccttaggccttttgcattgaaaatgcaccaggggaggttagtgagggggaagtcattttaaggagaacaaagctatgaagttcttttgtattattgttgggggggggtgtgggaggagagggggcgaagacagcagacaaagctaaatgcatctggagagcctctcagagctgttcagtttgaggagccaaaagaaaatcaaaatgaactttcagttcagagaggcagtctataggtagaatctctccccacccctatcgtggttattgtgtttttggactgaatttacttgattattgtaaaacttgcaataaagaattttagtgtcgatgtgaaatgccccgtgatcaataataaaccagtggatgtgaattagttttacgtcaatgtctgatggtttctttttattcccctccctctctggcctggtaacatcccatcttctctatagttgcctaagtttactttaaacaaacacacaaatcttagctctccattagtcttccaatgtccttagaagaacaagcaagggggttggggtatgggatcttcagaagaggggatgtggaagattaaggctgatttctccagtccccttccttccccctgagtctgcagagagaccagactcctctgggggcacttcagtggagctgagggtggggagtgtctcacttttctatagttaggtacagtttcttctttttgtcttttctctctcttcccttctccctcctctgtgctgagtaggcctgcctactttgtagacaagggggcaagtttagggagtgggaaggagaatagttttctttcatcttttagggctcttttgggatgagggattaaggaagacatcccctcaacatttgagttcttaaaagaaggaaggttttgagctggtgactctgaagcagcaaagtcacctgtcaggatgccttctctgtttgtttaggcttggaaaaaagactggccagaggcctgggaggtacccttgttatggataggcctcaaaggctgatgcctggagataataaaagacttttacctttttattctctaacttttattatggacctgccaggtgttgcgaagagacttagggagagtcaaggaccaccctctcttcctataacctcccaggtcctggcagcgtatggggatagcctgaacaagtttctctggctgtaaagaaataaattaattaaataaatttgtttccttggggctaaaaaagaaacaaaaaatcttgcctggattacctgaatacattcaagccaaaggctcccaaataattctggtcctgagatccaggccctagcaaggcctgcttaattttttgcttgtttgttaggagaaggtgggaggagggctgttggtgaccttcttctcggacgatttatccatatttcaggaagaaaggcaattagaagtagaagacagagggagaagagatctagggtatgcagggaagccagggataccccttccccctatccccaaattctggagtgaaaggcaacagcaggactaagttgtacaaatcacattggtgtgctttgaatttatttccttttgaaccacttgctggttgttacttggtgtgtgtgtgtgtgtgtgtgtgtgtgtatgcatgccctcacacatgtgtgtgttggggggagtctcttagtcctttaggt

SEQ ID NO: 15116 - DNA, 83462 bp, Human
  misc_feature (1)...(83462): n = A,T,C or G
cctcccaaagtgctgggattacgggtgtgagccacagcgcccggccacactgagacattttagagggagatcagtctatggaacaaatgctggcctggggctggtggcctgggtgtgctgtctggccaattttgtgcgtggagtaagcagtggggagaggcgctgggtgtcaggaaactatgccaggccctgccctccaccaaccccaatcaaagagctgagagggggttcttctccacaccatcccactacttgtgtccctcaccttctctgagtcctgggtattggtgctgggaactctgcaacagatttcctgaaggcaggtggcctgtggaaggaaggcagaggagggggcctgcagaatgcaaaggtgtacggaaggcatctctgcgcccctgctgaagatttttcactttatcctgaagggaagacaatatctgaggccgggaaataataaatattgattttcactttatcagtattcctggcagctgcacggaaaatggaatggcacagaaactggagtcttatgggcacttatcccactagttggggtgggaaattaaaggctgtgtgtaaggtgggcacagatctaacagaatgtggattgggatatgcaggggagggtggagtgggggaagacagactccatttggacttggtgagttataggtgcagcaccagcataatgcgcatggaagtcctggaatcatttaccaagaaggtcctgaacacaggtgagggacatccccttcttccctgttccctaaggcgcctagactttggagtcagtcagtcttgggttccagcctcccgctaggacgcaatttcttgagagcaggattcgatctgttgttcacggctagatcctaagcgcctagaatagtttctggcacacagtaggcactcaataaacatttgcagaatgaatcaatgaatgaatggtcacgctccattcctcggctgtaaacacaatgaaatcacctagccgcaaacttggcgcacagtaggcgctcaacaagttgtatttttcccttcccttgcagtagaccgcggtccccaggcgaccgcgaaagaaaaaaaggggtttctctacctcgcgtggtctgcacctcgcttcgccccccgcagccctcgctgggtcgcagggagcacgtgggccaggcaggctgggtgggagtggagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcgcgccccatggccggggagcgcatccgccaaccccgggcggaggtgggcccctccgagcgcgcgcgggcggcgggcagcggcggcagctgagactccgggggatgtgacagccgccggggaggggtacgagacgcagaccacacgttgcccacgtgcgaggaccgggcaggggctcagcccctaggccgcccggtgcgtggggcggcgggggctggctttgagtcacccccgcttgtgccagcttccccggctcggcggagactggcttggggatgcctggccgcccggcccccttctcggacgcggcgtggggagcgagctggagttaaggatgaaggtgggactggccgggccgacctctgacccctggaggccgagtcggcagggcggggcacggcgcgcttcagcagctttgcgtgggggcgaggaggtggaggagggcgaggaggtggagaagggcggggaggtgtagcgtggcgctcagtccgcctgctactcggtcccggcgctgggctgaggggaggggttgtcttaaaagtctctccttccccctgtaggggcggccggcgagtcccagtgagagcggagggtgccagaggtagggggccgagaaacaaagttcccggggcttcctccggggccgcggtcggggctgcgcgtttgaccgcccccctcctcgcgaaggcaatggcttccaaactcctgcgcgcggtcatcctcgggccgcccggctcgggcaagggcaccgtgtgccagaggatcgcccagaactttggtctccagcatctctccagcggccacttcttgcgggagaacatcaaggccagcaccggtgaggggctgcggggacgagggccgggggcgagccgcgttgggctggggtgaggccctggagggactggggctcccggatcacggcgcccttcccccgcccgcgtgtggtcgtgcaggctcgtacgtgccggggcgcatgcagctggcggccgcgcggcttaaccgcgcctggggaggaggccgaggctccaggggcggccggtgggaggtgcccacggctcctctccaccgctcctcctgtcgcgaggaatagcccgagccacccggccgagggaacgataactaggcagggagatcccggagcttccgtctcgcgctgccctccttaagacaaagccgtccccgtacccgttagccctggccccctcctccgagtccgtagagagccgcgcgccgcctaacgcgggagcacagaggtggagggccgcccacatataacagtcgggcggggccgcgccccccggaacctgtggggcgggggggctcacaacctaaacctctccagcccctccacgcagcctcgggcctcggggcagagccctgggtggctttgaaaggcctgtctgttcgttgtcgccttctaaggtaaactctccccagcaactcccccccctcccgaagccgccgggcctggccgtcaggagactcggaggagactcgttctgataaattacattttgtaatgcagctttcctggaaatggcttcttgagctgcctcccttggcatgagatgcctcctttggctggcgtggtgaacttggggatatatagatcgcctgatttcttagtctgacggggttgagtgcgtccctttccccctctcctcccactccacgttcacaccagttccgaaagaattggcgttaaaaggcgagaggtagcggttgtgctgctgcgaggctcttaacccttctgggatggagatgctggtaattagcaactcctttatgaaaagttgttcttcccagcaggggtcctttactgtcgatgtacttctcaaggatgtccgggctggttattgcccatcatggactaattatccggagatctgcatttcagaagcacagactggcttgaaaaggaaggtggaggacagtaccagaaaacaaaaggaaagcttaaaagcaaggaattaagaagtatctccagaattgtattccttatctcttaagcagattgaaaaagcggacttttacaggaaactcttcccccacccccatgtctcaaaaggaagaattatgtgtaccagattgcacttgagttttctgttgtgggtattgttacctcaagtgcgcctattttgattttaatacattcacatgcattttattcttgaaatgctgcggtttgaggggagagcggcctgagggggaaggctggctctcatcctaatggttttgtgtttaggttgggcttcttcatggtaggggcatggagtcagtgaaggaagacagtgagaagagatgagcccattccataattctctgtacctgactaggagacttgtttccttctatgagcccattccataattctctgtaccttacttggtgacttgtttccttctggaatgaagggcttcacactgtccatcctgggactggactcatagccctttccatgtttaaagagagtgtgatgggaagtagcttatttctgcactttcttaggggctttgaaaattttccatttgctcttttcccttgttctctctttctctctctctctcttttttttttttttaactttcctgtgttctaaattttagttttcattctctttcaaatgccttcatttcctccccagtgatcctccctggagtgagaaatgactatgaaatgtttagattttcttttttctgttgggaatcaagcagctttttgcatgagccaattaaaaaaaaaactttatcaaagaaagaagaaaaataaaggacagcaatttgttttgaaagtggcttgtttctagtgaactttcgggttatcggattatttttccctctcagaaggtctgagaatcttataggcttactgcctggtaaataaaacattcctttccacggtatttatttttctgtctgttacctgctgtttgcttttagctgatttcctggtgggaaacacaaccacccttctgtatgtaccctttataatggaaggtttgaaggagacgatgaagcacaacaaaaacccaggaaatagaaccgtgtaggaatttgaattggaaagtagctccggccatctgctccagcctggatttgggcacactcttgtctacatggctttcctcctcctgcagcctggtgaaaagctgctctttcaggaaagggccattctgatgtcattgcttcttggaagtcttccctcacctgctctggcagaattcatctctttcctctgcacataactttttttttttgagacgagtctcgttctgtcacccacaccggagttcagtggcgctatctcggctcgctgcaacctctgcctcccgggttcaagcgattctcttgcttcagcctcccaagtagctgggattacaggcgtctgccaccacgcccggctaatttttgtatttttcgtagagatagggtttcaccatctctacgaaggttcgaggtcaggctggtcgcgaactcgggaccttagatgatccacccgtcttggcctcccaaagtgctgggattacaaatgtgagccaccgcacctgacctcctctcctctgcacatgtcttattgattctaatgttgcagtcatatatcatgcagtgtaaaaatgcctgtctcacacccagtaagatatctgctgagtggctgctgtgcgtcaatgttctaggtgctgggggcaatagcattaagataatcttgtgcctcttttattattatttatagataggggttttgctttagtgcccaggctggtctcaaactcttggctcagtctcccaaaatgttgggattacaggtgtgagccactgcacctggcccattcttgggccttttgttctttctgcctataccattgtacaatttccactctgaaacttggaggacagggatcaggcaaagtacctaatgtataaaaggagcttaccgagtctgtattaaaggcctgggtcacaaattctagacagtacatcttagtccagaagtcaagcaacctatagcatagagaccattttgtttaattagctctgatttatggtaaaagtatgtgcttaatatggatctgagattagcttcatggtagctgtcacccattggcccttcctacactgcctagagtggtacaggctgaggcttatcagatacctcatttgaagagtcacccccatatctttggctcagattttctttagcacactgcaagagtaaatagaagggagagttctcttagattgccaggagttgggtcttaccctctgttgtaagaaatattagcttttctctgtgtatgtatgggtatgcacatgtatgtatgagtatacacacacacacagggactggcactctattgagtgagtcctactacaaactctgaacaaattctgatatttaatgatagattcttttattgggtcatatctaaaggatatgcaaatcctgttttaaaggttggagaaatagtggtattttttaaaaccacattatactggatctactatctcaagtgcaggaaaactggcacatctccatttggaagcatcttggagttaattgagataaaagatgttaaggaacaaacctgtttctgcacttgctatctctctctctctctctctctctctctctctctctctctctatatatatatatatatatttttttttttttttttttttttttttgagccggagtctcactctgtcacccaggccggagtgcagtggcacagtctcggctcactgcagcctccgcctcccaggttcaagcgattcttctgcctcagcctcccgagtagctgggactacaggcacacaccaccacgtgtggctatttttgtatttttggtggagatggggtttcaccatttggccaggctggtcttgaactcctgacctcatgatctgcctgcctcggcctcccaaagtgctgggattacaggcgtgagccaccgcacctggcctctgcttctcaatattaactgcagctcttgctggagttttgctgatgggactagcatttcaagttagtctatgggcccagcctctttttgaaaagatggcctagttcagagggctcagggttctttttggtgctcattaagtataaatgtgtgtcttatgtaagagggaaaacttctgagaactggaagatagaaacattgtattagagagacttgggagccagagttcaacaatgtatctaaaacaggtttcaatagttatcctttttatagatcatacagagtcttggcttattacagggtttctagagtatgttctattccatttccccccctagctggatgagactcaggatgtagcacaggtcaagcaagggtctgactggttttgagacctctccagtccaaaggtccactccatatccacttattgttgcttttttggtttctttgaggattttcacacatatttgaagaacactatttgtgacttgaataaggcattccatgacagtaagtctgccttagccacatgtacatctgaatctttgcacattcttccagtgggattttttttcttcttctttttgagacatagtttcactctgtgacctaggctggagtgcagtggcatgaacacggcttactgtggccttgatttcccgggctcaagtgattgtcttacctcagccccttaagtagctggggctacaggcatgcaccaccatgcccggataatttcgtatttttttggtagagttagggtttctacgtgttgcccaggctggtcttgaaccccttagttcaggcagtctgcccgcctcggcctcccaaaatgctgagattacaggtgtgagtcaccatgcctggccaggatcattttttagaagtagttttttctgatcaaagtcatgccttgtacaaaatttagaaaatataaaacggtagaagaaatgaaagcagcaagtaaaagttacccttaattccttaagggtaatttaagcaaataaattaaaggtgactgtcttaggttgtgtgattagggaaggcctctccaggaggtgaatgtcctcattcataccgtaaacaatgagcttgtgatgattaggaacaggttgttccaggaagaaggaacagcaagtgcaaaggccctaaggtgggaattagcatagcgtgtctgaggaacagaaagaagtggcagtatgtttggagcctagcaagtagaagggatgtggaagtaggtcaggtcagagagacgagcaggtgccagatcaggtagagcctgggggatcctggtaaggattggattttattccaagggcactggaaagccaaggaagggttttacataggacaatgacatgaaaagatttactttctaaaagttgatcttttgcctgctgtgtggagaggtgactcaggtgagcaagagggagaccagtatggatgaggagagtggcctgtggtttgaacttgttggtggcaaaggaggagagaagtaaagggatttgggatatatatgaaggcagagctgactggatataatgaattggttgtgagaggtgatggagagaaagaagtctacaatgaatcctagggttttgccctgagcgcctgcctgggtgaatgtgctatagggttgaatgaactagaatgtgtctaaccaatcttttgtggaacatttgggttatttgcatactttgctgattaagaatgcccttggaagagcacatgcatgggctagctccttccttttatcttgttgcactcctgacagcaagatgggtcaccagcagctgtactggagccactgctgaaaattcagccagggttctcgctcttgtcgcgtctgttcaaaccgtcactgtctgatccagaaatgtggcctcaatacgtgctgccagtgtttccgtcagtacgcgaacgatatcagttttattaagttggactaaatgatcctccttcaaaggattatccaaggcatctacccaatacaaaaccacgatagttctttgtacataaaataaacattcaaacaaagaacgctcttacaaatgtcattgtgtacaaatcactggacagatatactttctctgggataggtttctaggaatgaaactactggccaaaatagaacttaaatcatagggagaattttttttttttttttaagacgtagtcttgctcttgtcatccaggctggagtgcagtggcgctattttggctcactgcaacctctgcctcccaggttcaagcaattctcctgactcagcttcccaagtagctgggattacaggcgcccaccaccatgcccagctaatttttgtatttttaatagagacggggtttcaccatgttggccaggctggtctcgaactcctgacctaggtgatccacctgcctcggcctcccaaagtgctgggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctgcccgccttggcttccccaaagtgctgggattacaggcatgagccacctttccacacacacacacatagattttgagttacattattattgcattgtattatagtattactgttttgaaaattgctttaacaatgtgtcatctagtattttccaattttgttaaatactgttttttaatgtgagttaagtactcatgtataattccaatattcaaatataatttgttattccatttttacttttgaaaaggtaaaaaggtacatgcagatagtaaaattttcaaataatacactaggaatagagtggaaagtttcatgcctatccctgactcttggttccccagtttctctccacaggggtatctgcttttaactttttttggatgtgtatccaaagattttgtcatatatctatagcatttatgtgtgtatagcagtgcctcttttttttaatgtacacatttgttctttgtattgcacttaagaaaaacttagcagtaaagcttagatagtggtttccatcagcatgtatcagtttactttattcttttaaaaagatatctgcattattttttattgtacagatatatcatagtttatttagcctttctcttacattttggcctcaggtcctttttaacacgtttgaaaattgagaaccaaagaagctttgtttatgtgggttacatatatagatgttaaatggatttgaaattaaaatttagaaaatttgccgggctcggtggctcatgcctgtaatcccagcactttgggaggctgaggcgggcagatcatgaggtcaggagtttgagaccagcctgacgaacatggtgaaaccccgtctctactaaaaatacaaaaattagccgggcgtggtggcacatgcctgtaatctcagctactctggaggctgagatttacttgagaattgcttgaacccgggaggcggaggttgcagtgagccaagattgccccactgcactccagcctggacgacagggcgagactgtgtctcaaaaaaaaaaaaaaagaaagaaaattgagaaaatttaaaaatattaattcatcaaaataacaataatccactgtatgttaacagatttctgtgaaaattaactattttccaaaatgaaatctaatgagaaaagtactgttatttttgcacatttgcaaatctttctggcctaatagaagaaaactttattgtcatatctggttcttcattcagtctttggtgctatgttgttttggttaaagtatttgaagaacatctggctttatacacatgtaattaaaggggaactcatggacccctgaaaaggtctcatggactcacaggagtcctgggaccacaatttaatcagtcccctgttgattggaattcaggttatttatagtcattcgatatacagagcatgctgcactgaatgtcctggtaaatgtgtctttcaacaaatgtttgagtgccaggcaatcttggcttgtgggatgcaaagaggtgaaacaaggtctgttcctgaaggagctgctgttttttggtggaggcaggcagtcagacaggcaagcaaacaagaagaaaataacacaattgggctgggtgtggtggttcatgtttgtaatcccagcactttgggaggctgaggctggaggattgctagagaccaagtgtccaagaccagcttggataacgtagcgagacctcatctttactaaaaataatgtaagaaaattagctgggtgtggttttacacacctgtagtctcagctactcgggaggttgaggtgggaggatcacttgagcccaagaggttgaggttgaagtgatctgtgatcatgccactgcactccagcctgggcaacagagcaagaccctgtctctgagaaaaaaaaaaattaactgaggctgcaagatgtgcatgcttacagaagaggcagctaacccagcatttaggaggaggtgagatttgggaaggctttttagaggaggcgattcctgagctgagttttgacaaatgagtacagctacaaaaagatggcatggtcattgtcacagcatacctgaaactcctcttgtagagtttgtttatggtccacaagaggtccttgcttttatggcttggccttaccttttctattatcattttagtccgcatccatctctaatgatattgtcaaaggaaagggttatcacgcctgccccatatcacctttccagccctcattgcttgtgcttgcctttaagatatacatacacatagtggcattgtagtatatgcatttaaacttcggcttttaacttctggaactgaaggatggcaaacaatcctaaaactagtaaattgggcttcaagctgttaactataaattcacccattctgaaaggcatgttgaattacctgttcccttcaaaatctaccaagtaaattgttaaatggtattatattatgctagtctgctctttaacaatctgtattggtgcatattgtgagaaggtttaaggagttggaaattttgtaagttttttagatgatgtactttcacaatggacaatgaatcagatatttcaaccatgtattttcctttagcaaactagattttttttttctttgaggcggagcctcagtctgttgcccaggctgaagtgcagtggtgtgatcttggctcactgcaacctctgcctcctgggttcaagcgattcttgtgcctcagcctcccgagtagctgggactacaggctcctgccaccatgacctgctaaattttttttttgcatttttagtggagacggggtttcaccatgttcgccaggctggtcttgaactcctgacctcaggtgatccacctgcctaggcctcccaaagtgctgggattacaggtgtgagccactgcacccggcccaaactagattttttttaaaaaagcatgagtagataatagaggcttttggattactctgtgtattttaccccctccacttgatgtttaagctctcaggttggcctttaagacatagtacaaaaggtcttgtttgtacagcttcatgtagttgaatttaaatggctgatgttatattttaacagtctcacctctaagttctgagagtttttgtactagttaaacaacagatccaggagcaagcatcccttacttagccagacagataatactgaaataatgcagagtcattcttgtttatcatctaacttccaagaagctagaaatcaactattttctgatcttcagcaccttctgtctgggcagcagtaacctgtaaccctggcattttataattcttgtgacttggtcataaccaacatttgcagggggcgaagcaactgccaggccctggactgactaatgaatgcaaattatctctaattcccacacagatctccagagcagtttttgttatatcatttgctttacaaataaataaatggcctcagaaaggttgagtaactaacttggtcaggtacagtggctcacgcctgtaacccagcactttgggaggccaaggcggatggatcacttgagcccaggagttagagaccagcctgggcaacatggcaagaccctgtctctacaaaaaataaacagagttagccagagtggtggcgcatgcctgtaatcccagctacttgggagactgaggtgggaggattgcctgagtccaggaggctacagtgagtctatagtgaggctacagtgagctgtgtttgagccactgcaccccagtctgggcaacagagcgaaaaccttctcaaaaagaaaaaaagttggccgggcgtggtggctcatgcctgtaatcccagcactttgggaggcccaggcaggtggatcacaaggtcaggaattcgagaccagcctggccaatatggtgaaaccccgtctctactaaaaatacaaaaattagctgggcatggtggtgtgcgcctgtagtcccagctactcgagaggctgaggtacaagaatcgcttgaacccaggaggcggaggttgtagtgagccaagatcgtgccactgcattccagcctgggcaacagcgccgagactatgtctccaaaaaaaaaaaaaaaaaaaaagttgagtgacaaatatgtggcttcagaaaggttgagtaacttgtcctaagtcaaacagctagttaaagagaaactagcgttcaaacctggggctccatagctaggattaaacttcttcccattatgtcgtgctgacatctgagtactctagaaactagtgaaatactcatgtcttataaatgccatgtagggacagtgtgtcttagtctgtttgtgtggctataacaaaatacctgagatcaagtaatttataaacaacagaaatgtatttctcactgttctggaggctgggaattccaagatgaaggtgctggcaggtttggtgtctaataaggcctgttgactgcttccaaggttgcaccttgaactttgtattctcacatggcagaaaggatggaggaggaaaagggctaaaggccacattaagcttctttgattttattttttctaattttaaaaattttccactagagacagggtctcactttattggccaggctggttttaagctcctatactcaagcagttctcctgcctcagactcccaaggtgatgaagcctcttttataagacacaagacttaaaacaaaaacacaaaaacaataaattaagtttttttttggagatgaggtcttgctctgttgctcaggctagagtggagtggtgcaatattggctcactgcagcctggaactcctgggctcaagcagtactcctgtctcatcctccagagtagcagggactacaggcgcatgccaccacacctggctaatttttaaatttttggtagagacaaggtctcactatattgcccaggctggtcttgcatttctggcctcaagtgatctgcctgcatcggcttctcaaaatgctggaattacaggtgtgagccaccacactgcaggggaggagcccttatgaccacttaaaggccccacctcttaatactatcacattggttattaagtttcagcatatgaatctggggggcacgttcagaccctagcaccatggatagcagggaacaagtatgctgaggctcagaaggccctttaagggtaggatagagggatgtactttttgttgttgttgttctgtccctaaaacatttttttttaaaaaacctaaaaaaggaagcactgacttcctcctcccatgatcaaaaggaccaaagggggtcaaaaatagaagccatttggttgtgaggaggtagaaattgcttttcatcataatggtaagagttcaggaataatgcctgaacttggtgttattttattattcatttgtcccatttgtcacatgtcccagcattaggtatggggaggcgtgcaaaaaagtaaaacttgttctctgtctttgaggtaccgacagtctagggtttgagctctgagttctacattacgttcccaggaggcatggcggtgcgcatgcatgcaggtagagcatgggggtcatagacaaggcagcaaggagtgctttgttcacatgtaccttttgcctgtaatgcctttcacacttctttaatctctcgaagtccatttctactctcattgcttccatgaagcctttccacacctgttgcagctacaggtcattttcttctctaaaattctctcatacccattggtacctttaatttgttattcattatctcttgtaagatgttctatttcataatttcagttattgtctgttgccatttgaatagtaattttttttcatgacggttcagttcaactaatgttttaataggctataacgagaggagaggagacagaaaaaaataagacacctcatataccttatgccttgtacctgatatcttctggaagtactctaaagaaaatgagatagtacagtgaggaagagtgggaagactacttgagattgtggcgttagaggcctctttgaggaggtaatatttaagctgagctctgaataagggtaggagtcaggcgtgtgaagatttggtagcaggccgggcacggtggttcacacctgtaatcccagcactttgagaggccgaggcagaaggattgcttgaggctaggagtttgagaccagcctgggtaacagagtgagaccccgtctctatagaaaataaaaataaagttagctggacgtggtggtgcaggcctgtagtcccagctactgggaggctgaggtggatcacttgtgcccaggaggtggaggctgcagtgagctatggtcacaccaccgcactctagcctgggcgatacagtgagaagtgtcttaaacaagaagatttgaggcagaggaagcagtatgtggaaagagcctaatataggagtgaactctcagtaagtggagaggatgcgggaggaggcttgtatcttgagcactgtaagtggggaggagatggtagaagcggaggctggaaaggtaggtatagggccttgaggcatggccaggagtttgggcttcattgtaactggatgagaatccatggaaggttttcaggttgttacttttattttttatacgtaacagctatactgaatataaaatttgcatacagtaaaatttattctttaaaagtgtacaactcagggccgggcgcagtggcacacacctgtaatcccagcactttgggaggctgaggcgggcagatcacaaggtcaggatattgagaccatcccggctaacacggtgaaacaccaactctacaaaaaaaaaaagtgtaaaaatcagaggttttcctatattttacagagttgtaaaacgatcaccactatctaatttcagaacattttcatttctccagaaagaaaccctatacccattagcagtcactccccatttcccccttgccccagccctaggcagttactactctagttctgtttgtatggatttgcctattctggatagttgtatgttaatatatgtgactttttgtgtctggctgcttagcatgttttcaaggtttatctatattgtagtgtgtatcagtactttattcatttttattgccaaataatttattgaatgggtataccacattttgtttacccattcattccttaatggacacttgggctgtttcctgctatgggacatttgtatgtaagtttttgtatggatgtaaatgttcatttctcttgggtatatacctaaggatagcaatacaggttcatttggtaactcgacgtttaatagtttgtggaagtgcctgttatccaaagcagctgcatcattttaccttcccactagcaatgaatgaaggttcgtttcttctcatcgtcaacttttaccttctgataaaagaaaaacttcagccaagtttaattgagcaatgaatgattcacgaatcgggcagccctcagaatcacagcaaattcacagagactccagtacagccacatggtggaagaagatttatagacaaaaaaagagaaatgactacagaaatcggaattgagatacagaatggctggattggttacagctcggcatttgccttatttgaacacagtttgaacactcagcagtgtatgagtggttgaagtatggccactggtattggccaagactcagctattgttatagtcacatactcctaaattaggtttttagtcttatctacctaagccaggttgcagtttgtccacaagtgtaacctcccgatgggctcaccttgcctgctgcctagacagagcggatttatcaagacaggaattgcaatggagaaagagtaatccacgtagagctggctgtacgggagactggcgttttattattactcaaatcaatctccttgagcattcaaggatcagagtttttaaagataatttggtgggtggggcttgggaagtggggagtgctgattagtcaggttggagatggaatcatagggggtggaagtgaggttttcttgctgtcttctgtccttgggtgggatggcagaacttgttgagccagattatgggtctgggtggtgtcagctgatccagtgagtgcaggatctgcaaaatatctcaagaactgatcttagattttacagagtgatgttatccccaggagcaatttggggaggtttggactcttggagccagaggctgcatgacccctaaactgtaatttctaatcttgtagctaatttgttagtcctgcaaaggcagactggtccccaggcaagaaggggtcttttcgggaaagggctgttaatcaattttgtttcagagtcaaacccatgtactgaattccctcccaaagttagtttggcctacacccaggaatgaacaagggcagcttcaaggttagaagcaagatggagtcggttaggtctgatttctttcactgtcataatttcctcagttataattttgcaaaggcggtttcacaaggactcaaatactgaagtatggagtccttctcaggtcatatttagtttgctttaaccacccctccctccctacctttctctctctttcaattttagctaccctattgagtataaagtggtgtttcattgtggctttgatttgtatttctctgaggactaataatgctgaacttcttttcatatgcttactgaccatttgcatatatcttctttggagaaattccattcaaatcctttgcccattttaaaattggctcatttgtcttcttgttgaattctttatatattctggatacaagtcacttatcagatatatgatttacaaatattttctcctatcctgtttcacttccttgatggctcccttggaagcacaagtttttgattttgatgaagtccagatgatctattttttcttttgttgcttatgcttttggtgtcatagctaaaacaccattgcctaatccacagtgtagccattgtttttaaacatgggactgacatctgactcacattttgaatagatcactcaggctatttggaaactggggttgaaggttctagagtgaaactagggagaacagttaagaggctgtcagtattgacagacaaatgggtagactttaaacttattaagcacttgtaaaatcagtctattccaaaagcattttgttaatcagagtaagaaatggtctctaccttcaacaatttacaagataaaaatatactcaattattttataaagcaaattatattgagtgctataaaaataggaatgaaaacacttttttaagaacagtagagagaagagttacttgtatgaacttttattaagttcatttaaaaaatctctagtgtctaacataccttgcttaatagttgtttgttatacctctggacaaaagagttagagggctttgggaaagatggcattagaaccgagccttgaaggatgagtagcaggtggaaacatgtgaaagcagggtatttttgatgtaggtatcatgtctatgagtagacaattaaaattaagggaactttgtgaggtgagatgacacacaccacaccttttgtcccagctacttgggaggctgaggcaggaggatcacttgagctcaggagttcaaggctgtagtgcatgatgatcctgcctgtgaatagccactgcgttccagtctaggcaacacagggagatcccatgtctggaaaaaaaaaaaaaaaggaaccttcattgaaatctagagttggaggaattatatgtagagttggagcttacatgtaattccagattgagttcctcaaactccttttggtggctgttactcgtagcagagtatgatgtggattgtagtgggggaaaactggagcacagccaagatggtgccacaacagtttagatgcggtctagggtaacagtaatggataaaaggggaagtgagaggagtgggggtagtgatggcagtgtctgataggactgtaggagaatggtgggcggggcagagccaagtgctgccctttgaaggggtgaacttgaatgactgtgccaggaaagtagtcccatttaacacaaggagggcagtccaggcatgaagaggataatgagcttaacatacctgtgagaagtttcaggtggaggtatctggtggccttcggcacagcaagtggtaggcacagggagttggctatatgctgtagagaaaatataggtgggctttagaggcaggcataactctgcctccaccttttactggctttgtaaactttgggggaagttaattaaacttgattcctgagggtcagatggggtcgtctgtgtaaaatgcctggcaagtaggaggcttttctctattgtttgttcccttcttttctggagtcctaatgctttgatttcatttataatcttccttagtgaatgtggtgctttgaatggaagcacaatccagtgggatttaagctgtgtgtgtgtgtgtgtgtgtgtgtgtgtgtgtgtgtgtttaccacccagcagaggctacacttgctcactgtttgtaaaccccctattagttgtgctgtccttctattttcccttggacttctcttgtgttcagtcttgtccaaacaaaaatatttgcattaaagttatgtgtgttcctcatttggaagactccttgaatccataattgctttttaaattttttttgaaatagtcttgctttatctcccaggctggaggagtacagtggtgtgatcaaggctcaccgcagcttcaacctcccagactctagcaatcctcccacctccgtttcccatgtagccaggactacaggtgctcaacaccacaccaccaattttaaagttcttttgaagacgggggtctcactatgttgcccaggctggtcttgaactcctggactcaagcagttctcccactttggcctcccacagtgttgggattacagatgtgagccactggggcggccatannnnnnnnnnnnnnnnnnnnnnnnnnnnnnnnnnnnnnnnnnnnnnnnnnnnnnnnnnnnnnnntggaaggccaaggcgggcggatcacttgaggtcaggagtttgagaccagcctggccaacatggtgaaaccctgtctctactaaaaatacaaagattagctaggtgtggtggcttgtgcctgtagtctcagctactcagagggctgaggcaggaaaatcacttgaacctgaaaggcggaagttgtagtgagccaagatcacaccactgcacctccagcctgggtgacagagaaagactctctcaaaaaacaaaaatagaaacaaattatgtcattgttaagaggggcagttttctaagttttcctgtaggtctaatcggatggattttttttcaggatcttttaatatgctgggctgctgatatatctgattcaacttctggtctgctttgttttttgaactcagctgcttctatattttttcttctgcataactggtagaacagccaatgtagtctacaagagagctataaaatattgattgcatatatgagtacagtttcccagttttcttaaatggtaactataaatactgtctcaggacataatttagtttttccaaaagggagatagatttttttttttttacacttgtattactttagtggcttagtttaaaaaaaaaaaaagatcaaggatctagcttggagcacaaaaaaaatgcaagatctcctttccgtggagctcagttctgttttggttttctagggttcttagagactaaacactatgcataacaatgaatgtgttaattttaatgatttgttccatttcttaatgtcttagaattggaagggatttttagtcattctatccaagtggccattctgtgctggatccattctatagcagctgacagctaactcgccttctctggaaacaggctctttcattgctggacaggtctaattgttggaagatttttttcccccttatactgagatgaaagccagccccttgaaactgtcatccataaactgtcatccatttgtccaacttcagtcttttgttgtcacataaattaaatccgctagctcttcagataattgaaaatagttgctaggcagcacttctctgacttaagttgtctttttttccccaagaaaaatagccccagttctctctaccattcttcccatatcatttctaattctttttcagcctttcaccatgacccttttaaactgcaatgaccaccactaacaactggttaagtgtggtagaaccactgtagctttagtaggttactctgcatattctttttttttttttttttttgagacagagttttgctcttgttgcccaggctggagtgcaatggtgcgacctcagcttattgcaactccgcctcccgggttcaagctattctcctgcctcagcctcccaagtagctgggcttgcaagcatgtgtcaccatgcccagctaattttgtatttttagtagagacgaggtttcaccatgttggtaagtctggtcttgaactcctgacctcaggtgatttacccgccttggcctcccaaagtgctgggattacaggtgtgagccactgtgcctggccctgcatattctttttgtttgtttttgtaaagatgagggtctctgttatgttatctaggtgggtcttgaactcctggcctcaggtgatcctcccccgtcaggctcccaaagtactgggattataggcatgagccaccacatctggcctgctctccatattctattctctttctaaataaacacattatttggaaagtatttctgaacattgtcctgcagggcacactgtagctcagcctcataaaagcctacctaccatatttgagggtgcataccagggccgtttcagaacgtaccagctactccaggttactcaaatctgtagtcctgtcctttgagttgggccagagattttctcccttggcttatgctgaagaataagatggctatctaaaattaatggcaggacaaaaatgctggtagcatggtggaaataacacttagcctaggccaggtgtagtggcccatggctgtaatcccagctctttggcaggctgaggtgggaggaccacttgaggccaggacttctgagaccagcctgggcaatgtagcaagaccatgtgtctacaaaaataaaaacaattagccagctgtggtggtgtaccccggtagtcccagctactagggcggatgagatgggaggattgcttgaacctaggagttcaaggatacagtgagctatgattgcaccactgcactccagcctggttggcagaatgagacgctgtctcaaaaaaaaaaaaaaaaagaaaaagaaaagaaaagaaaaaaacacacttagcctaaatattgcaggatatcattcagcggtgaacaactcatgactgaatttccccaaattatctttatttagagtttatttggattgtttccacatatctggattttttaaattccagaactgtattgatttatgccaaatgacttagtgatgcaaagctcagagaggtagtgtggttgtatttaagagtgtaggctctggatttcgatcctgatttgaccaccctagctctgtgactttgggcagagtagccaatgttttgtgtttactcatttgtaaatgagagtaatgatagagctaacacacagggttttctagtattacacagattcatatatattgacagcctggccagggtgaggggagtgaagctgaggcactgtcccccagtgaaaagtttaagggggcaccaaaaacactcagtaatcaagataaataatagtttaatgtgataaaatgaacaacataccaaaatttcaaataaattccagatctggcctggtcaggatgagggtgaagtaagactaagtcaggcatatgtagggtcaggtcctattgttatttgaactttctgcagtttttttatcatggattttttgggcatgtttaaaagtattgcattaaagtattattttttcttggtcattagttgttcggttttgtgtgtgtgtgtggcccctcactcactccctcactctaggtggtgtgaggccagtgtattggtatttgttattagtgattactctagggttagttttgtagaggaaatgaattttagtgcctcatggaaagtccctcccacctccaggatattttctgttaggttgcgtcagagtcccaatccaaatctcataactaagatcagttttggccaggcgtggtggctcacgcctgtaatcccagcactttgggaggcggaggcgggcggatcacgaggtcaggagattgagaccacggtgaaaccccgtctactaaaaatacaaaaaaagaaaattacccaggtgcggtggcgggcgcctgtagtcccagctactcgggaggctgaggcaggagaatggcgtgaacccgggagacggagcttgcagtgagccgagatcgcgccactgcaccccagtctgggtgacagagcgagactccgtctcacacacacacacacacacacaaaaaaaatcagttttaaggtattagaggatgtcgttctttcttgtcttctgttaaatggtgctttgaatgtcatgtttcaaacactgctggagctcagatcccagaaaatgaaaaatgtgtgcacttagcttatgcgtagaggagcctagccaaaccaaacagcacgtttgaaacattgcttttcctttatggctgagattgtgaaagacagccacagatggtggctgagctctagctggaactgctgttagtcggcgcgagatgttctaagtgacgggagccaggaactcactgtggtgtttctagaagttaaattatgatgataggatcttcctgtaatactggttctgttccttgcctttagttatatcttggaaatctgtcacatggttagtgactagtgaaaggccaaaaaaatttgcagaatcagctatttaaagctttgttcttgatagttcaagtgttacgcaaggcaaagcagccctctgttaagggtttcaggctaggtgtctccttgttagggtgtcattcctgttgtaattattggtttgtcttgtcttcttcctttttttttttttttttttttgagacaaggtcttgctttgccatccaggctggagtgcagtggcacgatcatggcttactgctgcctccacctgtcactcaagagatcttccaacctcagcctcccgagtagctcggactacaggcacatgccaccatgcttggctaatttttttttttttttttttgtgcagatagggtctcactatatttcccaggctggtctggaagttctgggctcgagcaatctgcttgcctcaacctcccaaagtgctgggattacaggcataattataggccttttttttttttttggatatagacttattctgtgtttcagaaatagttgctttttttttttttttttttttgagacagagtctccctctgttgcctagcctgcagtgagtgcagtggcacaatctccgcactgcaacctccacctccctggtcaagcgattctcctgcctcagcctccctagtagctgggactacaggcgcccgccatcatgcccggctaattttgttttttcagtagagacggggtttcactaaattggccgggctggtctcaaacccctgacctcctgatctgcccacctcggcctcccaaagtgatgggattacaggtgtgagccactgcgcccagccaatagttgctcttaaaaggtcaggtaaaacgaatgttgttgatcgtttgcctaaaatatatagggttgaatagactgataatcaccatagcagctatcattggattttattaggtttaaatttatctgaagattgtcatgtctttaagtcgcaaagaagtggaatctaattatatacttagggctaggcatggtggctcatgcctataatcccagcactttgggaggctgaagtgggtggatcacttgaggtcaggagttttagaccagcctggccagtatggtgaaaccctagctctagtaaaaataaaaaattagcatggtggcacatgcctataatccccgctactcgggaggctgaggcttgagaattgcttgaacccaggcgcagaggttaaagtaagccaagattgtgtcactgcactccaacctgagcaacagagagagactccatctcaagtatatatatatatatatatatatatatatatatatatatatttaaactcattacacttcccaaatatatatatatttggaatgagtttaaaacgtaagctttacgttttttaaaacgtaacttttgtttgttgactgatgccagacgttgctgccttggtgaagtagctctactgcaccaagttaaaaaagttaatcgtctttaaagactgtaggtatcttctggtttagtgttaaataaaaagaaaaaagggaggggagattcttgtctcgaatatgtcaccttctttgtaccagtttttagagagcagctgtggcagctgctgaattatatatgcctgctttgttttcctccttttatttggcggtggagaaagtgtgacaattttaaagtgactctaaaattagtatatctggtggagcattcaatttcatgaatgtgctgtttggaatagcagtatggaatcaaataagatgcagagacttgggtatagaataagcttacgaatggaaatcaggggcctgatgcactacaggcggtttgatttatgacggaaacatcctcagatatccaggaactcatatattggaatagagacaactgtgggaatagattgtcctacccagaaagcaaaatctggcagagtttgaggtttcttattgggtaattttatcagctcgttcttagattaattagtagaataagacttccagagttgcaagatgaaatgcgatgctttcttctcttcttcttcgctatttctacttctgggccatcttggccagcaagagatttttttttttttttttttttttttgatacgaactctcgctctgttgcccaggctggagtgcaatgacatgatctgtgctcactgcaacctccactttccgagttcaagcgattctcctgtctcaacctctcaggtagctgggattgcaggcatgtgccaccaagcctggctaattttctgcatttttagtggagacagggtttcaccacgttggctaggctggtcttgaatgcctgacctcaagtgatccacctgacttggcctcccaaagtgctgggattgcaggcgtgagtcactgcgcccggcctagcaagagatttttgaaccacaagtcttggtcgtcagtattgaatcattatggtgtgtggcatggtagtggctgcaccatgtcggagtaaatgtgttctcatggtgggggatattagtgaccctgggtaacagtccatggcacttggcttgcaccacagagttaacatacagcagatcagctgtccctgtcctccagctttatataccgaattagaaagacttgggccctcatcctttactcagtggcttcccggcactccacaccacatctctaatactgggtattttctctggtcacctcttcctcagattgcatacttccctgtaatttttcacttctgcgtttcagtctttccttggaaaggctgccctttctgtatgacttcatcccatgttggacccgaccctccttctttccttctcccaaagcactactcatacctgtaatcccagcactgtgggaggccaaggtgggcagatcgcttgtgctcaggagttcgagcctgggcggcatggtggaacctcatctctacaaaatacaaaaataattagccaggcgtggtagcgcacgcctgtagccacagctgcttaggagactgaggtggcaggatcccctaaacccgggaagctgaggatgcagtgaggcataattgtgccactgtactccagtctgggtgacaaagggagaccctgtctcaaaaaaaaaaaaaatagactacttagctgaggtggttgtattaaggtttggggtgatggggattagagtctggcacaaggaagttgacatggcatgttagacaccggtgtcctaaaaacctatcagccattccccacacaccccttcagccactgcctgcccctcccctggcttaggttcagctcactgatttcttgctcttttcccttctggagagtctgctctttttctgttcctcagctttcaatcctccaataccagaaggatttggctttctaatccagaatagtttccctcttcaccctcaaccccccaaataaaccctagccttacctttattgatccaaaaactcattagtttttcctgaatgaagggcccagagcaaagcataggcagatgttttgacactctagttgttttttttttaacctgattaaatttttagatgaagtttattttcccccaagtctctctaagaatacaaggaactcgttttcttaattcagagactgagttttcttaattttctttcttaaattcagagaccgaatttccctttggcaaagacagatcctcgagtgtcaggacttattattatttttttcttggctacaatttgccttcttttttcttttaacatacctcatttactcacttaatttaaaaaatactgatgggatcctttgctccctgagcctttgtttaagtcactgagctcaacaagacctgcccttgaggtgttctcagttcacaaggggaaaggggaaagggacagatggttgaacaaagaatttcggtgtgagagaaattgcttgaggaagtgagcaaaggctttggacacagggtctagggagctacttgctgtagggcatgtgttaagagttcaggctttggaaccacattgactgggaagccagccaggcaagttactcaaacactttctatttcttcaaccacaaaccaagaataataatggtactacttcatacggttgttgtaagaattaattgagataatacgtacgagggagtatagaaagacttgacccaatatttgcttatttattttttctttttaaaatttttatggatatctatttttaatgtgctccatggtaggaattagcttaatcctgcaattaagtgaaacacattttaagaatgtataatattttctctttttgtgtgccactttttattttaaacaaccaaaatattggtcatgaccttcatttgacaacccctggtccagtacttcctaagtgtttcattactgttgccactggtatcgttgttcttgctggctgttgaaggatgattgtgtgttggcccgctcagtggactgcttgtccttgctgattgctgaggaggtcctgtcagaagagtgtccgcatcagctctccctgttcccgtttcccttccggaggttgctgagcagcacacatttttggagcccttgctgtagttctccaacagggcattgccagagttactacagagagagagagggaagactctcatgggcagcagtagcaatccatcctgtgtgagcagatggcactggagaatagcagccttgcttctgctgagctgcagccaagatcctgttcagagaggcagccaacaaggtgcatggcacagccggatagattcacactctgggccttgtgcaatggcaaggaattactatttgtgttgctttaaaagtgacattcctccttatcctctgaatgcgtctagtacttgggctgtgctcaggttacagggaggctgttctatggtttttacagagtaagaaaatccagagggcccctgagatttccaatgtaatcctactctgtagggctgaaagtgcctgctatggtggataccaaggcagatttccagaacatgagcttgaggagacggttaaacattctgggtttaaaactcttctgtgattttggcaaatctttcagattacttgccgttttcctatttgctcccttgcccaacttctgttgcattcatcccaatctgcttttctcctccgctgcttatataaagccgcgtgtggtattacaccagatgttcatggtgtgtttatgaatgcatgtgttcctatcccgggccaagaaaatacacttgacataggacgtccaaaattttttggcttatgaagctccagtatcttttactttcactacttatttaattttaaaagaaggttactgtactgttttattctttgaataaatatgaagggtgaaataataattgatctgctggcggaatgagaaagcctaaggaggaagaattgtctggatatcctttgtgcttagagattggatcaccttctttttcagtaatgccagcccctcccctacccaaagtcatggctgttgtccatgcatctttttatcttggctattatagaagcatacccactgccaacacatttctggaccctgggtacaaaattagactaagtgaatataaatatccagtctggctagagagaaaagagtgaagaggcctcatgaagcattggcccttattctcaggaagcgttctagggaaagtatggtagaaagaacactaaatgatgattcaggcctgagttcccatcccgactccacctctcacgttcagaacgggcataatgatcagttgatttcgctgcccgtgaatgccgggagactctccttagtctgtaaagtcccctcctcaccacagagatggaacctctgtggtttaaggaaagctggtgtggggaggctagtcctctacccttcacacaaggctccaaatgcagggagttgaagtgccaccacagagatagcagaggtcgaacggtctacctctctcttgcagatgaggaaacttgaggccacgataagtgaaatacattgctgtgttgagagtcctgtgggcagtgagctgaaagcagaacaaagagctgggactcctgattcccagcctggcagtagtagttcctggtgtcatatttgccattgcctcagtatgaagccattccagtatttcagtgtttttaaaaaggtattgtcccttgataaaatgcagatgtcaggaaataaatcacattacaaattctttcatttttaatctcacaattagtgattaagagatgcatatttgtactttcgagctcaaatctaggttaaataatttttcattttactattaatctgcttttgacttaggtgataatcgattgtgcagatcacagatttgagtaatgttggctacaacttcctttggttgaagaccaacaataattgccgctatcatgagctaaatattgcagactaaatgacaaaggaaaggtattgaagacgggtgtattccatatgaggtctctttttccctcagagaccagtgatcggtgacttgatgccacgagcatattagtctaatatccaaaggaacaaaaatgagtaggattatagtctttacagtttcaaagttttaaaaattatattaaataagttataaacctgtctttgttgtcttctttaggaatagcttacaaatccctgctggcttgggatttattaggacacttttagggtaaaatttatctgtgtcacacagacacccagaggagatggcacaaagagaagcagttgagttttgttggtgaagccttgtacaaccttccttgaggtgacttccgcgtacctatatgttaaaaacggtaaattgtttccttaatgctaaacttcctgctgcttctgtcagagaatactttggaatcctaatctcagaaatctttcagagttgactcatgcattttgtgggtgtttaagaatgtcagatagcttcaggaggagcaagcatccacttgttgggaacagacccttccttgttaagagatcaggcttgggatccaaacacaacctgtggtaatgatctttctgcaccaatttgtgtagactgaagcaacggttgtgagaaccaagggcaacatgcaccaaatgtccacttatgtagtctaatcaggtaagagaatgctttgcttaattcagtaattttcctcagttattcaaggcttgccaaagaatcagactataagatagcatttaaaaaaaaaaaaacattgctgcacatgatgtttcatttgttgagaagggttttctgagtcttaattgcctgaaagtcatgaccgtggctgtcaggggtgaacgatacaaaaagtaaggtatggtaaagggtgtaatgagaagttcatctaataatttgtagggtcctgtggatgggaaggtggaagagttcaaaggtatgataattcttcatctcaagtagagtggctcttgcttgactgttaagatagcctctggcctcaaggggattataatctgctctggaggatttgtaaacaatgtctgttccactggaggagtgaaatgtcaggtaaaggtacaaggccactgaatatgattgaacaaattgtgtgctgcacaggggaacctgcctaacgggtgattgacgcctgtattccaaccctgagtctaaccacccaccttgaatacttcagacacggctgactctgcctgcagaaatgagcataatgtacactcttcataggcacaatgtgcttactcaactggcggcctacagggctggcttttgcgcaaaggaacacctctgtagtacacactcctaatgaactaactctagacaatgagcttgcagatatcagatggatgcatgctctctctaggggacatatgagaacaatgatcacgcagagtggcttagagagacacacatactgcaaggcgttatatacagacaacactgtgtatacctagacagtccatatgcagacggtgaagctttttttcgacctgagttacatagaagcgaccacctctgtnnnnnnnnnnnnnnnnnnnnaaacattgctgcacatgatgtttcatttgttgagaagggttgcctgaaagtcatgaccgtggctgtccaggggtgaacgatacaaaaagtaaggtatggtaaagggtgtaatgagaagttcatctaataatttgtagggtccctgtggatgggaaggtggaagagttcaaaggtatgataattcttcatctcaagtagagtggctcttgcttgactgttaagatagcctctggcctcaaggggattataatctgctctggaggatttgtaaacaatgtctgttccactggaggagtgaaatgtcaggtaaaggtacaaggccactgcatatgattgtacaaatcgtggcctgttgaggggaacctggctaaggggtgtgtgaggcctgtagtccaaccctggttctgcccaccgagctgtgttctccggcacacggctgagtctgcctggagaaatgagcatcttgaaatgtgtgcatagccacaatgtgtttactcagctgggggcccacagggctgcctcttcccaaagggaacacctccgtagtacagacaccgaatgaactaactttagcccatgtgctggtagattacagaaggggggattaactctcaaggtaagataggagaaaaatgatcagggaaagcttcttagaggaacacacaaactgaagggtgtttcttccagccaacatttgctagcccttcagaagcccaactccagtgtgggaagcttcttttggacctgaggtcagattggggtgtccacctctgtcttctgttccgtctttcctccacgagtctgtagattgcgggagggtaggaaccacagtcgcacttgactctgtgcctggcacagacaaggggtcaaaggatgaatgataaggaaatgagggtgggaggtgaggttgagaagtagtttccagctagatcagagagaccttgaatgctatcctaaggagtattcatccatgccatcctacaagccaaggaacacactgtggtgtcagcaagggagcgacttgtgccaccttgtgtttttggaaggtctatcttggagttgtgtctaggatggattgggggagggagagggtctgggagagaggaaaggaagctgactggtgaggagatatggaattaaaggatgcttataatttggtaggaaacagccacatagaaactgagtttttagttagttagatacagtacctaaaggaagcactggttatacagagcaggaccaggtatttccttacagtcagcagctcggttctttagtaagaacctgtcccttttatacaggtgctagtgtcatatttcagcagcatgtatgctaacatgcaaagttgtttctgttcaagaaaatgctcacaaacattgagaggcagtgtgtagtggttaagaaaatggactggggccaacttgcttgaagttgagtctgggctgtatgacttattaactcagttactttgggcaagttacttaatctctctgtgtttcaatttccttatctaagaaatagggaatattataccctagacttcatagatatttgtgagcatttgatgagttcatgtatataaactttctagaatcggccaggtgtggtggctcatgcctgtaatcccggcactttgggaggcccgggcaggaggatcccttgaactcaagagtttgagaccaacgtgggtaacatgatgagacccccatctctacaaagaaaaattagccaggcatggtggcatgtgcctgtagtctcagctactctggaggctgaggcgggagaatcgcttgagtctgggaggtcaagtgtgcagtgagctgtgatcacaccactgcacttcagcctcggtgacaaagtgagaccctgtctccaaaacaaaaagaaaaaagaaatggtctagaacaacccttggcacatagacacaaatacttagtatctccatgttcttgaatgaaatttgcaaagcagcatcattccaagacctttatacatatgttaatcacatgcaactttcaaaacaaccctaagtgatattattcccattttattggtgaggaaacggaggcacaaacttgactgaggcaaagacatacgtgacaaaagtcttatagcctttaagtggtgccaggatttgaactcaggcagtctggctctaaagcgtatgtacttgaccaattatactggattcagaattttctttgggccaggtgctggggctcatgtctgtaatcccaccactttgggaggctgaggaaggaggatcacttgaggtcagaagttcgagaccagcctgggcaacatggtaaaaccccgtgtctactaaaaatgcaacaattagctgggcatggtggcatgcacctgtgttcccagctacttaggaggctgaggtgttttcttcatagttacccatagcaagtgtcagagagtgatttaaaactgtatttttggtatgaaggaaaagaaagtcaagctttgaacaaataccaattgaaaggtggatactggatgtctgaaatgagtcacttaagtgccaaaatgccttaaatttaagagtttcttccatgatttctgcctctaaaggactttgacatctatttttttaaccaaggttttttattttttaaagcttattttcttactggaagagattcagcagagtgatattagggataacttatagaatgaagtctttcttcactgtattttttcccccaaagtagttatttctacttcagtgccaaaatattcttacaagtggggagataaagaacttgcagcttgaagaattataaagctctacagttcatctttgaccaggccccttgagatgcgtgtatgtgtgtgcgcaggtgcgcacacacgtgtgcactgccattattagtgatgttttggcgaagggatgataccagggtgagcaaggcttctcctagttctgtcccatacatgcagtctgatacttcagggtagagtggtcttacaagggaattgagctcatttacaggaatcttactctcagcattttctgtagaacaatgaaaagaacattgagtaattatctctttctggtgacttagccaggcatcttgggaatttgctgttttgtgaacattcgttcagctctgtcttgtatatctagtttgccttcactttatagacagtcacaacaaaaagaggatacagatgtgtgggtgtgtgggtgctacaaacgataacaattttgtatctcccacccagcctaagaaacagagtgttatcagtaccccatagctcctttttccatctctctcctccagcactatcctgcatcttgtaatgattctcttgctttaccatatacttttgtatatgcatgtagccatcaacattatattgtataattgtgtctgtgttagactttttcataaaccagcaggctcctaagctgtagaattaagccttttttttttttttgagacagagtctcgctctgttgcccagactggaatgcaatggcgctatctcagctcactgctacctccacctcccaggttcaaggcctcagcctcccaagtagctgggactacaggcatgtgccaccatgcccggctaattttggtatttttagcagagacggggattcgccattgttggccaggctggtctcaaactcctgacctcaagtgatctgcctgtcttggcctcccaaagtgctgggattacaagtgtgagtcacagtgcccggccagaattaagcttttattatttttatttttgggttgtgccagtaaatgataggaagccattcttataacttgacgttgttttgataggccaagttgtcatctgtttgatgtcacctggccaagcaatctgaagaagatcacagatgacttctgatgccccctccctttgtggtttctctgacacttagggaaatgtgccacagcctggcacagagtagttgctcagtaaattttttattttttagaggcaggagtgcctctctctgttgcccaggctggagtgcagtggcgcagtcatagcttgctgcaccctggaactcctgggctcaagtgatcctcccacttcaatctccagagtcgctgggactacaggtgtgtgccaccacgcctgactaattttacattttttatagagatggggtcttgttattaatatgttgccccagttggtctcaaactcctggcctcaagggatcatcccatcttgacctctcaaagtgttgggattactggtgtgagctaccacactcagttcaagggtacgatgtttgtatctttagtgccttgtgtggtacctggtacatagacttgcagaaaattttggttggagaagtggtgtgttcagagaattttcagctgtggttctgagtgattggagtggctttggaatcgaggtgatgatctggggtgaaacaggagtagctctctcataggttactgcacagctgacttctggcatgtacttttcctttcctgtgtcacaaaacacacttttcattgtccttatgctggccccacctgcgttacttattgaaaaaagtatatgacagacagaaataagacattcagataaaaaaaaaaagacctcatttgcctttgcttaaagtattagtagttgagatttgatcctgagagactttcattccagttgatggattttacctaactaaagtcaattattttgaggtgttaatcaccacttttattaaaacaaatctttttgtctccagtgtcaagaaactaaggtaacctggttggctttctgtaaccctggactagtattttagagataatctcttcaatagtgaaaggtggattggctggcagattcattgtttgactaaacgctttcatttagcttgtgacctatagcctattcctctttcatagtgtatttatgtagaactttattggcagtgtaagagcctctatatcttaattgtgataactactgactgtttaattttctgcctgacacagagtaaaattccatgaacttttgctattgaaagcttttggtggattagtacccaatcccagtgtttaagactctgagctctggaacaggcctcatgctagattgatatagggcctggcacatagatgcttaataaatattagctgaatgagtattttgtggatttaaagagtattcaaaccacaaaactaaccataccctatattgtcagagggaacagtgtacctttttttttcttcccatttcaggaccaaaatcagccttttgtattttggatctttacatatttatttattttttctttcctttgttttattttgttttgagtcagagtcttgctctgtcgcccaagctggagtgaagtggcgttatcttggctcattgcaacctctgcctcctgggttcaagtgattctcatgcctcagcctccagggtagctgggactgcaggtgcacaccatcacgcccagctaattttttgtatttttgggggttttgccatgttggccagtctggtcttgaactcctgagctcgggcaacccacccaaccttggcctcccaaagcgctgggattacaggcgtgagccactgttcccggccaatatttctttctttttgagagtcattcagtccctgcagtgtttatgctgactgtcctgcatatttagggttgctgtagaatggattttgtgctatataaatatccgtgtgtgtgtgtgtgtgtgtgtgtgtgtgtgtgtgtgtgtatgtatgtgtctgtgttctcatggtttttctaaagaaatgtcatctgcttattggctcttctacttacaggtcttttctttttaaccagccttaagatgatgcagaatgtgagtccaacatcctactccttcagcagttgacagtgttttggcatatgtgctgccctgaatacagtgatctatttcagtctgttgatataaatgtggacagctttaatgtgtaggaattgaggctaacaaaatatctttccatatcctggaagcatgaattttggagagatgaccaacttaatagatagtcttaagttttgtgttatcgtataattttaaatgcggtattatcttaatgcacagtttaatagtcttaaatcctgaaaatttgtatattatctgatctagttagaaattgaaaatatatatttctcaaggttaccaagattatatctatttgaatttagtagtgattgaatggaataggttgttaagatgaattgccacaaaatttatattgttgtaagatatgtagaacattgattttcttctaatatacttaacattgtggatgataccatccatctatctttctctctatatgaacacataattttgttatatataatgtttggaatctgacacttcatctttccttttctgaagaaagattttttatatgtcgccttaatcattggtgttttgtttaatcttataaacacatgatggatttatttgttggtttgttgtgaaacttaagaaaaaggcaaagatagtggcctctttggggcaccctatatttattacatttatttgaatccttcctagtgttttctgaattatttgtgtgtgtgatgtgtgtgtgtgaacacactcaggattcagaagctgtgtgggaccatgtatgtgtgtccacagcctttctttggaatactgcttcagaaattagagcaggtaagtccatgcatgctatcatcagcatttaatgatgctgctttctcttccaagcaaactgacaagggtagatgaaggtccagttttccgaaatgggcctcagtcttctgacagggtgttttattgtagtttgctgttgtcatgaggtcttcattcagatgcggatatattaaggtcattttgctttgtctgaggatctttctgggttttcatggtagagattgagatatgtgggacaagtttgatcttgtatcaggttagaggacatgttgcttgccctgcttcagagaagagccaaagctggcaggaatagctgcaaaagtatgctgcacttagatctttcaattagtaaattagagtaagatgcctctggaagtcttccacagagttattttaaacttggggtcgtactgcttgtgttgaattaactcaaggttctctctcaaggggcacatgaaggtcttcctccactgcttctgcttagttcaggccttcatcttgtgcttggattattatcgcagcctcctttgcttccaccatgccacatccaaatgtcacatttccatgggcctgcgacccatgtaggcacgtaaggccccgtgcgtagtttagtgctctgctgttgtcatcttgaaattcttcattttccaacaagaggaacaccttcaatttgtactagtccctacgatttcagtagctggtcttggctctaggaatagcatttctaaaactatctatttaaaattcctcaaagttcacgctccatatcctgcccatctagcaccatctcttagtggtgggcttttctttgactgtcagtgcttgaagaagttcttccaggtataccaaatggccccacatctctgcaacatttgctgttgctgtttccttcttctcatttcccctacccaacctggttcacttctattcatgttttgaaatgctgaagaaataaggttgggctgtgaaaccgaatatgaccatcttttttttttttttttttgagatggagtcttgctctgtcacctaggctggcgtgatcttggctcactgtaacctccgcctcttgggctcaagctcttctgcctcagcctccccagtagctgggattacagataggcacatgccaccacacccggtaaatttttatatttttagtagagacggggtttctccatgttggtcaggctggtctcaaactcctgacctcaggtgatctgcccaccttggcctcccaaagtgctgggattacaggcgtgagctactgtgtctggcctaatatgaccatcttaactcatgatcacactttgcttgtatcatacctcttttcaaaaggttgctatctggtgaggttgggccatatttgattttgggataatggttctataataactctccaagatgatcatattgatttttgcaaggtaaaagaaaattctcctatcttcagggtgttcattcatgcaacatattttttaaatttttaaattttaatttaatttaacttaattttttgagacagagtctcgctctgtcacccaggctgtagtgcagtggtgcaatctcggctcactgcaacctctgcctcttgggttcaaactattcttgtgccttagcctcccaagtagctgggattacaggcatgcatcaccataccaagctaatttttttgtatttttagtagggcaacgagttgcccaggctggtctcaaactcctggccataagtgatccacccaccttggcctcccaaagcactgggattacaggcacgaaccatcagcctggcccatgcaacacatttttatgggtcatctaatatatgccagactatattttaagcactgaggatgtggcattgaaccaactgttttaacttttccttctttgagctaataatttctagtagagggggcagaaagtgaatgaacaaatacctcaatatataattagatctggagttctagaaaacaatgcaaaatacacattttggtctttcaccttggaagatgtgtatttgttgtttatctaccttaaagtttggtggatgagactaagaatggggctctgggcctggcgtgactattgcagagtgggacagcacccaggttgtcagttgctccttgcatcttttctgatagtgattgtttagacctagaacatagataccacacaggtattacccaagagaactgaaaacatacactcacacaatgtatatgaacattcactacagcattattcataatagccaaaaagtagaaacaacccaaatatccattatatgtatgaataaaatgtggcataaccatacaatgaaatgttatttagccataaataggagtgaaatatggatacgtggtacattgaaaacattaagctaagtgaaagaaaacagtcacagaaaactatgattccatttataagaagtgtccagggaggccgggcgcggtggctcacgcttgtaatcccagcactttgggaggctgaggcgggcggatcatgaggtcaggagatcgagaccacggtgaaaccctgtttctactaaaaatactaaaaattagctgggcatggtggcgggcgcctgtagtcccagctactcggagaggctgaggcaggagaatggtgtgaacccaggaggcagagcttgcagtgagccgagatcgcgccactgcactccagcgtgggtgacagagcgagactccgtctcaaaaaaaaaaaaaaaaaaaaagaagtgtccagggtaggcaaatctacagacagaaagattggtagttgctgggggcgagagggagatgagaagaaggagtgactgctaatgggtcagggtttctttctgaagtagtgaaagtgttctgaaattagggagtggtgatggttgtacaacattgagaatatactgaaagctgctgagtcctacatttaaaaatggcagatgttatagtgtgtgaattatcacaataaagctgtcataaaaaaatgctgggattaccttctatctgaaggtgaggatcttatgaagattaaatgaaatgaaataacataaagcacttaaagcccagtgcctgggacatagtatgcacttaattaatggtggtggttgtcgctcttgaagtaatacggtttaaatatctgtaagctggaacttttatttattcactgctacatctccagaatatgacctgttatggagtatgtagccaataaatataatactagtcaaatgaatgtggcttgttcacattcatgttcagtcacattcaccaatgtggctgtctttcttgttccgccttttgcagcatgttagtgaatctgcatcaactgggcctgtgttttgagctacttgtctagtggtagtactcaagagatatggagcccttcacagcccatctttcagtgcttaagttggggttgggggtacagactcagtctggggaggcaaggcttctacctaaattaaaggtgaaagtggggaggccaggcatggtgtctcatgcctgtaatcccagcactttgggaggcagatgtgggcggatcacttgaggtcaggaattggtgaccagcctggccaacatggtgaaaccctgtctctactaaaaatacagaaattagttgggcgtggtggcgcacatctataatcccagctacttgggaggctggggcaggagaatcgcttgaacccgggaggcagaggttgcgatgagcagagatccactactgcatccactctcgtgacatgagactccatacatannnnnnnnnnnnnnnnnnnnnnnnnnnnnnnnnnnnnnnnnnnnnnnnnnnnnnnnnnnnnnnnnnnnnnnnnnnnnnnnggctcactgcaagctccgcctcctgggttcacaccattctcctgcctcagtctcccgagtagctgggactacaggcgcctatcaccacacctggctaattttttgtatttttagtagagacggggtttcaccgtgttagccaggatggtcttgatctcctgacctcgtgatccacccacctcagcctcccaaagtgctgggattacaggcgtgagccaccgcgcccgacctacttatatatttttttgagatggagtctcgctgtcgcctgggctgaaatgcagtggcacgatcttggctcactgcaacctccgcctcccaggttcaagtgattctcctgcctcagcctcctgagtagctgggattataggtgcccgccacctaatttatttttttatttttattttttttgcgatagagtcttgctctgtcacccagtgcagtggcgcagtcttggctcactgcaacctctgcctgctggattcaagcgattctcctgtctcagcctcccaagtagctgggattagaggcacccaccaccacactcagctaatttttgtattttttagtagagatggtatttcaccatgttagccaggctggtctcgaactcttgacctcaggtgatccgcctgcctcgacctcccaaagtgctgggattacaggcgtgagccaccacacctggctctttgtgttttttaaaaaactgaattggtctgttgagaatgtgattctctctctttttttttttttttttgagatggagttgttgcccagactggagtgcaatggctcaatctcggctcactgcaacctgcgcctcctgggttcaagtgattctcatgcctcagcctcccgagtagctgggattacaggcatgcaccaccatgcctggctagttttgtatttttagtagagacagggtttctccatgttggtcaggctggtctcatactcccgatctcaggtgatctgcctgcctcggcttcccaaagtgttgggattacaggcatgagccactgcgcccagctgagaatgtgattcttagcattcattataagttccccagagagcagaggatttcatttgtggtaaaacacatacgcgtgcacacacacacacacacacaccccccacacatttagttcttagaaatgtacagatttaaactgatagtttgttctgctgaacctaactcacaatttctacatataggaaattaatgttttaaatgaagatagaagcagttttctcctgaaagtatttatgtggttttgttaaaacttcacatccttttatgaacttggcattccactaacaacactcagctgcttttacaactgtgtcagcaaggttccatctgcttatattgaggttgatgaaaagaagtaaagctgttgttgtttgtattatgtggcattctttttagatcactggaactttttttcctttggtctctgtaagaaatggttgtgcttctcatcttcctttagtcttctgtacattgtgtggttgatcatgttccttgttaccataaactgttgagaggctcagtgcccaatttgtggcctacctctaggaattatccagggcttctctttatcagcttttttatgtaccatcctgcttcttgactttattttctactcttatttttttcttgaccaatttatctttctttctttctttcctgctttcttggtttctttctttcttttttttttttgagacagggtctcctcctgttgcccaggctggcattcagtagtgcagtcaatgagcttgagctcactgcaagtgcaaactcctgggcttaagtgatcctcccacctcatcctcccaaagtaccagaagtacaggcacgagccacacacgtggccactgtttctttcttcctttttttggggggggggcgggaggaggggtggtgctatgctatctcaaagagctgcttttataattttttgggagataaatgtgttaaataagcaacagtcccaccttattgacgtgaatattttaaaaacttaaaacatgtctacaacttcctaggaatttcttcccacatcaggaaggatggagagaaggcaaaactaagagttggtaagctttgtgtttgggaaattttcttgaatacctctttttttcttgtctttttaatagaagttggtgagatggcaaagcagtatatagagaaaagtcttttggttccagaccatgtgatcacacgcctaatgatgtccgagttggagaacaggcgtggccagcactggctccttgatggtgagttgaaactgtgggtaaaccgaatttctgggaatagtcagttaaggtcttgcacactcccttaacttcttaccgaatggaaaatgccttattttctaaactttctgtcatttatttaatattgcaatttggcaacatgataggaacccattgtggtgaagcctcttatttcttctgtctccagatcaccatcatgagaaccactgacttgaagcaaatattcactaaatttctgttattgcttcagcccttttgtttccgtaagccatcctgagtataactcctcttcaatcagaggttctttcattcaccacagggcacacaaaatacaattatgagttattatttttcacctgtcagattaacagagatagaagatcggaaaatcctttattgagtatgtaggaaacaaatactgttgaaagtataaaatgagcaacctttgtagagcagttagcattatatatactttctgatccagcagttccattctggatttctgcctaaagatgcaaggaggtttatttcagcattattggtaaataagaggacattattactgacactataaaagaatcattatatatgtggtattctgaggacacaaagaagaaaattattctgttggtaggaggaggggttggaacaactgtatggaaagtgatgaatagatagatggtcctcagatagatgagtggggatagggaaggtaggtttttttttttcagcagagggacaatgtgaacagggtgaaaggggaatgagttatcttagtattttttctgagcctgcaagcagaggttggcagaggaaatcctggggtggatagcctttgattttgccataaagatggtggaactggattttgttggctttagggagcactgaagagttgttaagtaggggtataatatgatcatatttctctcagaaagactattctgttagcagcacaggagagattaggtgctggggcatggaggagagttgtgactacaaaccagagatcattggaataactggactaagggatgtcgaaggcctgaatttaagcaataatagcagtgggatggaaaggaggcaccattcataagagagtggattgaggaaaaagaattgataggagttgtggctgatgttaggtactacagccccagggttttcttttattgcctttcaggctttttgagtttctcagctttcatcaccctctctgcccttacctaggcatgttaatttctctagactctacttttaactcacagaagttagcccttttcttagtctgttttctgctgctacaacagagtactttggactgggcaatttataaagaaaagaaatttatttctcatggttctagaggctggaaagtccaggagcatggtgtcagcatctgatgagggccttcttgctgcatcatcccatggcagaaggcatcaaatggggaagaagtgcatgcctctgagagggaatgggagccgaacttatccttttatcaggagcctattgttttatctagaacccacttctgtgataagagcattaactcattcatgagggcagagcctttgtgacctaattacctcttaaaggctccatctcccataacatttcattgccaattaaatttcaacatgagttttggaggggacattcaaaccttagcattctgcccctacccacctccccctccaaaacaactcgtgtccttctcacatgcaaaatatattcattctatcctattagcccccaaagtcttaacttagcatcaactcaaaagtccaagctaaatcagacatgggtgagacttataaagtacaattcatcctgagacaaattcccttcagctgtgagcctgtgaaatcaaagcaagtcatctacttccaaaatgctgtggtaggaaggtgtatgatggacattcccattccaaaggaagaaataggcaagaagaaaggggcaggtggtcaccgataagtccaaaatccaacaggggagacattaagtcttaaagatggggaataatctctgtggactccatattctgcctcctgggcacactgggatgggagttgggcttccagggcctcagaagccccaccctctgtggctttgctgggttcaatccactcagcagctctcatgggttggagttgtatactggtggatttacagttctggggtgttgacagtggcccactcccatggctccattaggcattgccctagtggggactctggggcagccttgaccctacagttccactgggcattgtcctaatgggggctgtctgcagtggctctgttctgcaatagatttctgcctgggcctaccaggggcattcattgaaatctaggtggaggaagccatgctctgtaggtcttgcattctgtgagatgccaccaaggcttatccctttctgagcaggtggagccacgcctgaagctgtttgagttatggttgaggaggccaaggaatgctatccatcttctgaaaccattctaccctcctagatctctgggtctgtgatgggaggggcagtctggaagatctccgaaatgccttttaggtctgttgtccattgtcttgattgatagcacctggcttccttctagccatgctaatctctttagcaataggttgtttgaccacacacttaatattccctctggaacatgcttttccactctttacatggccatgccgagaattttccaaattcttctgttttgcttctcttttaactatatggttatccctcagtatctgctgacagtaaggggtgtgggaagggattggttccaggaccactccctcataccaaaatccatgcttactcaagccccacggtcggccctgtggaacccatgggtatgaaaagtcagtcctccatgtgcaagggttttgcatcctgcaaatactgtatgcatttgcttgcgaatgtggaacccagtgatatggaggcccgactgtatttattgaaaaaatccttggcccatgttgtggctcacacctgtaatcccaacactttgggaagctgaggtgggcagatcacttgaggccaggagaccagcgtgggcaacattgcaaaacctcatctcgacaaaaattagccgggtgtggtggcatgtgcctataatcccagctacttgggagctgaggtgagaggatcactttagcctgagaggttgaggcagcagtgaggcatgatcacaccattgcactccagcctggatgacagagtgagaccctgtttcaaaagaaaagaaaaaaatgtttgtataaagtgtgccctcagagttcaaacccgtatcttcaatggtcaactgtatttgattgtctctttgctctcacattgcattttatgcaattaaaagtaaccacacagcagcttgaaagctttactgcttaagatacttcttccaccacatatcctagttcattgctcttaagttttgcagtccataaagccctagggcacagacaaaatttgtcaaggtctttgtaaccgtataacaagaataacctttactccagtttctaatatgttcttttccatttctgtctgagatctcatcagaatggactttactgtccaattgctgctaatatgccagtcatgaccacttgagtaatttctttttttttttgagatgaagtctctgtcgcccaggccagagtgccatggcctgatctcagctcactgcaacctccacctcccaggttcaagcaattctcttgcctcagcctcccaagtagctgggactataggcatgtgccaccaagcccagctaatttttgtatttttagaagagacagggtttcaccatggtggccaggctggtcttgaactcatgacctcagatgatccgcccacctcggcctcccaaagtgttgggattacaggcgtgagccacaccatgcctggcccactgagtaatttctaagaagattcagaccttccctacagctcccctcttcttttgagtcctcatcagaattgcccttgatgcatcattcatggcaatctagggtgttactagccgcttcctccaaattcttcagcctctacccattacttggttccaaagctatgaccgcatttttaggtatttgttatggaaacagccccactccttggtatccattttttgtcttagtctgttttgtgctgctataacagaacacctcaggttgggtaatttataaagaaaataaatttatttctcacagttctggaggcagggaagagtaagacgatggttctcacatttgttgggagccttcttgctgtgtgttggaaggcaacacatgatgagaaggctcacacaagagagggaataaggggttaaacttacgcttttatcaggagcccactcctgagataaccaacccattaattcatccatgagggcagagctctcatgacctgatcatctcttaaaggccccacctcccaatacctttaaattggcaattaaatttcaacatgagttttggagagaacattcaaactatagcaccccccagtgctttttgtctgggtattcatcatgactgataaactttgactttgccaccacgtaacagtaatttctctagtttacatttttaaattgtgagtcttctcatcttgcaaaatgaatttgtatagttttagggaacttaaaaatctgtgtttaaaaaggatcatctgtgttaaactcccctggaaagagggttagtgtgataattgagagcatggacccgggtgctgccagactgcctgacttgaatccccgctctgccactttctggcagcctgtgtgaccctgggcctctggttgctcatgaaacacaaattagcaaagaggggcaaagtgagcaaatatatgtaaagtgcttaaaagagtgcttgccttatataagtgctgtatgagtgtttgtcattattttgtgactagtgtacaggtcctgaagttttttgggtgggggtgactatttgaagtgttcacttcaaaaatagctctaaaagtatttagccaggcagaataaaagtcagtttcagttatggaatgttttctctatcttttcagtgcttgcttttgccatgacttcctctcagggttgaataactgaagttctttgacatcataggcctgttttagtaaagtacgtcatcctcccaagtgatttggttagtatttttctccttgaaaacccatctggtcactttttcagttgcgatttttctttaaagctctggaataaatccatttggcaaggtgtggagtgcgagggatgcctggttcctatgttcagctttagactccttatgttacacaggcacatgctctgcggaggacgtgcctgttgagcgtgctaaaggtgattgaatgtggaaaggtcgaaaaaggcattctgatgacagatgactcatcatcttggtccatatggctgtagagaggcatcctgcaaatggtgggtggaaatgagtagagtggatccaagccaagggaaccccaagtggggatgtggggaggggagggagggtgagtgttctgtggtttggtcagctttgctcttgctaaaaaaaaagttcagcactaccttcccttcaccgtgctttccagttgggtaagaaatattcttgttttgttttgttttgttagagatggagtctctctctgtcacccaggctggagtgcagtggcatatcttggttcactgcaacctctgcctcctgggttcaagcgattctccttcctcagcctcctgagtagctgggattacaggtgcacaccaccatgcctggctaattttttgtatttttagtagagatggggttgcaccatgtttgccaggcttgtcttgaactactggcctcaagtgatctgcctgcctcggctgcccaaagtgctgggattacaggcatgagccactgcacctggctaatttttcacttttttaaaaaagggtcacatattagaccgttttcacactgctgataaagacatacccgagactgggtaatttatacaagaaaaagggtttaatggacttacagttccacgtggcttgggaggcctcacaatcgtggcagaaggcaaggaggagcaaatcacatcgtacctggatggcagcaggcaaagagagacagcttggcagggaaactcccatttttaaaactatcagatctcatgaaacttactgactatcatgagaacagcacggaaaagaccagcccccataattcagttacctcctaccaggttcatcccatgacacgtgggaattgtgggagctacagttcaaagatgagacttgggtggggacacagccaaaccacatcaggccagcagtgaggtatagccatagagagagatgtattagtaactgtttttttcgtttctaaacttgcctgcttacttgtgccttgaaatagtaatctagaagttccccaaatcggttctaatttatctttgtgtaccaagatgtagtagaattatctgccatatgattttaggggtaactatcaaaatattttaaactggtatttcaaagtttggttttgtagaaaacaaccttaaattttggaattgtaaatgaaatgtaatttaatccttttcattggtaataatgataacctttagcacgagagtcatcattttgtccatagttgtatttagaacctggtttgtttgtttcattctgtgcaatgttgaacactaacaagtgctttctgaaggtaattctgtttttagcataagtcagagttgtttgaatgtgtgcagtgtttgtgtctattttccctgagagctaaatgatttcagacttgagatgttcctggctacgcactcacttagagcccttggtgtaggtgtatgttcagaaactaaactatagatgctggagccagagtattttgccttgattttgcgaatgtgttttaccatacgaggctagtacataacaactctgaccttatcctctccacatttttccttctgattcagacctctgaggagtgtcacatcccactgggcgacatatgtctatagaaaaaagccaacagtatcttctgaatcacatcttttaggaaatgccaagggtaattttttttcttctgttgcccttgtgagtctagggtatctttcaagaataaagtgtataatagatttgtttagaaggttactgaagaattctgctttcataattaaaaaaacagctttttcttcctgtgtgtatgtgtttatgtgtaggagggcagtagtttatcttagtcatttatctttaaatatttagccctgaaaaatcatagccacataacccttctatctcaggttgttactaaggcagtgatgtatattctggtatcttgaatggaaagtttaaagcaattgtggtgatttctaaagaatgaagaatagttgtaaaatttgtggagctctactagggtgctgtggccatctatgcctgccaaatgtggattgcacaattaaaatgtttggttcctcactgggattgttcttcttgacataaccatgatttgcccctctcattgtagctctgttcattcagtaagcattattatatctaatgggtcctgaatatttctaaagtgaataaagtgcaagtatgactaactttgcactaggctggtgacagtgaagaagaatgtgtggaaaagaaggattagaggtagactaagcttgtcagggagctcctgacataggagggttcagagacatatattcagccacacatggtacaggtgaggtgttccaagaggtaagtggaatgatttttgcaagtaaggagtggcatttttggtcaaaatgattgcatgaaaaaagatgggtgtgtgtttagattagtcttagcgctacatttttggaaactctatccatgccccaagacaatgtaaatatgcctgacagtttttttttttcatcatccaaaattctgatttgaggagacagttgggtgtggtagcttatgcttgtaatcccagcagtttgggagacagaggcaggaggatcacttgagcccaggagtttgagaccagcctgggcaacacgatgaaagccctctctacaaaaatatagaaaaattacctgggcatggtggtgcatgcctgtctatactcacagcttgtcagaggctgaggtgggaggatcacctgagcctgaacctggggaggtcaaagctgcagtgagccgagattgtgccactgcactccagcctgggcaacagagcgagactccgcctcaaaaaaaaaaaaaaaaagaatttgggcagtgacccttagatgaatgttattttctttgttggcattttcccccctggactttgaaggtagagtttgatcaaggcatttctttactgtgtgtttgcatgaaggatcagcagttatttgttgagtttggtttgcataaaaaaattatttttgggctgggtgcggtggctcacgcctgtaatcccagcactttgggaggccgaggtgggcgagtcacgaggtcaggagttcgagaccagcctggccaacatggtgaaaccccatctttattaaaaatacaaaaaattagctgtgcgtggtggtgggcgcttgtagtcccagctactcgggaggctaaggcaggagaatcgcttgaacctgggaggcggaggttgcagtgagccgagatcgtgctactgtactttagcccaggtgacagtgcagtagcccaggcgactccatctcaaaaaagaaaaaaaaaatttgtaaccagataactgtaacagtgttcccctgaatgctgtgtctttaagtttgtgttgtaaagtaggtttgacaatttttatcatgttagaagaaagaattgtaaaacccaagacctatgtttgattatatagcttgagtatctcttatccagaatgctcgggaccagaagtattttggatttcagattttttggattttagaatgtctgccttatacttactggttgggtatctctaatccaaaaaaatgcaaaatctgagatgctccaataggcattttctttgaggatcaagttggcactcaaaattttggattttggagcatttcagatttcagattttcctattagagatactcgtactttctaacatgataagtatttggatattctcaaataaaataatttgtagacatataattaatttcaagttaaatagtgcactaagagagaccacatgactttgctagaagaagatgggcaataagaagaaagtgtatctacttcacataagactaggtaacaggtttttgttttgttttgttttgttttgttttgttttgttttgttttgtcagaattttgtttttgctgcccaggctggagtgcaatggtgcgatcttggctcactgcaacctctgcgtcacgggctccggtgattctcctgcttcagcctcctgagtagctgggattataggtgcctgccactatgcctggctaattttttgtatttttagtagagacggggtttcactctgttggccaggctggtctcaaactcctgacctcaggtgatctgcccacctcagcctcccaaagtgctgtgattacaggcgtgagccaccgtgcccggtctaggtaacagttttctaaacagagtaatactggttgaattacacaggaaataccactattcagtggggttaagttatgaagagacatttgggtgacatgtgacctgaaattttagcacactgccatcttcttacacactttatccaaagtacacagcctgatcagactttgtatctagctgctgattgcactgaagctattgcaactcctttgttaatgctcccaggtgatcgcatgcatttcttctggtgctaagcattcataattttcgataagtatttattgatcagcagctgtgtgccagacaccacagtagagcaacaaagagactaggtggggcctggctctcctgatactcagaatccagtggtgttttcagctgggttttgtttttttttttttgagacggagtctcgctctgtcccaggctgagtgcaatggcgcgatcttggctcactgcaacctccacctcttgggttcaagcgattctcctgcctcagcctcccaagtagctgggactacaggcagtgccaccacgcccagctaatttttgtatgtttagtagagacggggtttcgccatgttggccaggatagtctccatctcttgacctcgtgatctgcccacctcggcctcccaaagtgctgggattacaggtgtgagccaccaggcccagccagttttcagcttttttgctaccctaggcagtgagggttatctttaatttctttaatttaaatcaaaaccctgataactcactttttctcttagtgacttttcctacgttctgcacccttgctgtcaatatgagctcagagtagctgactgaaaaacatgataaagccttggatctcttctctttctcatttgttatagattctgtcctgcgttcgtgtcctccatgtccatttccagtgtttttcttctgattgaactgactgctgctttggggtgaggaacagttgtaccacagtatagtagacaatggtggcttatcttatgtgtgtctcagagattgactagattttaacattaaggaacattaaggggacaatatggaaaacatatgtatacacatatttgactggaccctagcaaagcttggttcatggatcaataaacaaattgagtatacattttttgtgtcttgataagctaggcatccgtcattcccaagagggagtagcatgcttcctgacctcatagtccaggagtgccgcacaaatggttgcagaataggtagggtcttgggagcaccagtgaagagagagtgaaaggtgatggctggcgcagagagggaagtaactgaccctcttttgaaggtgagggaggcaggtattaggaaggcttcctggagaagctgacacccagaaccataattggaaggtgggaatgaagcacattttagagggagggaagatcacatggaaaagctctagaggtatgaaacaacatggtgtattctggaaaccacaagtagttgggtaaccctggagctaaaaatatgagcagatgaggctggacaagtggacaggggcaaaagttaacctttcatgaaatttagaaacagggagttgagtaagcatcaaagttaatattaaaaatgagggggagttaaaagtaaaatttaaaactttgagtttaaaagtgtgaacaacatatttttaaactctacttccaacatttaaaaattaactggattggctgggcgtggtggctcacgcttgtaatcctagcaatttaggaggctgagatgggtggatcacaaggtcaggagattgagaccgtcctggctaacacggtgagacccccacctctactaaaaatacgaaaaattagccgggcgtggttgcaggcgcctgtagttccagctactcaggagactgaggcaggagaatagcacaaacccaggaggcagagcttgcagtgagctgagatcgcgccactgcactccagcctgggcaactgagtgagactccgtctcaaaaataaaataaaataaaataaaaattaactggattattaaccttttaaatttagatctacatttgacattaaactgtggtttctctgtatttgggtgtgtcttgacttatatgttcagatgcacctagcccatttgccattgctgcttaattagaagttgataaagtaaggtacaggatgaaatacttcaactcctaagtttaggtgttaggagaacctgcttccctaatttatgaaacaggtaattcatccagttcctgggaattggatgaattaagaaaattcattacaaagcatcattcaaggcatttgagggcatactttgctaattgctaatttaataataattattgtgcacttacaatgcacaaaccatgatgctaagaagacattaacatggtagaaaaagcatgggtttatgaatcagacctgaatatcagtctgtaacttacaagctgctgcgtagtcttttttttttttttttttttttttttaagatggggttgtgctctgtcacccagactggagtgtagtggcacatcatagctcactgcagcctcaaactgggttcaagtgattgatcctcccatctcagctccctgagtagctgagactacagatgcaggccactacgcctggccaattttaaaacttgttgtagaaatgggattttgctatgttgcccaggctagtcttgaactcctatcctcaagcaatcctcctgtctcagcccctcagagtgctgagattacagtcatgagccactgtgccgagttgtatagtcttgagcaagcaaagttttctttcttggattctttttcttcatccatgaaattagcacgttcatggcataggtttgtgaggattgactaacaaatgtaaaactcttagtggagttctggaaaataggtcatcaaatggtagacatttgatattattatttattataattgattttaagctccaatagaaataccttgatacttacatagatgttaggacttaacatttcaataataacttactgagaaacttcacaaaaaatactgtcattctaatgaataaggatcaacatattcacccctcataaagcacatttgggcaaagcataaaaccacccctcttggcctggcgcgatggctcacatctgtaatcccagcacttttggaggacgaggtgggtggatcacttgagatcaggagttcaagaccagcctgaccaatatggtgaaaccccatctctactaaaaatacaaaaattagccaggcgtggtggtgtgcacctgtaatcccagctacttgggagggctgaggcaggagaattgcttgaacctgggaggcggaggttgcagtgagctgagaccgtgccattgcactccagcctgggcaatgagagtgaaattccatctcaaagaaaaaaaaaatcacccctcctccattaaaccttgtgtagtaatgtaaaacaaaacaatgtaaaactcttgattgtcctgtcaccagtaagagaacccagattttggagagatggacaggttgattagggctaaagggagaatgagatgtggaaaactgcagagaatttaattttatctttttctgtaatacatgatcactataaaacatccaagccatatggaaaaatgcaacggaaagcaacaaatcacctgaaattccaccagccagaaacaaccagggtgaacagttgaaaagcatcattctagatacctctctgtgcgcatatgtagatggaaatgtgtaagaaggcatcagactttatatgctttaaaaaagtatttaatcttactgaatttttttttttttttgacatggagtctcgctgtgtcgcccaggctggagtgcagtggcacaatctctgctaactgcaacctccacctcctgggttcaagcgattctcctgcctcagcctcccaagtagtgggattacaggcacgcaccaccgtgactggctaattttttacatttttgatagagacagggtttcaccatattgggcaggctggtctcaaactactgacctcaagtgacccacccgctttggcctcccaaagtgctggaattccaggcgtgagccaccatacctagccttaattttactcaaatttaacagtaacaaaactaaagtgaacctgaaggagttattacggagcttcagataaatctttgttcatcaccaaggatattaattcctgtgagagctcttcaacattataaaagccactgggagactgacatatttgttttcttttgttttaaattcacatttcaaatttagacaggaggcattgtctccacagtgaaccctgagggaacttatacttcctttaacctcctcttacccttcgtctctcccagtttttgttggcttttgtcattaaaaatttattacagttttcttctgcaaatgtaattcctcagtttcttacattaaaaaaatttaggtgaattctgtgcactggttcttttacccacctctactcattttattttgattaatctcttggttatatctctgtgaatatactagaaatcattgaaatgtacactttaaatgaattaattgtatggtacgtgaactgtatctgagtaaaggtgcactgctgtttaacacagctttttcattcaacactgggttgactggattttgctggatatttttttcgtccctccctcctctcccctccctgcagaagagctcataatatgtttgagaatgtctaattttttaaaattagctaactgatatttttgagttgttcttgtgtctttcaaaacattgcaaccattgttacattttcttctggcctggttccccattttattttatttttatttgttaaatagagacaggtcttgctctggcacccaggcaagagtgcgatggtgcagtcgtgttaatagcttgctgcactctcaaactcctggatcctcccgcctcagcctcccaagtagctaggactacaggtgtatgctgctgtgcccagctagttttttattttttgtttagacagggtcttgctatgttgcccaggctggtcttgaactcttaggctcaagcaatcttcctgcctcagctctccaaagtacttggatttacaggcgtgagccactatgcacagcccttttccacctgtttcaaggtgattttttttcaccccgtatagactttctaaagagttatttcttcatacttgaagtcagtagaataacttgatgttgttgttatttatttatgtcctatatagagtgtatcctcctgatctgcaattcagttctttcctttcagggaagttttcctgtgttatatcctttttgtcatttgttcagatttctatttcaataatactagttatattggatattctattgactattttttgtctttatactttaaatttttcttgcttctgtgtttccttctactttcaggcacactcatatcttttattttgagggcaggagagaatgaaactttgtttatattccataactgtttgattatttttcaacctgtatgtgccatgcacctgtgctgtgggcccttgcacttactgttccctctaccggcagtgccctgtctccagatatccgtgtggatcgctggatacagatccctacacagataacccttcctcagaaggtctgtcttgtaccattctgtctacctacgtcactctccttacattattataatgtgacattatgtatttatgagcatattcgattttccattcctcccctatccctccacccccagtgcaggccccagaaagcacaggttatatccattttgttcatggctatattgccagtacctataacagtgcttggcatatagtaaagacttgtacatccagttgcagacaggtcatgcctgcaatctgtagctgagcctttagaaggtatacttgaattctgttacttttctggggataaaaatatgggcctatggtgaaatcatttacaaatttctttagtcttaattgagatacagtgggaccggttttcccctaatttgtgtatggggacttatattcaaagaacaagcaagcaggccggacgcggtggcttgtgcctataatcccagcactttgagaggccaaagaggagaatcacttgagtccagcctggttaacaaagccagaccccatctgcgtgtgcgtgtgtgcacgtgcgtgcgcacacacacaaacacacacacacaaaaccaatgtccaggtgtggcgatgtttgcttgtagtccagctacttgggtggggggtggctgaggcaagaggaacccttaagcccaggagttagagattgcagtgagctatgatcgcatcactgccctccttcctgggtgacagcgagaccctgtctcaaacaaaacaaaagaaacaaaccacgcagaattcttaaacagaagaggctttaagcaaggggtttgtagatgacagctccttcctcaatggaatatgcattttcccttatgggaaaagggctcagtgattttagtataacttacttaagaacaagggttataaggtaacagttttatctgtgtctttattcaggaaaaatcctcgcgatgatcccagaggatctcagtgaagccatttgggaatttccccaagaattcctacctgaaaggaatttatcttttatttccctaagcctctttgaagatgcacacttgtggtttaaaaccaaattttctggagtacttatcttctgcttatcagtggatcaccaagtagtgattgtagcatatctaggtttttaaagtctttttctttttctttcttttccttcctcctcccttcctccctacctcccttcttgcctctatcttgccctgtcacccacgctggagtgcagtggcacgatcacagctcactgcatcctcagtcccttgggcacaagaagtcctcccatctcagctttggggtctttttctattaacctataagcttcctgagggcaggacccacttatttcaaatctcttaaaccctgggatctataactagtgtcccaggaagctgccatgagcaggaagtgggttctagagctctcagcactgtggggagtgtggggctcacagagtggtaggaggaagcataaacttcagttgctgacatctggagcacagctgctgttttttttttttttttccttctactttcattttaggtttaggggatacatgtgcaggttcgttacacgggtaaatttcgtgtacagatgatcctgtcaccaaggtagcgtagtacctgataggtagctttccaacctgcaccctggtcctggttcaagcagtccctgttgtctgctgtgcccacctttgtgcccatgtgtattcaatgattagctaccccttataagtgagaacacatggtatttggttttctggtcttgagttagttctcttaggctaatggcctccagctgcatccatgttgctacaagggacatgatctcattcttattacggctgcatagtattccatggtatatggaatatataccacatttctttatccagtccatcattgatgggtatcttggatgattccatgtttttgctatggtgaatagtactgtgatgaacatacaagtacatgtgtctttttggtagaacaatttattttcctttgggtgtatacccaataatagttttgctgatagtcgtaagttctttgggaaatctccacagtgctttccacagtggctgcactaatttacattcccactagcagtgtgtaagtgttcctgtttctctgcaaccttgctggcatttgttgtttttttactttttcgtagtaggacagctgctgcttcttttcaccatctgttaataataactggatgacatggaatatggaggtctttgatacatgtacaaataaacattgtgtaaacagataaggaaagtatacgataggagagagaaaaggcctttatgaagcaggttttggtggtaattaatttgctactaaggcttccagttggtgatgtgagtgatttgaactcctgggctagggaaggctgtggaagaataaccaaccacctgctttcaactttaagctaatcatcagtgattgattgtcatgaacaatggcttgcatttgtaacttggttcttacttattcaacaactgggaagagatgggcggtccgaagcaactatgttagctccagatcttaatggaggtaggaagggggctgatgtcgcatagccttttcacaagctgccaaacccaggcggatgttggaagttgcccttctgaactgccctttcatttccatcaggcggagggcttgctttgctgcctgggaacgtggtggtggactctggctctgcacccttcctgcagagtgaatgcgctccaaattagaaaaacagaagtgtcctactttctattccccaccactgcctcagcttgttgccgcagcacctcctgcttcagctgcccttccttgggttcttggcatggctgggaggagcaggtgccaaggcccagtggccagcactgctgggaacacaataccagtcaggaatttaatgatatctcactgcacttagtaaatattttgtggggggggtcttaaaaaaaacaacctgtagatgtcataattagtgatataacaagacagattctggaagaaatttaaaaatataaaatttcagctttcaatctggattggctgtttgaatgaaaagagtgagcagcttttctaggcttggttaggggatgaaggatagcgatagtctggtgtggaagcatgataaagcatgcggtggaacagaccctctgaggagctaaagggaggaaagcaagcagtccatgcttaaacatgatctttattttacgttagctcttggcatttctacttcttcaacaattaatggaatatattcacatttggaatgggctaattaaggaacctagaataacgctagtcagtcatttagaaagcctttcttggagtgttacttttagtaaatgtaaaagcatacttcaacttgtaattctctctaaatggaaaaattataaatgctgccacctgttgacaaaatttgagggtgcattctactccagttggtcagtgatccctgccgacaggggatcttactggctggataatgaccctcagctaaaaatgctttaaaatgtgctggtctgactgtaccttatctgacattctgttcttggcggctgattggtgtgagaagtacacctgaattgctttgatttgtttagcccaacttgagacacagatgtagatcaatttaaagaatgctgaagctcccatgctaccttatagaatccatcatttaagacaccatttcatattgtatgccctgaagccttaaagtggatctgtggctgaaaagtatgtttttctttttcttttttttctttttttgagataagagtcttgctctgtcacccaggctggagtgcagtggcatgaacatggctcactgcagccttggcctcctggactcaagcgatcctcctgcctcagcctcctgagtagctgggactaaaggcatataccaccatgcctggctaattttaaattattttgtagagacaggatctcactttgttgcccaggctggtctcaaaatcctgggctcaagtgaaatcctctcaaaatgctgggactgtaggtgttgaccattcttctcggctgagtatccatattttaaaagtcttgtagatgaataaatactactacttacttggtagagcacttgcccttatgtctagccagagtgagagagagccccttttcaggacctgtgacacagcaccccaaactttggaggcagccttagcctatccccagggcctctgtgaccattgctgggtctaggacaccacactcgccctgaaagtggcactctttgaggccagtcacttccaactctgcctttcatttctgagaggaaggtaagccatcctcctgttctcctttcttttatatccgcttcggtttctttattattgattcccctcctcaccgtaccctctggaatcctttttccttaacagtttcccccaccctcctcgccacatacacatgctatttgcagaagtctccactttctgtattaaagaaaacctagatttccccttaggatgctactttctttcttgtcttttctgttaccgaggactttctcctatgtgaaaatctcatgttgggtgatggtggtggtggtattattattctgtctcctagtgtgtctttcatccttttctaaaagctcaaatctatctttatccttcatatctttcttctcaaacctgctgtttgtctttttacctccagtcccacattgccttcattttttcccagtaccgtccgccccctgccatgcaatttatcctgagccagccactattctggaatttacatatagtaatttgcttatttctcacaatgactttatgaattaggtattactattttcataggcacagagaggttaagcaaccagggtcacaagtaagtggcttagctggacctcaaacataggcagcttgcctctggatctatattcctgtgaatcaacttttccttagtcatgtgtttcaggtcatgtgcaaagatgctcattgcagtatgactggaaacaacttggatgtccaccattaggggattggttaaattatgctctatctaaaccatgctgtactctgcagttattaaagagaatgattcccagcactttgggaagctgaggcaacaggattgtttgaggccaggagttcaagaccagcctagggcacaaaccaagaccctgtctctgcagaagagaatgagacagtaatatgtaatatgaagaaaaaaatctccaaagagaaaaagcaagatgcagaacatttgttgtgtgtatgtggggagaaaatctggtctgtgcgtgtagcactggatcaggcggttcctgaagccatacaagatttagatttctcaagtcgttttgtaagctgcctgtcagagacatcaggatcaggcatttctccctgtctgagaatttgcttctcacagtctgcagttttctgttcaggaggaagacagcatggtgtggtacatggcgtgtgattgtagagacaaatagcacttgatttaaagctagattagtcacttatcatgtgatcttgagcaagtcacttcacttttcccagcattggtttttacagttttaaaatggggataaggcctacctgacagaattattgttacttttgagataatatttactcattcaacaaatattttcattcggcacttactgtgtgcaaagcacgcttacagcactaaggttatagcagtaaacaagaacttaaaatgttctactctaatttagtttacttctggtaggaatagaaacacttaaaaaataaggtaaatcatatatggcaaatggtgatgaatattctgaaggaaaacaaaaagaaaataaagggtgaataggagtgttggcgtgtggtagaggtgcagtttaacaggacagttagaaaagtcttaacaaggcaccactggagccaagatttggaagagctgaggatacacatgggtatctggagcaaaagcagagggaatatgaactgtgaatgtccagggtgggcacctgcttgagagctgcaaggatgccggtatggctggcacggagacgtggacagagaaatgaggtgagagaggtggcaggacaggggcccagatgggtaggcctttgcaagcctgtacaattttggcttttcctctgcatgtaatatatctggcacataagggatgctctacaaatggtaactgtgttataaggatgccaccatgatgccctgctttttaggtaggtagaagaaagatagacagggtaacattttaggattcttttttttttttgagacagggtttccctgtgtctcccaggctggaattcagtggcgcgatctcagtgcactgcaacctctgcctcctgggctcaggtgatcttcccaccttaatctcccaaagtgctgggatgagccactgtgctcagcctaggatccacccatgctcacccacccaactttttattttattttattttattttgagacaggatcttggtctgtcacctaggctgtagtgcagtggcacagtcacagctcactgcagcctcaacctgctgggcttatgcaatccttctacctcagcctcccaagtagctgggactacagacgggcactaccacgcccacctaatttttgtactttttgtagagatgaggtctcactatgttgcccaggctggaggattctttttaacaattactttttatatgcctgatacagcagcatcgttgcatagaaagagagagcactttagcagaaatctaaggaccagatgtcatatgcattgtgctgttggctttcactgaatccaagcttaattaaactgaggctaataacttctctatccacctcatagggttaatgagaagagtaagaggtaagtaaatttatagaaatgctttgtgaacagtttagtatatgtgaagcataaaggctatgtttgctgagttgcagacttggaagccatgtagtccagctccttccaaggcacagttgtcttgtctttgtgaatgcttctagaaaagggcactcactacagaaaataccacaaagctgccacttttcttgatttggatccttagttacagttaacacagcctgcacgtgcactagttccttggaagttataccatgttgctgcctcaaggtacacttgtattatcaacagcttaagagtgagtctttgtgttgaatttatccatctgtaacccaaatgaaacctcaccgtgataaggtattgaaccagatcaggaaagtagattaaggagctttactattaaagagtcaggtaggtgatgaaaggggcaaactgaaaaccagtggaaggaggcttatggaagtagtggctgtgttgtgcccaggttctgtgctgtgctggggttgagctccctgtgactcatgactacctgtgctgagctgtaactgccacagagagcaccagggactccccaagctcttagaaaaaacccagaaaaggaattaaatgtgggtggatgagggcctttctttcctgctgctgcgtttttattgaattgggaaatgagctgagctcctaggtgagctctaccaagagcagcagcaaccgtttattaatcagcacactctccatgtgcccagcactttgcatcttatacatttgacagggattgtcacttttaatcctcaaactgccctgtgcagtaggcattaccctttgtcatgggctgagttgtgggtgtgtcctctgaccccgaattcctgtgttgaagccctaactgcccccccagtacctcagattgtgactatatttagagagaaggtctgtaaagaggtgattaacttcaaatgaggtcattagggtgggccccaatccaatctgactggcgtccttataagaaaaggacatttggacgtggatacatagagtgaagaccatgtgaaggcagcaggagagacagccatctatgaatcaattagaggcctctgaaggagcaaaccctgctgataccttggtcttggacttatagcttccaggattgtttaagccacccagtctgtggcagccctagcaaactaatgtgccctcatttttgttgttgttgttgtttgtttgtttgtttgttttgagatggagtccctctctgttgcccaggctggagtgtagtggcacgatctcggctcactacaacttccacctccgggttcaagtgattctcctgcctcagcctcctgagtagctgagattacaggcgtgggccaccatgcctggcttatttttgtatttttagtagagatggggttttgccatgttggccaggctggtcttgaactcctgaccgcaagtgatccacccgtcttggcctcccagagtgctaggattacaggcgtgagccactgtgcccggccccttgtttcatatctgatgaaactaaggatctgagagtagatgaaactaaggatctgagagtatatgaaacttgccaaagttctcacagttacggctaggtaaagtcccgggattaaatccaggtgcgtctgattacaggtagagataaatctaggcattaaatccaggtgtgtctgttcccaaagcttgtgcttatacctaatgtgttattgagtcctgaatgtgtctaccttaaggctatttctcctcacttttgaaatagtgagtggcacccagatctttgacttatttctggtccattgttcttactaatataccatgcttgcctcccctgccaccactttccttagaggtaagatactgcacaagtacatgagagcctctggagaagaatgtcacaaacaggtgactaagttagggagttcgtaaatctggaaagatttgcatgtgtttgggactttccttcccagctcacttctgatgaagtgagatagaggcgacttgttcttcaaagtggtttgttacctagttagaagtagagttaagcctgacagaaaaatggggcagataagtgtttagtgtcatacttgcactgttgctgtcactgagaagtttggtggttcgtcatgaatcggggtaaatattagaaatacccaagtcctgctctcactcctagatgttctactctaggaaagtctgggacaggatctgagcatccatcatcattgattttttttcttttcttttcttttctttctttcttttttttttttgtttgaggcggagtcttgctctgtcaccaggctggagtgcagtggcacgatctctactcactgcaatctccgcctcccgggtttcattgattctcctgccttagcctcctgattagctgggattacaggcgcctgccaccatgcccggctaatttttatatttttagtagagatggggtttcaccaagttggccaggatggtcttgatctcttgatctcaggtcattcacccgcctcggcctcccaaagtgctgggattacaggcgtgagccaccatgtccgaccctgattttttcttttgagtcttccttggtgattttgatgtgctcatcaaatggagaacccttgaagttgtggaatggtttatttctatagttgttccttctaaaccagctttaggtacctgttgcttgtagtctaaatcactggaattaattatcatctgtggtctttagcaggtctgaatgtgagagtccagtaggtagcaggtgctatccaacatgtttttgaaatttttcttgctgagttcagcctattttgtacactttgcattttactcctccagagggctctagagctcagctgagcagactggcttgttaccctcattagacaaagaaactagccaataagatttgagcttttatttgttggaggaactaatgttatgttatcttttagagcttcctgttcttttcttttctagtgcttcccccgctcccagctctcaacctctatccgatataaagactgttttcttgtcaaggtcacagttagtgatgctagaacacaaggcagagactgtggctaagctttcaggtcttagaagagggatctctaaaattctttgtttacatttatcagtgagaaggttgaatttacatcttcaatatatggataattatgtataaattatttatttacccatgcagtttcactaatgtgattgcagtgcttttttttttttagacagtcttactctgtcacccaggctggagtgcagtggtacaatctcagctcactgtaacctctgcctcccaggttcaagcaattctcgtacctcagcctccctagtggctgggattacaggcatgcgccaccaggcccagctaatttttgtatttttagtagacatggagttttgccaggctggtctcgaactcctagcctcaagtgatccaccggcctgggcttcccaaagtgctgggattacaggcatgagccatcatgcccggccactaatacgacattcttttaaaagaatgagccaagccctccctgcctcccgcttccccaaagttcaaatattttctttctgtacttcagtgaagataactttggaagccactgctttagaaaatgcttttcattgatgtggcagaggtttgcggggaaagagtttatagatgatcttgaggttgtttgggctgtaggtacctttctttttttttcttttttctttctttctctttctctctgtcttccttttctttcttttcttcttttttttttctttttgagacaggagctcactatctcactctgtcacccaggctggagtgcagtagtgtgattgtagctcactgcagccttgaactccttgggctcaagtaatcctcccacctcagcttcccaagtacctgtaactacaggcatgcatcaccagtaaaagcaattttttaatttttatttttggtagagatgggttctctctacattgcccaggctggccttgaattcctggcctcaagtgatcccactgcctcggcctcctaaagtgttgagattacaggtgtgagcgactgtgcctggccttgcaggcaactttttattccaattgccatcttgacattgtagtgaagagtgagttgtccagggaaaggcagaacctgacagtcattgagaggggactttatgtggatggctcacaggcagtaaggaaggctttggaggaagcattggagagttagcaagcaataggtacctgaagcagtggcgtgggtggattttgtcacattcaactcagtgagcactcaaatcagcttggcattcacacagacttaggggtttcaatgcagtgctgcatattcatgtttgagccaccaacttcctgcagtaaggaaaggaattctttgaattgtaagtgctacagggccatgaatacccatttttaagttgtcatcttgatacttccaattttgaaagggtagagatgggctggtatccttatctgaatggatttaaagtttctcttctggatgttgcatcttttattatactttcagctcttcatctacctggttctttaactaggatataaagacatttttttagaaaatgatagtagatccagcaagatttttgtcagagcagataaactggagtgatttgtttaggaaaaagttaccactgtgtagccccaccagagccaaacctggagttacatttaaacaggtcaatctctgaagaaaagtgtaatttggggtcatatgacctaactcctgaggtcacccagagcttatacttaaatcagaaaaggaagagatgcccatgagcccaaattttaattttgttatttccacacatttagaaaagtaggaagaataagttttgcattatcccaatagatttaaaaactctagttccttttaaaatctttaaatagacttaaaacaatttcaaattttttccagctttatcgcggtatacttgacaagtaagtgtatatatttaaggtgtacaatgtgatgctttgatacatacagtgtgaaatgattaccacagttaggtttaataattaacatatccatcatctcacataggtatgatttcttatgtgtgtggcgagaatcctgaaaatcaactctgagcacatttcaagtgtacaatacagtatttatgatagtcaccatgctgttaatcagattgcctaccttggttaaagtgcagactcaggtgaaggtctggatggaggatcatactttaattgatttagactctaaaataaatgtatatagttatttttgctaacctaagaacctactcataaatggctagtgttaaaatgatgtaagataaaatgctttcccttcacttttttaacagaagtggaaatggaggtgatgtaacttgcctgaggtgacacaggtagttaagagcagagaaaggactagagccaggactggtttagtgatttttagtttagcgcattttaaatttttatcatatgattccttaatctttgagtcttccaaatgcagaagctaggttatagaatagcatattttattttaatattacatttatggaggtagatattcttggttaaagctcatttttaaaaaataatttcaacttttagattcagaggatacatgtgcaggtttgtgacatggatttattatgtggtgctaaggtttgggatgcaaatgatcccatcacccagatagtgtaaagctccttttagaatggtatatgcagatttaattctgtcactgaaaatgtttcaagaactaattggaactgggcaatagcttgcatttcacttgttttgttttttgcatttaggttttcctaggacattaggacaagccgaagccctggacaaaatctgtgaagtggatctagtgatcagtttgaatattccatttgaaacacttaaagatcgtctcagccgccgttggattcaccctcctagcggaagggtatataacctggacttcaatccacctcatgtacatgtaagaatatacaaagtgctttcacaacctgacaagaaaaagacaaacaatttccattgaaaagtggagaaaaggatatgagtagaccattcaaaaaagaacaaatctacatgaccaaaaaacattttttaaatgttcaaatgtagttgtcagggaagggacatttaagtatttaaataggatatcactttggatctattggactggcaaaatcaaaatataaaaatttttaattttatatttattactgataaatatatgtatacaatgtatataattatatttattttatttaaaaaataaaactaaaagtctattgctggtgggatctggggaaaataatactccctttttttgttagctgaagtattactagcctctttttaaagcaacataacaatgtacattcagaattttaagtaaataatttaattcaggctacttttaagagaatagctgtggaaatggaagcattagcaggttaggtcatgtataggttgatgcttgtttcaatgttgctgtagtgggcaaaaaacaaaaccaaaaaaatctcaaaaaagcaaatgaatgtccatctgtagtggaatggttaaatacattggagaatatttataccatcttggaatataatatagtcagtaaaaagaatgaattagcactacttaaaaattaatatacttgatttttagataagctttaggtttacataaaaattaaatggaaaatcccctccctcaccctagcttcttcattattagcattttgcattagtgtagtacatttgttacagttaataaactaatatagaaaagttattaactaaaattcatagtttgcattgacgttttcgttttttatagtctatggattttcacaaatgcacaatgacatgacatttttccatcattactgcattatacagaatagtttcatggtcttataatttatatttcctgtgctctacctattaattcctccctgattttcgccaaacttctgaaaactacagatctttttactgtccttataattttgccttctatagaatgtcatatcgttggaatcatatagtatatctacttatcagacttggctcctttcacttagtgatatgcactacacattctgtgttttttggaggcttggtagctcatttatttttgtaagtgaataatgttccattgtatggatgtaccacagtttattcgttttgaagaacatcttggttccatgtcttggcatttatgaataaagctgctccaaatattcacgtgcagagttttgtgcaaaatgtaagttttcaactattttgggtaaagaccaaggagtgtaattgctggattgtaagtgtatattttagctttgtgagtaactggcaaattgtcttccaaactggttatttgattttgcatttccaccagcaataaatgtttctatttctccatatcatcaccagtatttagtgtagtaagtgttttagatttcagccgttctgctaggtgagcattatagttttttgacatggagaaatcttctgaaagtgtttttcttttttattttcttttctgagatggagtctcgctccatcacccaggctggagtgcagtggcgtgatctcagctcactgcaacgtccgcctcctgggttcaagtgatttttctgcctcagcctcctgagtagctgggattacaggcatgtgccagcatgcctggctagtttttgtatttttagtaaagacagggtttcactatgctagccaggctggtctcgaacccctgatctcaagtgatccacctgccttggcctcccaaagtgctgagatgacaggtacgagccactgcgcatggccctgaaagtatttttcaatgagaagtgcaaacagcagaatgatcccatttttgtaaaacagggactacacctctttatgtatatctgtttgtgtgtgtgagtgtgtgatctatagctttataagatcagggagaaagtcatgagggctgtatcctgggctggaactggatgagggaaaggaatcatagttgatgtgcagagtgggtagttaagtgactagggaaggctaaaggaataaaaagattacccttaaacagttcaaagtataacattgatacagttacctaaaattagacatgtgtaaaggtatatgtgtaaagatattttaacaaattttcttaaagaattattgtttttttgataaagactatttggtttatgataaagactatctgataaagacagattgagctgtctttatcatataatagtgaacgccagttttgggtggtagatagtattacttgttattcaaatgtggaatacatgccttactaggttagtctttatggaaacattacacttggatatagatggagtcagtaattactatagaaaatttcttcgaggggctaagaatggcttcccaactcctgggtgccattgtgtcagtaaagtcccagtgagactttttcactaagcactccttttgaagtcttcttttaaaaatgtaaaagcaggccaggcttgttggcctgggaggtcaaggctgtagtgagctgtgattgtgccactgcacttcagcctgggcgacagagtaagacctggcctccctcccacctccaaaaaacataaaaattttctaattcttgtattagatcccttcctgatatctgtctcaagaagctatgatgggggaaaaatgggtgggaataaaaaaggagttctgacaatacagatgggaaaactgaagtccaacacagacgctttatattttgcatttgtccagacctgctgacgcagagattctcataaaatttgaaaagccttaccactgagttgcttttcaaagcctgggtttccctcaaagaacatctgcaattaccatgctgcttttgaagaccatagtgaaagtgctaacctagaccagctctaccagctgtggtgaagtggctatgttgtctgggatatataccctggggttcgtcatctcatgccaggaaaatttaggacacggacgcaaggagtttaggagcggaggtttaataggcagaagagaagagaagagaaagagaaacagccctctctacagagatagaaggggctccaagtggaaaagaccagctggtggtggatgccccggattttatagtccagggtgaggagatggtgtctgatttacatagggctcacagattgtttggatcaggcatgatgtttacacagtgctggagaaaggctggtggccccaccctaaccttattatacaaatgaactctccctgtcctgcttctgatagtacacgtggctgacaaagagaagggaagatggagccgccatcttgaacatgtctagtccctagttcctgccagcattcccccgtgcaagctcccagcttgcttgtctatgtctgcagctcgactttacaggctgatctttgttagaaaatgatttggggctgcttttcattaaagagaaaagccttactgaggattcccatgcccttaccatctgcctaagtgatttcttcttaactcctgtgtcagtggtagccggattccctgggaaggagggacgctgttgctctagcatcattctgctttttggaaacagggttgtatttgctgatgctctgaaattctggaaatgactttctgagccttgtggctgtaagtaaaataaagaaggtggcaatagaggtaatatattctcccatccccatctctcttgtcatgttgggttaacaaccatagaatacacatgtgataattacatggcttactcataaatcataagaataagtcatatacccaaggccctgagctgtaatggaattttagtgcatttcaaatttatagccagtttctgattatccagttgagttgcctgtgcctctcagttctgttctggcctaccttttgacaggtttatttcttgtgactatctcccctggtgagtaatagtcatggatgtgggaggcaaaattcaaaacgtgtccattttgcaattttaaggaggcatgattcctggggagattaaaacaaattgaaaatcaaggtgttttttttttaattataatttttcagttctcagaatgtttgtccctgattgtcatgggtaatttaataatttctattttaatacacctttaaatatgtcattttttaaatattctaattcatgccttctgtttctcttttccttaattttagtggttaagagtttcactaaaataaatgttattttttattttttattatttttatttaaatttttttgagacagtgtctcgctctgtcacccaggctggagtgcagtgacacgatttcactgcaacctttgcccctgggttcaagtgattctcctgcctcagactctcgagtagttgagaatacaggcacccgccaccacacccggctaatttttgtatttttagtagagacggggttttgccatgttggccaggctggtctcaaactcctgaccttaagtgatccgcccgccttggcctcccaaagtgctgagattataggcatgagccactgcgccccaaccaactgataaatgttatcacgtatgatgagagtgggggggttcttgcctttttccccaaacttatagtaagtgtattcaatatttaaccttatgtatgatatcagctataactttattataatgtccttcatgagattttgggggggaatagaaagctagcaaaataattagacaaacatactgcagaaaatcatatacattttcaaatcaaatacataaaaccagccaggcgcagtggcttatgcctgtaataccagcactttgggaggccaaggcaggtggatcacctcaggtcaggagttcgagaccagcctgaccaacgtggtgaaccacactgtctctactaaaaatacaaaaattagctgggcatggtggcaggcacctgtaatcccacctgttcggctgaggcaggagaatcacttggaaccccccgggggaggcggaggttgcagtgagccgagatcgagccattgcactccagcctgggcaacagagtgagactccgtcttaaaataaataaataaataaaataaaacctgtattaatcagaactagcagttaaggtatattttttgttttacattgagaaagaagcaacacataggaaaagctaaaataaaggatttaacaaatccaacaccagcttaccttttgagtaatataatttaggtgaggacacagtcacttcagttttttttcccttctgtatgttcctacagtgtatgtcattatttgatctagtaaaataacctgaataagagaaatttcatagaagctccagaatagaattggaaagctggcagagatggtactgaaccgtattctcctagattagtatttttcctaagtaagccaagttgtttttttgagattttgttttccgcattaagaactcaggctttattttagaagacaaggtagttttagggatatttagagaaccaagatgacaaggtttgttgttaggagaggttgcatgcaattttaggctgaattgaaagtaccatttatcaacagcactggaacatgtttgaaaagatctgaactgttaataaagatttaatgtcagctcccaggaaataaggttaacatactgttaagtgtgctatttctttttctactactcttaaaattaccactgtcaccaaggcctaattcatcatgtggtaggagttaaagatgaatacatggttttgcacagaaaagtttttaacctatgaaatggcccaactgttgtctatattaattggtttatttggtatttgtagggtattgatgacgtcactggtgaaccgttagtccagcaggaggatgataaacccgaagcagttgctgccaggctaagacagtacaaagacgtggcaaagccagtcattgaattatacaagtgagtgtgcttcaatattttcatgacaaaggacagactggaaaggtgtggagcctgctgggaggaacacggggctgaggcagagtagtgtttctttaagacagataaacactagcgatccaaaaccttcccagaagtcagatgaaatgctggagctgtacatgaaagataaggttcaatacttttatcctgaaactgttagaacataaggacccaaacctgatcatctctgtctgctttggatgtaaaacaacattgagatttattttcattttcttaaaaatttaagtgactgagatagtggtcccacatatgttgatactcccacatataaatatatggtttggatagaagattagaagacacttggtgtgtcccttcttgaagtgtctgtaaggagtttaacaaaaaaaggctaaaaccgtaaaccagagattaaaaattcaaatggctgcaggggctagggcaggtattggaaatgagtctcaaacatggtgggggatgtgtcaagctagacagttgagtgacaggtcttgggctgttccggccagttatcattctagggcacgcaggccaatgattcccatttttcaggaatagcagaaatctggttttctgtgtgtatgtgtgtgagggggaatctcagttttcatattggcaacatatttaaattttttaaataacatgcaagtcaaacaaaactttatgctgagtgcattcaaaacagcagtttatactctgttacaatcactttctggccttgtagtcccccccaaaatttagcaaaccttaagatcagagttttatgatcatattattatgatacatcaattatgtattccatgattgactaagtaatataggttttagtaaagcttttcagtggttcgcttttgaaaattatatattggggcacatttggaatggcccctataatgctattctttgatatgttttaaagggggagaaaaaaggtggcatcatgacaagcataccagaattgcaaaagctatgaccttatttatgtacacccagtggaggtgttgatacctttgaaaggggctgttttagcacttagtgtggtatatgatatagaccatgagatcatgcttgttttatatctaggatcttctgcactaatacgtggaaaagaaacctaaaaagccattgtatgttgggctttgtttttcaggagccgaggagtgctccaccaattttccggaacggagacgaacaaaatctggccctacgtttacacacttttctcaaacaagatcacacctattcagtccaaagaagcatattgaccctgcccaatggaagaaccaggaagatgtggtcattcattcaatagtgtgtgtagtattggtgctgtgtccaaattagaagctagctgaggtagcttgcagcatcttttctagttgaaatggtgaactgataggaaaacaaatgagtagaaagagttcatgaagaggccctcctctgcctttcaaaaggctggtcacctacacatgtttaaggtgtctctgcacatgtctcaagcccatcacaagaaagcaagtacagtgtggatttcaaatggtgtgtaacttcagctccagctggtttttgacagctgttgctgtggtaatatttttgacatgtgatggtgatagtctctggttctccccatccccacaaaggctgttgaaccacagcaccaggaagcctgagaatgaatcctgagggctctagcccaggctttgtcccaggctttctggtgtgtgccctcctggtaacagtgaaattgaagctacttactcatagtggttgtttctctggtcttgagtgactgtgtccacagttcatttttttccggtaggaataactccttttctacatccacgctccatagagtctctccttttcagacatcctgggatgaaagaatttggctttttttttttttttttttttgacatctgttttcactcttaggcttttaaacaatagttattgctcttatccctctcagattctaataactgagagcgatggggctatattgaatctctgtatgcactgagaactgagctatgaagaggatcttattaaactgctggtctgactttatggattgacactgttcctttcttttattgtgaaaaaaaaaaaaaaccctgaaagtcttgggaaccccctaaagtcttttgggaatcctcaaaaagcatgggaagttaagtatttagctacataaatgttgtaagatcatatcttatgtatagaagtaataagaccatttggaattactggactaattgaatagttaaggtttctattcgggacaataaaatgtattttgaaagtgctgctaactattgatgctgacagtgtttcactcctatgagtgacccaaacatattataaatatgtggtaaagggaatggagcctgtggggttgagcagaatgttgtactagctgtgcctggactgagtataacagctttatgattatgagaaaacaaattctttattttttttttctgttccaaagattcatcctatggggtggccataaagtctagaattagatactaatattttgtcattcattataacatatcaataaaccatttgttaaaagatttgcctggtttccagacttggtggccaccttgaataattcttgctgtcttctgggaaggatgatgaaatttattcctgctgccttaaaaatatgtatcccttcttcacccatcatgactgtccccagtgagtgtcctttactattcttgggagtgactcctgtctaacttttcatactggcgagaagaaaagaagcctattttaacactttagtggtgttgaaacacattacttactttctgaagatgtcccagtgaatcctctgtcaattcactgccatatgtaatctatatgataaggaatgcatcttccttctaagtactgcccaaactcttgccagctcctctcccattgtcccttcatgtgaatatttcttggctaccttagtggaaatatagatcagttttctccccatccatcctctcaaacataatgagattgtttactttttagatttatgcagtgaaaatgcccagtcaggtctgaatcgtcagtgcattatattgactctgagcactttagaatttagagttgcaattgaatgccagctgtggagatggggtgcatatcagatatataaataaagctcaggtttgctagggaaccaggtatagagaaaaataagtctgatatgaggaaaattgcacaatttagagtagttatgccgtagagaaaatttccacaaactaggaaatgtagagagttattctatagaatactcaaaagaggaaagtatgtgatttttggaaacaggaaaatcttcaaacttctttcttcacttccctttgtgtttagctgaccctccaatgtgatcattgcctttggagtttgggagaggtacgggaagtggcctgatccctgcttccatacttcactcctccatccatccttccctccctcttcccctccagctaaatggacaattctagccaacattgagtcactcaataagtctcaacagtgggtgtgtttgctgagattgtccagcggttgagcagtttggtctcacctccctcgctagttgagaccaaaaagagacaaataactttttcatggtctttgaaacataatgcttatttcgtggtcaatggctttaaaaaaatctgtttcttgttttcttcaacaaactcactagttttcccttaaatgatattgtaaaaattaaagtaatcttgaaaatgttttgacaaaagtaaaattaaagggacatcttttcttgttttgttttttttttttctattgccacacatgaccgttccttcacctttaagcaaagagagtggttcagatggtttctaagatgccaacctgacctcgcattctgtcattctacccagctcttaattcaatttgcttccattatcctaacaggcttctttcttacttagaacttggaaaggctgctgtatttaataccctccaacactaacgcagacttaagataggtactgtttattgaaaacctactgagtgaaatgtgcggttttaggaccttcataaacatctcatttaatctttctagcatcctgtga

SEQ ID NO: 15117 - DNA, 9825 bp, Human
gtcaggagttcgacaccagcctggccaacatggtgaaaccccgtctctactaaaaatacaaaaattagtcgggcgtggtggcgggcgcctgtaatcccagctactcgggaggctgaggcgggagaatcacttgaaccccgggaggcagaggctgcagtgagcctagattgtgccactgctctccagcctgggggacaagagcaagtcttcgtctcaacaacaacaacaataacaacaagttcctcaggtgactctgatgtgcagccaagttggaaagtcatcgctagatccgcggtgtgcaaagtgaactgcggaccgtggactgcggcacttgttagaaaagcagaatttgcattttaacacattcctaggtgattccggagatgtctgagaagcgatactttgtccaggggccacagtttgaatagcaaagctctagaacaataactctaggcttcattcccgttgtctgtgtgtgggcctacgaatatgcattttcgcaagcattcctcctcccccttgcctcagaccattctgatgcgggtggtgctgaacggctccatcctccttcacgttcacctctccctgggatttatcttactttccaccacctagacaggaaggggcgaatctggcttcccatctcggttgtgtgaccctgggcaaatgcctcccagttcgtggaagtctcagtgtctagttaagttttcaatcacaagtcattcctcacattcattcatctattcctttgacaaatggttactgactacttcctgcgtgctaagtgctggagatgcaaaatccagacagggaaaccgaataattacgaaaatgacggtagacgtacaaaaataaatcctaacgaacaaggcgcgcaggagcgctccgcccgggagggaggtcagggaagttttctctccaagaagacaacagagctgagacctgaaacgagcaggcattagggagccacccgtctcctctgtaccttctgcagcgtcctcaacacactaaggaagcggagacgcagaggagaatgactgtcctaccatctggtcgcctaaccaggcaggggcaggacaaaaactccatgcctcacgcttcccaaccaattctgctatgcacggtgccagagacttaaagcagtgtctctggtccctttcttctttcactcagcaaataatgaatttcagagatgtgccaacatagaggcacttggagaaagacgaggcagctgagagggaagctgcttacctggccgggacgcaacggttgcgaccaagtcccacttctgccagctacatacaccctctttcacacgctctacgagcagctaccgcccactcgccacgctattggtccaactagcatgaatgataacttttagggccaacgaagaaaaaggggtggactttcttgcccagctcctcccacttggccctgtggctgttttgattggcagatgacttcggctcggcccccgctttaaaggcacctgtctgtctcccattaggtacgcggcccctaacgcccacactccatgccttcctccgctttccccacccacttccaggaccaaccaatgacttcaaggcagaatatgcccccgcaaccaattaaaaagagctctaaacttgacggacgacttcccgcccctggactgtcgtagctcctcccccagaccaattgttttaagagaggggggcggatacatccaatcagcacgacacaggtctcttgattgacgttcgggtcctcgcgctggcgtgttgtgccctgaggcgggaggaggaggaggagcggggaggaaaacctgagccaatcctagcagcctgcgcgggaggccaatcgaacgccgcgccttggagcgatcacccaatccgcgaaagggggcagggcgcatccctgccaggaaccaatagaaagcctccaagggtcaggagcgacgttcagcgggagcaatgactggcctatattcgggactcgggggcgggtcggcgccagagacgagaagagaggaggggaggcctcctccgccgccgccatcttggaccgggcccggtcagcttccgcggagccatcggcagacgccgcggcctcccttgagccccgacccccgtcgtcagaacaaccccgggcccactcccccaaccccacttccgcttcgcgccgctatcgcgatagcgcccgggcccggggcgcgagaaaaaggcggcgggcgctcgcctcccccgcctgtcgcgatacgctcctcagcggcggcgccagctcctgtggtgagagcgtcaggctcgactgggccggaccccttcccttcctccccccggcgccatcggccgccctccccgccgcctcccgccctggcgacaccgccgtctgtcgcgacatggcctcccctcgcctgccccctgccgccgcctctgcagcgcggggctcccggcggggggcggctccctccctctcgccctccgttttctgcgcttctttcacgttcctcagcgcctcccgggggtccttccgcgacccggaccccgggccccgcccgccgccgcctccccgcgtggcatcgcgtcgggccccccggtaggggtgtgagggtgcgaagcctcccgggcgcgaggtgcccgcccctctccgcgtcggtattggctcctggctggaaggatggaggcgcccctggtcccaggtgcccgccctctcggggctcaggtgcctgcccccctcggcctcggtccttcgcgttgtggggcagcctccgcgccggggcttctccctcgacggtggcggggagggggggtggtggtcgggacgaggaccccagctgggtgggggagtcacccttcccaggaccgaggccgccctccgcatccctcctcactgctcccgggagcgcagcctcccctggatctcaggttccagctgcccgtctgtatcggatgggagcctcttgggagaggagtggaggagaaactccccgttagttggagcctttgccgaagtttccacctctgtagtctgcagctcttccctctcatagcgagtagcgccctgggtggctccagcctcgccatcccgctgcactgggcgcctgcctttttgggggagtttggctttcccccacctggggtacaggaccgtcctcagtgtggcccacgtctggtctcagctctcacacttctttgatcctggcgtctgcccctggctttgcagccttgaactcccctgcatcgtgactctccgaccttctgggtgtgggcgtctcccagtgatatcaggaccactgtggtcttgttgctgggggctgctgggatcccctggcgctcaggtgcctggtgaaagacactaagccgccacgctgtccatgttagtgagctcccactgcgggcagcaccagcccctctttctgagcagtccctgcctctcagtgcagggcggccacccaccccggggtgagctctcctgtccttttggtgaggggttttgatgtctcccctccctcccttcacccctgcctgagtatgaggcttcttccatcttcacaccagtctcctcctttagggtgtcagctctccaaggaccaagaagcccactgcccttgatatttgcatcagatcccacactgtgggtttgttgacttcccatctacccttacgctgggtgtcagcagttggagaacaagggtttcgccttctggccccgctgctggtaccccatgagagtaggaagcttcctagacccgggttcctgtactgcgaggtgggggctcttccctctggggctgtgccttctctccagggtaaggaccctttcttggtgtcacctcccccagggataaggttcttgccatccttggtattggtatggctgcttttctggatttgaggtgtccacgcctctgcatgtgtccccaccgtaaggctgaggacccctctcggatgcaggtgcccccggctaatgcttccaaaaccccctcttgatttgtcactgtatggggtaaggcatagtttcctggctgtgtggatgtaagatacctgagtctcaagcgggagactccactgtagaccctgtccctgggaccagagacttctctggtgtagactttccaaggtgggagattccagccccccacccttggcatggggcatctcagtggagatgactacctctaccccaggccctaacgcatccttcttctggagtctcagagcctctgtgtggccacgtcagcagccacctgggttaaggatcacccttcaacatcacttctcagagctccttgctgcagaggcggaagctctcccagatcaaaggtgcctcatgacaaagaccactctgtgggcacatgacggcccccaaggttaaggaccacccggtgttagtttcccagggctgacctcctgcccctccctcctcgagtctttgtgtggtggtatcatcttccctgagatgaagtctggggggctcttctttactggttttggctctgattttagcgtgttggctcctgtgaggctggtgtcctgctcacctccccccgccccgccacccgccttgtgggtcccttccctgtggggatgtgtgttcctcttgggtaagtctcctcctgggccgaggttcccagattcctcagtgctcttggagagcctttgctgctggagcacaggttcttcacgcctgagagtggacctgcgatcaccaccttccttggaggatcttggtggatgcccccctgactacagcaaatggggctctttcttctctggcggcgtctctgcttcgagactcaggctccagcttcccttctctctggtcctttgctggggggaccagaggtacagataccctcatgatataaggattttcttagcggggaaggtgttgtctctactgtggctaaggctccagcctctctaggggacaagtaccctgggcctctggcacttgccccttctctgtggaggagctgcctcctcactgggtctcagctgtagccgacttcgatgtcacactgttctgtctgaaacatcacctccctgggttagcgctcttgttcccctccttctggcttgtgacccctccaggacttccttctcttgctgccacagtgtggtctcctgtctgtgggtattcttcctctgcactaggataccagtcctttccgtgtggagacacagggagggcgtcacctgcctaaggtgttgattgccttgtttaggggtgtagaccatgagacctcttctctctctgggctggagcacctgcccatgaccctctgttgggttcttgggatggaaagagggagtgtaaactctcgtttcacattcttgttccccctatgcagtaagaggcttttctgtgttggggtgttggactttggtgaggatccctgcacacctgagctctggtgtccaggcccttgccttgtgtgagctccctgggtcaaagaggctttcccctcctcagcctgaatccccactgtggcaccttctcctgggtccttttgttggttgctttgccttcttagagattccccaggtagggcgtgatagctgacctgggcgggggctgctgcggctttctttaggttgggccttttactgaggagatttaaattccctcaagtgtaaggtagcacccctacctattatcacccagaatgggtccctgcggtgttgggaaaattctccctgggggtaaggtaccagccctgtcctttatgggcttcttgttctaaagcatatccgtcccatatggttgctgctagtcacatgtggtgattagtaactagttaaaaatgaaaaattcagttcctccattacacttgccacatttcagatgttcagtggccaacagatatgcgcaaatagagtgtttccagcattgcaaagttctgttggatagcactgtttgccagatgttcccttctttgtgggtgaggactcttttggtgtgacttccctctgtattgaggctcttgttcctcagtatggggctgtttctgtctttacagtaagtgactactccagggttccctgccctgcacacgtagagtgggagcggcccgtggatcccagggaactgtgcttttcattgtaggccccctccctggaggggaagagggcaatctccgctggtatctcagaagtcttcttctgaggcataagcctctcttcccagggctcccctggtctcgctgtcaggccctaaggtatgtcttcccttggactaaagctccttggaactcccttttgacctcagtcttctctgggttccaggtaacttcctttaaaataaagacgctcctctcttgaagttttgggttcctgccctgatggtctatgtctccctgactctaaattaccaatccacttgctatgggattcctccatgagtgcagatcggctccctcacagctgcggtacctttgcaccctcttatcttagtaagatttctgtcttctcccaggtctctcttgggtactgccttctgcccccaaatctctaagccttcttggtattagcttctttgggttaggagtgttatttccttttggtttaaggatcctgctctggaataaatgtcttggtggtttgagtcccttctacttggcattcagccctgtctgcatgagcgggttcagctcttcacagctttcggcatctctgctcgccgtcgttttcccccacccccaatctttcttctcctacctacagcttacacacacacacacacacacacacacacacacacacacgcccttctctgtgagctgccagtttcatttgtctcctgacttgtctgagggatgacctctcctagccacctctgcccagcccctctgagtaggaagtgtgatctccagggctaatgcctccatcccagtcatcagctgtgtgcagcatgactgtcctgctctgaaaaacctttttgagtgtattctggggagaaggtactccatgctctaggaattttccacttcctgagtcagaggcacacaaaaaagtatgtaacttttcttgtttcaacaaacttatggggtcccctgttggccagacactatgctgggcagtcaagcgagcatcaggagaactggggctggtctcttgtcagatagcaaatgcttcttctctttaccagtcccacctacctcactatgctgactaggtccatgtctctgggtttttaccagccagggaatacgtgttaattcctctccaatctctcctagcagcgtccgtctccaagagagtatgaagagagtgcgtctgtagggcagggaagatggcggacaagcgcaaactccaaggtactagactgacttcctgctgcacctgtagccacatgctccctcttctgaggactgctctttagatacctgccacctgggcaggattctcacagccttgttcctccctggccaggtgagattgatcgctgcctcaagaaggtgtccgagggcgtggagcagtttgaagatatttggcagaaggtacaggggctgagaccctaataatctgggtcttcagagaggagggcacaggaaggcggctcaggacctctgggtgttgaccagcgggaggggctacatatgcagatgctgaggacctaagagaatcagctctaagatggattgggggtaggggttggggggggggtcctcgagtccctagcataaggaagaatcactggagtgggtactgggacatcccctcccacactgacttctcaattctctccatccctcagctccacaatgcagccaacgcgaaccagaaagaaaagtatgaggctgacctaaagaaggagattaagaagctacaagtgagggggctgggggcctggacgcctttgtcctgagggtagagggaactgggagagtggactgctgggtcccagggagaaggagctgtgggccccagttcctgggtcctgaggtctgactttcttgcttttcccatctgcagcggctgagggaccaaatcaagacatgggtagcgtccaacgagatcaaggacaagaggcagcttatagacaaccgcaagctcattgagacggtaggagcccagagcctgagtcccagagaggtgggaaggtcaccagattcttgagatcccaaggggcggaggcagagcggccagaccccagaggtcctcaagagaagtaaggtttctgcacctaagggaagtgaagaggcagcggactcagagctcagaaagtagggtcacgaggctcaggtcggagtgtctgctggcccttagtcagctcctttcccacctttgagagcccccctgccaactgcactctctacagcaaatggaacggttcaaagttgtggaacgagagaccaaaaccaaagcttacagcaaagagggcctgggcctggcccagaaggtagatcctgcccagaaggagaaggaagaggttggccagtggctcacggtgagttggggtagagaagaggaggtgaactctgaggatcctgagccctgggtgtaggcggaaccctagctgatgggcttcctcttcctctccctcccctagaataccatcgacacgctcaacatgcaggtggaccagtttgagagtgaagtggagtcactgtcagtgcagacacgcaagaagaagggcgacaaggatgtgagtgagggagacccgacacctttgggatggggatgggcatgggaatgggctggccagcaggaggccagtcatttatgctcctgggagttggggcctggattcctcaggcggacagggccaacagccgggattagggatttgagagacaggattgggagggcttagcagctgcacgcgtggggcaggaaggaggtcagacagaatctcagggtcccctgggtgtctgggtagaccgtggggcctttgtgaagaggagcgacttgggggaaggtgagtgcaggttgagcttgggccacagagtaaaagtgagacctgaaggacacccatggcaagaggcctcctggcacccagagggccctggtcctagggagagcacagtgggtagagacaaggcagaacatggagaaggcagagaaccaggcctgaaggaagacaggagtctgggacaaagctggatgttggggtcccaggttctaaaatccgggattgtggggtatgagttcaaagggatacaaactgtacagacttgctgaaaccagaaagacagggaggggagagccgggtcctcagggaagctgtgggtgggagagggtcaggaagtggaagatgacagggttgggtgtcagactctgaggggtttgggaaccaggggctttcggggagatgatgggtccttgaacagagcagagatttggaaccaaggctaagatgttaaatcctaaaggggccttgaggggagggcaggagcgaggcttaggaatctgggctctctcagggataaatgggtagggttgggggcctagtgatgacagatatcacaattctaaacagcaagctcctcacaaatgggggttatcattgttactgctggagcaggtcggagggtatctgtatgccagaggcagtcacagtggtgggcgggctcagttgagaaatctgggctgtcaggtgaggtgcagatggaggccaagtcgtgggatggcacaaggacctctgggtcttttagaggtttccaaggactcctggagccagaaaggtgtggggagaggagggagcagtgggatcccaagatgtcaaggctaagattggtccccacagggctcagagggtgggtggaccccatactgccccaccccgaaggggatggcgtggaggctttgggtctccacaggggtcagggactgagga

SEQ ID NO: 15118 - DNA, 74804 bp, Human
tgaccatgagccaggggctgcaatctgtaatgcataaggagcaattggggggtcagtgatgaggaggggttgaggggggtatggctggagagcacagaagaaagaatttttgcacaagggtggaaatggccatgccatccccacatcctagttttatagtatatggggagtggaaaaatgagaagccttctagcagagggcagcaaaggaggcagtacctggaggaggctcaggcaaagaagtcacctgagtactctgaagaagcagagggtatagcagagtttgttgacaaaagaacaggattctagaaggcacagaggaaagagctgccagtgtgatgggcagtgtgagtgaaagggctgggcaagaagctcagaagagtaagcgtctgaggcagaggccagacaagcagaggagctgtcagcttgggtggttcctaggctggagatgtacactgtagacagggtcataatggaacttggggggaaaatggttttggtatttgactcagacctctaagatctgagatgggggagaagtgtggggaaagacaatgattctagagcaagccttcagctggctcctgtgacctcaggaagactggaagtccatatcaggatttgagggtggggtatttattgcctcctctatctgcctcctctagtggaagtgggacttcctagggccaggccaggcaagaacatttttctactcctgttgacagcctcctggtaatgggaaaccattgagaggtttttgtttgtttgtttgtttggtttttgatggagtctggctttgttgcccaggctggagtgcactgctggagtgcagtgatctcggctcactgcaacctctgcctcctgggtgcaagcaattctgcctcagcctcccaagtagctgggactacaggcatgcaccaccatgcccggctaatttttgtatttttagtagagacagggtttcaccatgttggccaggttggtctcgaactcctgacctcaagtgatctgcccactttggccttccaaagtgctgggattacaggcgtcagccactgtgcctggccgagagttttcttaaacaaggttgatggtaacatggtgacattttttaaagggttgctcgggcttgtgtcaaaatgattttggtatctgactcagaatgaatgggaccaggaagtctcacagctaccgaagtcaccaggagtatggcagaacaggggctagttaggatgaccatgggccaggggctgcaatctttaatgcataaggaacaattgggtgtcagtgatgaggaggggtggagggtggtatgactggagaccacaggagaaagaatttttgtacaagggtggaaatggccatgctgacaccacgtcctggttttatagggtgaattggagagtgaaggcaggaattaggaagctgttgcattagtccaagcaagaagtgatgatgctggagtcagaacaagggcaatggagacacagaggaagggcagggatatgttaaggcggtgggatgtggggtgtgaaggaaacacagatagggtagaggacagcgtccaggtttctggcttggtttccgcttgtagtcagcctccctctctgggcttttgtgaagacggagccatagaacggaccggaccagaaagcagtttggaaatggcaaaactgctacccatcatcagctacattatcatcaaagctctctaattaccctagtaagttcagtcaatggaacgaggcatgacaattaagataaatcacgagagtcacccagacatgggggacctggaggtcctgagtcacctcggattacacctgctaggagttgagggccggggcggggcgaacacagactccgcccttgggcggggcctggatgcggccggagcggagcagtgctggagcgggagcctcagccctcaggcgccactgtgaggacctgaccggaccagaccatcccgcagcgccccgccccggccccctccgcgccctcccgacgccaggtcctgccgtcccgccgaccgtccgggagcgaacccgtcgtcccgcactcggagtccgcggtaaggggcgcggccccggcagcccgcccgcggaggatcagggaccgatccccggcgcggggcgctgggcaccgagagcgggcgccgagaaggagcgcggggcagcggaaggaagccgggggaggagcgagggagggggctccgcggcggcagaggtggggctcacctagggagggggcgccgagggggtctcccagacgttgggggcagccgggggagctccaagggcgggaggggagcaagaaagacggcgctggggctgggaggagagatggggggcaactggagggcagtgagggatcgctgggggaaacgggggcgtggggggcgggggagctgcgaggagggcggagtggggctgtgcggaaaggtggtaccgggcagccgaggggcagcgaagggggcggtgaagggagcggactgaggggagctagagcgggggtgcggggggaggcatggaggtgaggagctgaggggaggggactggctgggcgggggtcgtttggagctggaggggactgaggtgccgagggcaaggggcgctgggcagctggggagtgtctggttgggagagggtcgggggtggggatgtgggtatggatagctgggaaggagaaaggcagcagggcagtgtctggtcgaaagagggtcatttatgggggatgtgggtatggatagctggggtcggaggttgagcccggctggggaccggcgtgggggtaactgtagatggaagacgaggggtggggcttgggggcgggaagcttgggagaatggaagggtgagaggccaggttgggtctaccctgctgcagaggaagggggcagggagccggtggagacacagggaagtggccttggaaatggacacaggggcctacattctggtcaggagtggagaggaggctctggaatagagtagggtctggcggctgcaagtggaggaatcgtgggagaacttggagtgtatagatagggtggtggggcgctgggtcagcctggggaggaggccaggtgtgggtcgtggtgtaagggtggaaaggtaatgggggctggagtggtgtccacgcactagcggtgtctcggccactcaggagtccaaggaggggacccaggcactggaccttgttacacgggcaccggggatcacagaaaataagagaatcgtggacagaaaaagtcatccaactctgttctgtagtccaagcatggaagcaactttggggagggcagggcagcagcctttggaagctaagagagatgtggaggaggtgggagaaagatgggccctcaaaacacacacacacacacacacacacacacacacacacacacacacacacacaaaacaagatgggccctcttcccccggcttcctggaatccagatggaaaggggtgggagacagtaaaaggagaggatgtgtgtgtgtgtgtgtgtgtgtgtgtgtgtgtgtgtgtgcgcgcgcacaggtgggtgtccacctgttctgtgcctataaacagaggaagacaatggaagccgtgaaaggccctatctatagaagtggaaagccctggtgccctgtgggagccagagaagaagcattttgggggaggtgggtgggttggggaagccttcctggtcatgaaggatttagctagcagtggaggaaagtgtgttcctatcagaggaaaccgtatgggaaaaggcaaaaatctaaaagcatctccagtccaagaaatagatcttcagtttcttaaagattatgacatgaagggaggcatcagtaacctatacaaaatatttaaatagatttcccctctaagcttgaagctcctagggtttctctccatctccctaaagtatagcacaggtcctggtgcatagtaggtgcttggtgaatgttgattgaatgaataattggtgctcctgcctcaatttcttcatccattcccaagaattgttgtgagaatcaaataggataatgtgggtgaaaagaactttgtaaactgtaaaacaatgtacaaagagagaggccactgatgttattctgcaggtgttcctgttttgtcagtggacacacccatggctatctctttccaatctggaggaggaaggaaatgaatatcaagcatctgttggtgcaagatggaatgctttgaaagcatcttgtagaatgctagacatttagtaggtgctcaataaatggtagctattgtgatattgtttctgtggctctaggagacctgggaaaacaatgagaaggtggtgatgggtcagcagtggggaatggtctaaagacagattgaattagaaaagtagagtatggcttaaaggaggatgaggtccacatttgcccaactcccttcttattctcactgaaatgctccaagtaggaagacagggaattacattattgagcccctgctatattgcatatacagttgacctttgaacagcatgggtttgaactgtgtaggttcacttatacctgaattttttttttcaaccaaacactgattaaaaaaaataccatggtgggtcaagcgcagtggctcaaacctggaatcccagctatttgggaggctgaggtaggaggatcgcttgagcccaggaacctgaagctacagtgagttatgatcaggccactgtactccatcctgggaaacagagtgacacccatctcttaaaaaagaagaaaaagagaagaaaatacagtagtgaagggaggtgaagtctgtatattcagaggaccaacttttagtctaggtgggttccactgggccaactgtggttcttgagtaggcgtggatttcggtatatatgggggtcctggagccaatcccttgcctataccaagaaattactgtactattctagatgtataacccacattacctataattttcccaacaacacttgttttatgaatgaggaaactgtcttaatcatgtaacatttcttgccaaggtctcataggtaataaatgatagacctggaaactgaatctagtttgtttgatttggagctccaaactatttccactacacaggatgacttgctagaagaaaccatgaagcacagagacaaacaaacaaacaaaataaggggttaataaaacaccctcccatatacaggttttaattcttgcaacagttttgccaggaagccattttatgagctccttttatagataaggaaactgaggccaggggtgtgatttgcctaagtttacaggatcactgaaagagccagggcttatctttcaaatgccaggtctcttggactcagtctcatgttctttgcaacaaaaggtaagttccttcattcacttcttcactccatttattgagctgatctcttctcgctggattttagggctctctcctcctcctccccgctctttcctggctgaagttggcttcttccttaggtgcttatttctgccgcctatcagactgaaagggttgtttttcacagccaccctttgaggagtcatttctttcccccagcctgggacagggacgacttcccagatggtccctgggccttcatctgtattgcttgtcacggagatagctctatcattttatgtgactgtcacaaaatagaggaaagatttgattgatgcttatcttacaaatgcaattctgcatgcaccactgtgcatgacctgtctgcttagatctgcctcaggcagctgcctgctgggatgctttttgcctgtcttccaaatgtctgagtagcccctggccgccccctcctaagaagatccccttgggggcttccatctgaatgagccttccaactgaactcagctctctgcctctccccgttctcacaccacctactgggaaagccatgctgtgtgtgcataagcagatgttaacagtgtggtatggcaagtacagtacggtagcaggacactcaggatgttggggatgcttcttttttttaatttttatttttagagatagggtctcactctgtcacccaggttgggatacagtggtgcaatcatagctcactctaacctcgaacctctggactcaagtgattttccagcctcagcctcccaagtaccgaggactacaggtgcacaccaccacatccgactaatttaaactttttttggctgggcgcggtggctcacgcctgtaatcccagcactttgggaggccgaggcaggcggatcacaaggtcaggagaccgagaccatcctggctaacacggtgaaaccccatctctagtaaaaatacaaaaaattagccgggtatggtggcgggtgtctgtagtcccagctactcgggaggctgaggcaggagaatggcgtgaacccgggaggcggagcttgcagtgagctgagatcgcgccactgccctccagcctgggcgacagagtgagactctgcctcaaaaaaaaaaaaaaaaaaaaattcgtagaaatggaatctcactatgtttcccaggctggttttgaactcctggcctcaagtgattttcccattttggcatcccaaagtgttgggattacaggcatgagccaccatgcccagccaggatgcttctttattcaccctaaaattgttgtggttttcgttttccttaatcccgtcaaacctggaagccattaggtaacagaagttccattcatgaccctccaactgacttgctgtgtgagcttggacaaatcacttgtctttgcagagcctcaattttttttttttttttttacctgtaagataaacggaggtagatcaggaactgaaacaattttttactcttgccatcacttcctagtctcctatctgtggcagtcacagctaataaaggcaggcaaatttctcactgattctacacgaggctacatgtatttttctcagcacagtgtatgaaacatacttatatacgttctcttatttaaaattcacagcacctcgtgaagtaagtattattgtcagatgaggacactgaggcatagaatttaagtaactaggccaagtttacacactgagttactgggaaagctgggcccagtagccaggctttttgttacaataaaaagctgctactccaaagtcccctctaattctagcagtttaagagtgtgaagctgggctacatcagaaaagtgaaaaccagtaatctgacatttacactgatagtctggcacttgaaaaatgctctatatgtgtttcttgaaagacataacaccctctaaggatttactgtaggtctagcgttgaccagatgtaaggatggataaagcccccttgaatccagaagagagagcaaacagttaattgtaaaacaggcccaaataatggagccacaatcagggagagggcagttgaacaagatttgcctgcagaagtgaattaaaggggccagtgaaataatatgtattcagtacctccatgggccgagaaactgtgtcagattgtttacatatagtactactctttctatttgtaccaagctctgtgaagtaggtggtattttctctattttaaggtaaaagtgctgtggcttagagaggcaatatgacttacctaagaattcatctgagggtagagcattgattttaaactttttcataacactgcagggtactaagtctagtctcggctgttagctatgagatttgggcaaatccttttaatttctcattttcagtttccttcttgatcaaatggaaataataatccctgtctttccagctttatttcccaggtttatttagagataaaagaagataaaggatatgaaattgtggtaaagatcacatttatgttttagtagtgactctttgaccagcaattccacttcaaggaatctctctcaaggaagtaattaggaaaatgtacaaaaatttatgtaaagaaatgttcactgcagtttcatgtataataattaagagtagaaaaacaacttaaaaacaacttcctaaagagagtgacaacattaaataattgatctggctgggccaacatggtgaaaccccatctctattaaaaatacaaaaattagccggtgtgatggtgagcacctgtagtcccagctacttgggaggctgaggcaggagaatcgcttgaacccaggagttggaggttgcatggagcccagattgtgcccttgcactgccagccagggtgacagagccagactctgtctcaaaaaaaaaaaaaaaaaaaaagaattggtcttatgacacatctataggatggaatataatgtagtcaactgaaatgatgtttttttagagttttcaaagtctcgttcatgcttttttttttttttttttttttttttttttttttaattagagagtcttgctctgttgcctgggctggagtgcagtggcacaatctccgctcattgcaacctccgcctgccaggttcaagtgattctcctgcctcagcctccagagtagctgggattacaggagcatgccaccacgcctagcgaattttttgtatttttagtagagatggggtttcaccatgttggccagactggtctcgaactcctgacctcgtgattcacccgcctcagcctcccaaagtgctgggattacaggcatgagccaccgcgcccagcccttactttcttttctttttttttgagacagtgtcttgctctgtcacccagactggagtgtagttgtgcaatcttgactcactgcagcctccgcctcctgggttcaagcaatttttgtgcttcagcctcctgactagctggaattacaggtgtgcgccaccacacctggctaatttttatatttttagtagagactggatttcaccatgttggccaggctgatcttaaactcctgagctcaaatgatccgccctgcctcggcctcacaaagtcctgggattatgggcctgagccacggcacctggcctcaaaatctcatatttttgtagtacttttggtactactaaatttttgtagtatttaagtacagtcttgcattgctaatgacaaggatatgttctgagggatgtgtcattagccgatttcatagttgtatgaacatcatagagtatacttacacaaacctatatggtatatggtatagcttactatacacatagtctatatggaatagatagcctattgctcctaggctgcaaacctgtacagcatgttactgtattgaatgtagcaggcaattgtaacacagtggtaagtatttgtgtagctaaacacatctaaacatagaaaaggtacagtaaaaatatgatggtttttttttttgagaccaagtctggctctatcacccaagctggaatgcagtggtgcaatctcagctcactgcaacctcagcctcccgagtagctgggattacaggtatctgccaccatgcctggctaattttttgtattttaatagggatggagtttcatcatgttggccaggctggtctctatctcctgacctcaagtgatccacccaccttggcctcccaaagtgctgggattacaggtgtgagccactgcacccaggcataatatggtataagagataaaaaatggtacacctatataagacacttaaccatgaatggagcttgcagggccggcagttgctctgggggagtcagtgagtgagtggtgagtgaatgtgaaggcctaggacattaccatacactataggagactttataaacactctacacttaggctacactaaatttatttaaaaatatgtttctccaataataaattaactttggcttactataacttttaaaccttataaacttaaaaaatttttaaaacttcttagactcttttattttttatttattattattattattatttttttgagattgagtcttgctctgtcacccaggctggagtgcagtggatctctgctcactgcaacctccacctcccgagttcaagcaattcttgtgcctcagcctcctgagtagctgggattacaggtgcgcaccaccatgcctggctaatttttgtatttttagtagagatgaggtttcaccatgttggctaggctggtcttgaactcctgaccttaagtgatctgcctgcctcggcctcccaaagtctggggttacaggtctgagccaccatgcccagccatagactcttttataacaacacttaacttaaagcacaaatacaccgtatggccttttttgagatgaaggctcagtgtgtcacctggattggaatgcagtggtgcaatcatgggtcactgcagcctcaaactccttggcttgagcgatcctcccaccttggcctcccaaagtgttgggattataggtatgagccactgaacctggccttttctttcttttcttccttagtttttaaatttatgtttaaaattattttgttaaaaaggaagacacaaatacacacacctgagcttaggcctacacagggtccaggagcatcaatatcactgccttccatttccatgtcttgtcccactggaaggtcttcaggggcaataataggcatggagctgtcatctcttatggcaatatcttcttctggaatacctcctgaaggacctgcctgaggctgttttactgttaactttttaaaaaatattaaatataaatagaaaaagtacactctaaaataacaataaaaagtgtagtaagtaaatacagaagccagtaacatagtcatttattatcaatatcaagtattatgtatagcacataatcatatgtgctatacttttatacaactggcaatgcagtaggtttgtttacaccagcatcaacacaaatatgtgagtaatgtgttgtgctacaatgttaccatggctactatgtcactaggcaataggaatttttcagctccattataatcttatgggaccgccattgtacatgtggtctgtcattgactgaaatgttgttatgcagttcatgattgtacttttaaaatttaagtgatttgctaaatgataacataccatatattctagcctataccttgtgcatatgatgtcagctattacaatatgcatagaaggtatagactagaatgcatggtatgttatttatatagaaataaaaagtataaataggtctctttgcttatatatgcaagggctatctctgaaggatatataaattgataacatgtatgcctctggggaggggaactggatcaggaatcagagatggaagcaagacttacttttcagtgtaaacctttaggtttcatattacttgtattttatgctaggaattaagaaaataatgcagctgggtgtggtggctctcgcctgtaattctagcactttgggaggccacggagggcagatcacttgatcccggtttaagaccagcctggacaacatggtgaaaccccatctctacaaaaagtacaaaaattagctgagcatggtggcacatgcctgtagtcccagctactcgggaggctgaggtaagaggattgcttgagcccaggagatcaagactgtagtgagccaagatagtgccattgcactccagcttgggcgacagagagagaccctgtctcaaaataaaataaaataaaataaaaataataataattgagctacagctggtaaaaaaggtaatacttgcaaataggatatgcttgaattattttccgtaagtatgtattaccttttaaattaacaaataaaacatagtattaaaatagatggcttttttttaaagtacaatttccattttatttttctccaggaaatagtccatcttcagtctttaaggactcagctccttacatgggctttggtgggggtcgtggggcagcacctacaggtctaaatcagggtgggggtgtttggtccttgcgggcttcatgagatcgattcctgactactttgctgtgaattgcacaactcgcatagtaatgtagcttcacatactgcttgggaagcacataggcatcgaagatgctcacttcagaaatgtccctgactgctgtggcctccactatgtttcaaatgacgaatttcttaatggccttgtccttgggcacacattgggcacagttcatccagtgaataggctgcaagtggctgcaggcctttttggcatgaccattgttccttcttttctttgtcatcttggaggcatggactggagagaggaggtttttttttttttttggtagagacagtcttgctctgttgcccaagctggagtgcagtggcacaatcatggtttactgcagcttcaaatttctgggctcaaataatactcctgcttcagcctcccaagcagctgggattatagatgtgtgccaccacggctggctaattttttactttttgtagaaatggggtctccctatgttgcccaggctggtcttgaactcctggcctgaagccatcctcccactttggcctcccaaagttctgggattacaggtgtgagccactgcacctggccttaggtggcactcttttgtatgaaaaaatattggaggaaatacagtaaaatgttaacagccatagtttctgagtgggtgggatgtcagttaattttttttttgggggggtggagtctcgctctgtcgcgtaggctgaagtgcagtggcctggatctcagctcactacaagctccgcctccctggttcacgccattttcctgcctcagcctcctgtagctgggactacaggcacccgccaccacccctggccaattttttgtatttttagtagagatggggtttcaccgtgttagccaggatggtctcgatctcctgacctcgtgatctgcctgcctcggcctcccaaagtgctgggattacaggcgtgagccaccgtgcccagccgtcagttaattttaaattctcttttttacacttttgcataatataattttcaaattttttataatgaatatattcatagtagaaattttctcttgtgaataaagaaagatgacttgcaggcagcagagcggaggatggtgtgaggttgttgtggttgcttcccttgtttttatgtagaaaaagcataatgtggccaggtgtggtggctcacgcctgtaatcctagcactttgggaggctgaggcaggtggatcacctgaggtcaggagttcgagaccagcctggccaacatggcaaaaccccgtctctactaaaaatacagaaattaactaggcatggtggcagatgcctgtaatcccagctacttgggaggctaaggcaggagaatcgcttgaactcagggggcagaggttgcagtgagccaaggctgcaccactgcactccagcctgggcgaaaagagcaagactccatctcagaaaaaaaaaaaaaaaaagcataatgcctttacatggcaagttcttgcaacagcctttgcacctagtaccatgaaaagctgaaaagttaaggctgtgagacagtttaagcagccaatggcaccctcccttccaacctcactttcttcctccatgtaagtgctatgcctcagtctccaagtgtcctgggcatgttccacacttgcctagtgagtcttgtcatggggcagattgatacagggatggaacttacagtctcagataaggattgagagctgggaacaaagggaaggaagaacagagaccacaggagtccagtggtgacatatgcaaggaacttttattaaaaggctgctaacaatcttacatatttgtctaacttttcttcaagagagctttaaacctacattaatcagctccttatccttacagctcatctgagaggcccaaagagccacacccaccagcctcatgccctttctttgcccttggggaaaaaaacaggaattcctaaaaagaatgaaaacccagacaccatcacacttgaatgctgtcctcccaccctcctctgaccactcatccagccatctgggtacccttgtgctgagaagaaggggagatttcaggtggagaagcagggtacctgaggcttccaagacataggagaagcaattaaagacttaaataagaccatgtgaccaagtgctgaattatggagttcagattcgggtgttctaggaaagcagatggtgacagaactgagaaggctggggtctcaggaaaggcctggcatgtattaaatatttgctgagtgaatgagtgaacaaataaaggacctaggctttgaaggctttggaataataaggacatatgttcacatctgtgtggaatttaccagttgataatggtttcatccattgttatctcatttgagtcctgtgatagccctgtgagaagagcagggtggaaattgttctccccattttccagatgaggagattgagccccagagtgatgaagtgactgtgatgaattcagcacacatttcctgagtgcttattatgtgctaggattcatgctggaagccagacatgtaggaatgaagtccattaaggcccagatgctcattccaacagtgctgaagtgatacaagggctgttacagtgttctgggagcacagggaagctggcacttgatctggatctccaaggatgggtaggagtcttttaggaggaaaagagaattctaggcagaaggaatacatgtaagggacaaaggcaaggaataatgtggcttatttggcataaagtgtgtaattagatctaagggaagcacaggttggtgaagagaaggggtatgggaagataaagtttagagaattgcctctttggttagttggttatttgtcaaattgaacagtttggacttgatctttagagctgtggaaagccatgaaagtttctatgttttatttattttattttttagagatgaggtcttgctctgctacccaggctggcattcagtggcatgatcatggctccctgcagcgtcgaactcctgggctcaagtgatcctcccacctcagcctcctgagtcataatagtttttgaagcaagagaatgatagccctttactgagtctttccttggatgtgcatgtgtttgctgttcttggctttttttttctttccccaaaatagctcaggagctgcttcctccaggagcctctccttgatcaccgggcctccaggctgaatgagatgcttctcatggacttcctcagccaggactcctctgtcttatcacttatctactgctttgttactctgtgttgacccaccttttattctagtttttgtccacctagaggtcaggcaccatgtctgactcatgtttgtaagccccatgcccagcacagggcttgccccagatcaatgtgctcagtaaatatttgctgaaggaatgaatgggaggagctgggttccacctcagtgctgagacaacatttggggcaggtgtagtgatggggtgattctgagtagtgtgcatttcctcagtggtgctggagtaaggagtgagtgtgtgaatggtggggtgaccattagaaggatggtgactcagggtgacaccgaaggtctgttcctgagtgactctaggtctctcttgcagatggcttcagtgacagatggtaaaactggagtcaaagatgcctctgaccagaattttgactacatgtttaaactgcttatcattggcaacagcagtgttggcaagacctccttcctcttccgctatgctgatgacacgttcaccccagccttcgttagcaccgtgggcatcgacttcaaggtgaagacagtctaccgtcacgagaagcgggtgaaactgcagatctgggtgagtcccgggaatcttgggcaggattttcctgagaagcggctggcctgccagtacaagggcttagaggtggggccagcttggaacttctgggccttacagcatcaggcattaatgctgtttcaggtgtggcccctgggctaccctctgctagttttatacaagtttgctctcctccaggggttcagttgcttctgctgtttaactatccaggaggttttatgttggcttgtctaaatgagtgaccaagaaactggggcttggagttagagacttgggttcaaattctgcttctaccacttactagtcatggaacttgactgaattgcttaacttctctggggcaccctttctcctttggggattgtaatagcatctacatcataaggctgttgggtccttaggtccttggcttagttcctggaacatagtaaatgcacactaaatgttagctaaggtatcagttatctactgtcgtataacaaatcacttcataagttcatagtgccagactgggcaacattgtgagacctcatctctcaaaaaaataaaacaaattagctgggcatggtggtgggctcctgtagtccccattacttgggaggctgaggtggaaggattgcttgagcccaggaggtcgaggctgcagtgagccatgatcatgccactgcactccagcctgtgcaacggagcgagactccatctcaaataaataaataaataaataaataaataaattggtagtgtcaaacaacaataataattcattatctcatagtttctgtggatcaaacatttgggagtggttggggcctctcatgaggtgtagccagatgttggcttggcttgcagtcatctgaaacatacactggagctggaggatcttttttttttttttaagacggagtcttgtcctgttgcccaggttggagtgcagtgacatgatctcagctcactgcaacttccgcctcccgggttcaagcgattctcctgcctcagcctcccgagtagctgggactacaggtgcccgccaccatgcccagttaatttttgtatttttagtagagatggtgtttcaccatgttggccaggctggtctcgaactcctgaccttgtgatccgcccacctcggcctcccaaagtgctgggattacaggtgtgagccaccgtgcttagcctggggctggaggatcttaagactgcacactcacatgtctggtgctagctgttggcagaaggccttacttctttcccatttggcctcttagagtgtcttcacagagctgctgaagtgtctttatttgcatagcagctggcttttcccagagtgagagatgtaaaaggccagaggaagtggcaatgtctcttatgagttagccttagccttacagcgttctgttggtcactgattcagcatgggaggaaactacacaaaagtgtggatattgggaggaaagtatcactggggaccatcttggaagctggctgccacagctactattattattagtatctgccaatagtactaataaattatgcacatattttagatgatatagcaacatgtagatcatatagttttcaaaaatgaattagtacctggattggaaattttgaaaatttgtgatttaaagtatttaaaacatgtattattattattttattttatttttttcgagacagagtctcactctgtcacctgagctggagtgcagtggcactatcttggctcactgcaatttccacctcttgggttcaatcgattctgttgcttcagccccccaagtagcttcaattataggcgtgtgccaccacgcctggctaatttttgtatttttagtaaagatgggttttcaccatgttcaccaggctgatcttgaactcctgacctcaggtgatccacccgtgttggtttcccaaagtgctgggattacaggcgtgagccaccacgcccagccaaaacgtatgttatttattatctttctattctgcgtgttaaatgtacattaatacattatgcatatatcttattggggcagtctgtatgtagtacttttctttttacaaattatttcccatatactatctcacaattaacactatgaagtaggtactactttaatacactcctgttttgcaggataagaaactcagagattagttaacttgccttaggtcaacaacactgctataaagtgggatttcaacaagatcttctgattcaaaagtatgtgctcttttctctacactgtgcatctgaggtattatagagttcatatttcccttcatgataatgtcaaatattatatagggataaaagttcattttgttcatttgctctctattaaaggcattgaggagtcagagatcattagaaatagaagaagctatacgggtcgtctagttcactgattcccagacccatggcatcagcatcaccttggaatttgttagaaatgcaaattttcaggcccacctcagaactattgagtcagaaactctggtgggtgagtgacaaccatctgtgctataacaaattttccaggtggttttgtggctggctaacattgtagaaccacttagtttaactagcttgaggtgaaagtcaacatgcatttactaaaagcacctattaggtgccaggtgctttcacttgtgttatttgatatcatccttacagttccatgcacagggggatgtgagagcacagaatatttggggcatggtgagcaatacagtaaaactggatcaaggttgtgaaagagcagagagtgggtgctgagagaaatttgctggagaggctataggtggcagattgggggtcaaagagatcttccacagcaaacagaaagttcttgtcatcggtcagaggattcatgcttgatgattccttagggaactgaagaaattattagagcttacttttaatctttgaacataagatattttttactgatatttactatgtggattgacagaagtgtctttgtttgacccccatatcagatggtcagatagcctacactcaaaaaatcttgagataggaggaggcattgtgcccttctgaggggttgacagtggactgactcacttctttgtttatgttcagccaattgtgagcttttgtggttttcttgtgcctgggtaagtggatttattgattacatggtctagttttaactaaatgaaacctcataatggatatgtggcttttaaagagtcctataaagaaacctctgattgaagactatgctagaagattatagtgaatccaagtgagcataaagaaaatggctgaactggtgtttttccaactcccaacacaagttcattgtcagccacgtttcgaggtaaaatcaatgataatctaattagatacgacatagtcaatctcccatccaagtactaaccaggcccaacccctcttagcttccgagatcagatgagatcgggcgcgttcagggtggtatagccatagatgacatggtcaatctcattgcttttgctgaaggaaaattagcaaagggtttttatgtgtgtgtatgtgcttttatgcagcaaaaataaagttttctggactattcatgaatacattagattttaaacatttaaatattgtttattttaattttatatattttaatatcttgtgtatagaagtagacatatagatatataatctaaagaatacacatatactgtgtgtgctgtacctacatttttcttacttaaagggatgtaagttggagaccaccaccataggcactggggagccatagaagggtttaaacaagttagatttgcattttagaaaaattcctggcttcagtttgaagggtggatggaaatgaggcaaagaaaccagggttttggatccaaactcatcaaattgtatacattaaataagtgaatttttttgtgtatcaattatacctcataaaggctatctaaaaattaataaacaaatatagtagtgaccagctataaaagaaaggaagcaagcaagcaagcaaggacttgggtaaattatatggggctgaactaagtgtattattctgctctggctgccataacaaaatacaattgaaattaattttctcacagtctggagactggaagtctaagatcaaggtgccagtagggttgatgtctgatgagagctctcccctcgggctgccttcccactctgtgttcttgtggcctttccttggtgcatgggcatgggggagagatagtgcaaactctttggtgtctcttcttataatgatatgaattctgttggatcaggaactcactcttatgacatcatttaacttcgattacttcctttgaggcctcatctccaaatacaagcacactgagggatgagcaacactccaactcaaaaaaaaaaaaaaaaagaaaaaagaaaaaagcatagtgtatactgtataggattaggtactatctagggcttcaacatacacattttgggaggacatagacattcagtccataacgctaagagtgacaaaatgacataagggatggaaatgaagagagagatttggaactagaatttacagaatttgatgatcaattgctgtcccctcttatccttggtttcactttccaagatttcagttacctggggccctctagatctgaacatactaaacagaaaattctagaaataagctaataaattttaaattgcacactgcttttttttctttgagatagagtctcgctcggttgcccaggctggagtgcaatggcatgagctcagctcactgcaacctccacctcccgggttcaagcaattcttctgcttctggagcagctgagattacaggcgtacaccaccacgcctggctaatttttgtatttttagtagagatggggtttcaccatgttggccaggcttgtcttgaacttctgacctcaagtgatccacctacctcggcctcccgaagctctgggattacaggcgtgacccaccgtgcctggcctaaattgcacactgttttgagtagcatgatgaaatattgcactgtcttgctctgtcctgcccagggcgtgaatgatccctttatccagcatatccgtgccgtatttgctatctgcccattagccactcagtagccatcgtggttatgaaattgaaaaaacatagtgtggtctgggtgcagtggcccacgcctgtaatccggcactttgggaggctgaggtgggaggatcatgaggtcaggagttcgagactagcctggccaacatagtgaaaccccacctttactaaaaatacaaaaaattagctgggcgtggtggcaggctcctgtaatcccagatactcaggagggtgatgcagtagaattgcttgaacctgggaggcagaggtttcagtgagccaagattgcgccattgcactccagcctaggcgacagagcgagactccatctcaaaaaaaaaaaaaagaaaagaaaaaagaaaaagcatagtgtatactgtataggattaggtactatttgaggtttcaggcatccactgagggtcttggaacttatcccccaaggatagggggagactgctttcattgtaaagggaaagggggaacatttatgtgtgtttatacatatcacttctgtacacaaaagttttgtgatttttttttttttggttttgtgagctttgataaatcacttcatttttatgactagttaatgtcttcaactattaaagcctcataggtttgctggtggtgagggggcctaaatgtgataacataatactgtgtctggggaatgcaataaatattgggttccttcctttctctacctttgggtccacatggaaggggtcactgggttgctttctttcttttttttttttttttttttgagacggagtctcgctctgtcacccaggctggagtgcagtggcacgatctcagctgactggaagttctgcctcctgggttcacgccattctcctgcctcagtctcccgagtagctggggctacaggtcccagccaccaagcccagctaattttttttttttgtatttttagtagagacggggtttcaccgtgttagccagggtggtcttgttctcctgacctcatgatctgcccgcctcggcctcccaaagtgctgggattataggtgtgagccaccgtgcccagccactgggttgctttctgaagttttccatctgtggttccagtgtaggaacagcatttagtgactcactagcacagtatgaagtgttcagttaaattcctccagcctatttgatctctcttaggggattccagacacaagaagaggaggttatgagcattgctgagcagggccacccacaataggaatttctgtcatctctgggggatgagggtcttgggagtgccttattgcctggagcccctcaccacaaaggtccctgagagctccctttgtttcctgagaagttaatgattgtggatcagagaagaaagtcttactggggaggtagggataggagagaagcctcattattagggagcgagagcatgcacaggtgtgagaggagacttggtaactccacagcaacggatccaactagaggccacttattgctgggtgctggttgccaagcaacccctggagaccttgtgggaatagaagagtggagggggcttccaccacctctatgtggggcccattgcagaggctgtctggtgctgatcaagagaacaatccagaggattgagctcacctaggactctgggtcctggattctagtttttgtttttttgtttgtttgtttgtttgttttttgttttttggtttttttttttttttgagatagggtctaactctgtttcccaggctggagtacagtggtgcgatctcaggtcactggaacctctgcctcctggcttcaggtgatcctcccacctcagcctccctagtagctggaactacaggtgtgcctggctatgccatgcctgaataaattttgtatttcttgtagagactgagtgcaaccagcacccagcagtaagtggcctctagttggatctattgctgtgttggtgatgatttaaaagctcttagtgtaactaaagacatacatagataatgtgcataaagcactaacatagtgcatggcacagagtaaacactcaacaaatcgtagtttttattaaggttctagggagattgataaatagcattccttttcttccccacctaaacccattgagaaatagatgcaggagtcagagagatggggcgtaatggaaaaaaaaagccttattactcattaaagcgaggatgaagccatggctaaagtcttccggcaagtgcagcttgctcatactttactctggagtcagaaagacacacaaacccagtcataggccaacgtgggccgctggctataattagcccgtacaccattcactcaaagtcaaagtccatgtggcccagatttactaatatttaaggcctaaagcattccactcaggtctgtaggagaagcctctgtctccatggacagccttcctcatagacagagaaaggagggtccctcctccaacagctcttttttaaattatcattttattcatgtatttaatgttgagacagggtgtccgaggctggagtgcagtggtatgctcatggtttactgcagcctcgacctcctgggcttaagcaatcctcccaccttagcctcaccagtagctgggactataggtgtgtgccacaccatgcctggctaagttttgtattttttgtagagacagggttttgtcatgttccccaggctggtctcaaactcctgagctcaagtgatctgcctgcctaggcctttcaaaagtgctgggattacaggtgtgagccactgctcctgcccaatagctcttactataattaaagacatagataagagtgaccatgggttccaaaggagggttagacagaatgacaaacaatgggacaaacaagaggagtcttaagagatttcctgggaatctgaattccacagtgatgtgagtaactcctcatataaacaggaactgagaacaaggtcaaggtgagatggggtgctgggcagtcagcaaggttcgcttatcagtcatctgccttatgtccacacagcagcctccatgaaatgttaggtcacaacatggctttggagtcatttataaatattaaagctagtgagtattaaatctgggaatgtcaaggatctgtatcttagggccagtaatataagaatagctgaaatgtaagggagtgtaggaatgtgggaaaggtaatcataccagaaacttggaagaaggaggattgtggctcttcagcagccatttaacaaatatttactgtgccagattctggggatagagatattaatataaatgtgacattccctgctctccaggaattaatgagactgaaattatgagcccaataaatgaataccatagctctcttgttctgattaggggaagaagaataggatatcaagagacttttccctagaatttaagaatgtacagtcatggattattatatgagattgggtagctgtctaataggcttctctattagtttcctgttgctgcactaaaattactacaaacttagtggcttaagacaacacaaacttactatctcacagttctggaggtcggaagtctaaggtgggtctcactgggttaaaatcaatttgttggctggtttcagtctgtgttctctctggagggcctcatctggggggcatctttaatttgccttttccagcttccagaggctgcctacatccctttgcttggggccccttcttccatccatcttcaaagctgcagtggaacatcttccaacctctctgaacctcctccttgtctcttataaaaacacttgtgattataatgggcccacctaggcattccaggtcaatcctgcattttcaagatccttaatttaatcccatttgcaaaaatcccttttgccatgtaaggtaacatattcacagattttagggattatatatttgggagactattattctgactactacagcatctgttagtaacatataaaagacctggttgggcgtggtggctcatgcctataatcctagcactttgggaggccaaggcaggaggatcacttgagctcaggagtgagaccagcaacatactgagaccttgtctctacaaaaaatttaaaaataagctgtgtgtgtggtggcatgtgcctgtagtcccagctactcatgaggctgaggccagaggatcacttgagcctgggaggtcaaggctgccttgagctataaccacaccactgcactccagcctgggtgacagagcaagatcctatctcaaaaaaaaaaaaaaaaaaaaagaaaaaaaaaaaaagaaaaagaaaagaaaagaaaagaaaaaggaaaatacctgatataaattccctcatcctttaagactctgaagcaggtaatgtccatgttttaagttcacactgctgattaagatttcctgttaccttgttaggtgtcaacaagcctgtgaatttagagcacatcacatctcagtctctcattttatttaatttaattaattaatttattttttgaggtggagttttgcttttgttgcccaggctggagtgccatggcataatcttggctcactgcaacctccacttcctgggttcaagcgattctcctgcctcagcctcccgaatagctgggattacaggcatgtaccaccatgcctggctgatttttctatttttagtagagacaggttttcaccacgttggccaggctggtttcaaactcctgacctcagttgatcctcctgcctcggcctcccaaagtgctgggattacgggcgtgagccactgtgcccagcctcagtctttcattttagacaggaggaggctgaggctcagagtgagatagggactttactgagggctcatggtgatgtcccttgacccattccagtgctcttcctgccaccttcaggaaggtgcaatctcgtcttgagtgtaagctggagacctgtggagagatcagcgggcagcacagaagagtctggaggctgaacagggaaactggggctctgacaagtctctgtggctccaggaatgtgaagacagttcctgagtacaccatcctgtgctcagctcttatgataatcagaattgatttttctaggcagcaagtttcctggtgtggctgcagaaacatgctgacacttttatctccccaaagcctgtaggaaccagctgctgaggaagtaagtttaatctgattttaaaaatcacaacaaagaccatggggagtcaaatcaggcttagttggcctctgtaattttcaaatgaattaacaagccatcctgattgactattgaaggggtctccaagacacactatttagggccacaaccccctttccttccatccaaactggcatgggagaaaaagaaataatctacaagccatttgtgtattcattaatccattcaataaacatgtgtcatgtacatattatatgcgaggcactgtcatgagagggcaaagaaacagctacaatgtgataaaagcgatgtaataaagggatgaagaaagtgttgtaagaacagctacctccacctgggaaaatcattgcaggtctcacaaaggaggggacatttgagcagggtcttgacaaatgagtctgatttttttcaggttaatgtagagtaagagctttacaggtggaagaaatgacatttgcaagagcataattgctttcaaggaccctttgtgtgcctagctgtgctaggctctgcagcgattggtgagacaacatccctgcctcttaggggcactcagtgaagcagaggagaagggggatatacaccaggcacgcacacattgaaatgcattgcagacattgagcagtggaatgacatgctctgtcttacattgttttaataaatttttaaatctttgggtaattttaggtttatagaaaagttgcagtgatagtgtagagttcccatgtgtcctttgcccagttgccctaatgttaacattttatataaccatgatacatttgtcaaaactaagaaattgacattggtacaatacgattaaactaccgtctttatttgaatttcactagttttttttccacaaatattctattaccattgcaggatccaatccaagatactgtattgcatttaataatattttttcaattgacatataccttatataccataaaattcaccttttttttttttttgagatggagccttgctctgttgcccaggctggagtgcagtggtacattctcggctcactgcaacctccgcttcccgggttcaagcgattctcctgcctcagcctcccgagtagctgggattacacgtgccccccaccgcacccggctaatttttgtacttttagtagagacggggttttgccgtgttggccaggctggtctcgaactcctgacctcgtgatccacccacctcagcctcctaaagtgcttggattacaggcgtaagccaccgggccagccaaaattcacccttttaaacagtatagttcagtgatttttagtatatttacagacttatgcaactatcatcactaattccagaacattttaacattttagtgacttacatctttctttctttctttttttcgtttcttttttttttttgagacagaatttcactctgtcacccaggttggaagtgcagtggcgcaatctcggctcactgcaacctctgcctcccaggttcaagtaattctcgttcctcagccacctgagtggctgggattacaagtgtgtgccaccatgctaatttttgtatttttagtagagaccatgttggccaggctggtcttgaactcctggtcttaagtaatccaccagccttggcctcccaaagtgttgggattacaggcgtgagctactgcgcctggccaggtgacttacatcttaacacttaacaggatttctctgaggcagagttatgcctgtttcaagaataaattatgaagagcaaagtgcagaagcagggagaaccagttaggatttgtaacaattgaggctgggaatgatggtggcttgaactagggaggtagtagcggtagtagtgagagtagtcagattttgcatgtatgttgaaaatactgaatattgaattagatgtggagagagaaagaaggagagaagtcaaggatgttgctgagggtttgggctgagcgactagaagtttggagattcctctaactgagatggggaagactgcaggaagaacagggtttagagagagagagttggggattcagtttggttatgctaagttggagatacccgttagataaccaagtagagatatggaataagcagttggataaatgagtctgcatgtatatgttagcaagtagtattttaaatgatgagaccaaataagattaacaagggaaagagtgaaggcaggaagaagaaaaggttcacagactgagcccggagacattccaacaccaaggtgttgggaagatgagggagaatcgggaaaggagactgaaaaagagcaactgaaatgagaatgtgtggtgtcctggcagccaagtgaagatagtttttcagaggaaggagagatcaactgtgtcaaatatggctgctaggttatgaatatgggaactgaggattgactgctgtatttagcaacatagagtacattgataaccttgatacaagttgttttggtggagtaggaggggtgaaagcctggtaaaaatggcagaagagaaattggagacaccaagtatgacacagcactttgaaggatgtttgctctaaagaaaaggagacaattggggtggtagctgaaggtgaatggggaagtgaatcagaagaggtttttgtttttttaagatttgagaagtagcagcacgttcgtatggtggtagaacaattgaatagagatcaacaaagcaagccaacaaagaaacaaaaatacaaagctgatgatttggaaacaaaggagaactgctgggacaatatccttgaactggggagaggggataggattacatgcagagggtgagtccttggtaggagcacagactgtgcacctacattcccaggggagaaagcagagggtttgggcacaggtgcagcttggggttccatgtgctggttcgagttctcttaagtacaattttctgatgaagcaaggtcatcagtggagagtgaagatgagggaggaagtttggagagtcgaagagagaggagaatgtcatttaggaaggtgggagagtgaatagactgtggaaatgtaatttgattgctgattagcattaagacttcatttgaaattagtgatcataaatttaaattcatcagctcatgaatttgaagcatggttgtgtgtttttctccagccatgttttgctctgaggataaaggcatagaataggcaaagagttgactttaagtaaagtgtggttttgctgagtataacaaagcaagagggcctggggagtcaggggcatgtgaagggaggctgttgtcatgattgaccttagaattcaagttgggccaagagggaggtaacaacacaagggatgaaggacagtgaaaaggtggtagggaaagaagactgttgatgctgggaatctacaaggagtgagctggaaagagcatagtggtctgagtatgagaggcttgaaattactattggtaatgataaggtccaggatatgactgtgagagtgagttactgaggtggggtcagagatcaatatcactggaggagaagcattcaaggaaatgagagtccaaggtgatggaagcctcatctatgtggatattgaaatcaccaagaattatggagagagtaacagtgaagcagaagctgttcactggccagtagagggataagtgggtggtataatctcatgatattgaaagctggaggtgttttgttttgtttttttgaaggagggaaagagagtgatatgaaagcaggggtgagaagcaacaacatctatcccacctccagcccgctgattcaagggtgatgagagaggaagtgagcaacaatttagaggctttaggagaagccatgtcctcagggagagccgggctttgattacagcaaggaggtaaaagaaacgttcggatgagaggctgagcaaaaatagatttttctgatgactgactgaatttcagaagactcagagaaaggtttcagtggggaggggaggagacagtgttagaaaagatgatgatgtactgagctatatggcaattggagtccagtgatcagggatggctttggagacatgggcttcttgccataattgacatgaacagagggataaagagaatacaaaacaaattataaagcagacaggtggtcccaggacagacagtggttgtgtggcgtgtgtgggaggatccctgcttccttttgatccctgcatttagaggcccagagtctggcaaaagtgccattcttattctgaatgcctggcatccctcttgacttcacacatcaataattgtggcaatgaacagcagctttcatttagaccttcacctgtaaatgggactaatactatctcccacaaagctgatgtgagctgacagtggcacgggctttcatgccagcactgtgctcagtgcttttatgaactgatttcatcctgacactaaccctgtgaactaggtgctgttattatccccattttacagagaagtaaactgaggtccagaggagttagatggctgtctcaagttcacacaaatagtaagtggcagagtccagatttgaatcagggtctatctggcttcagtctgggtgcagtggttcatgcctgtaatcccagcactttgggaggccaaggcaagtggatcatttgaggtcaggtgtttgagaccggccttgccaacatggtgaaaccctgtctctactaaaaatacaaaaatttagcggggcttggtggctgacacctgtagtcccagccacttgggaggctgaggcaggagaatcacttaagttcaggaggcggaggttgcagtgagccaagatcgccccacttcactccagcctgggtgacagagcgagactgtctcaaaaaaaataaaaataaaaataaaggtctgactgtcttcaaaacccatgtatggagttttgaaccccttgttatatcttcacataggtaaagcactctgtaaatggtgaaattgttaataattacaatttttgggcagcaattacatactttacaggtgctttacttgcagtttttcccttataattatcacagtgatggtgcccagaacagatgaggaaactgagactcagagaagttaagggacttgaccaaatcttaccaagcctggaaaatagcacatctgggactcaaaattagggatgtttgccaccagagtgttcttttcacaccaaactgccttccccactctttccactgccctgtggtaccccagggacctcacaggtggttgagagtcaacgtcacagctaaaaatcagaacctccaaacaaacactctcagaaacggaggtgttatctgttgcaaactatcaccttttagttaccagctcccctccttttctaccagccctcctctctctctgtcccactacaacttcacaggggagtctaatgggcatccaagattgagcaacaccagtgtataggtatgtaattaagtgacttggcactgaatgtagtggtctctgaagaagctgctgcatgttctgggcatagggtgaaaggagtggttgggggcttaattacttcagctgtggtgtaggtggaatgaacacatggtaccagcagtgtgataagtaatgtctctgaacctctgtttcctcagctgtaaaatagaagaatattaatgcctacttcttagtgttgtagtaaagattgaatgagatcatatagggaaaggatctagcatggagcctgtaacatattaggtgctaaataaacttacccaaagtcatacagtgaaggggagagccaggattagctcatgaggtttctattatgctgtactactgtgactgatcttagggttaccaccactttaagattgcgagccacaggacttacaaggcggagtcatcaacagagaaattagttgtgagttgtggcccttttactcccattttcaatggatggagagagcagcagtgctctgcccctgaagacgtccagttgccatctaaggctggagattctcctagcctgcttggaacctgcctgatgtgttgctaaggacaggggtgggatgggggaggccattcaactgaggatttataatcccttccttctgcagaatcctccttcccccacaccgttgcccaacaccattgccccacaccttgggttgccaggcgacagctggaaactcttatcctgtctgtgctcctgtgcttctcaccttcctctgtgaagtctgtcagctctgtgctaatgacgcaggggctctgtgctgaggcccagatggctgggagggcaggtcccaggggatacagtgccccctctcttgagtgccccactactgcccccagctcaaaactaagggtcatcctttactcctctctgctcttgtcgtattcatctgattgttcatgagaaatatccattctatttccccaatttctcttgaacgcatcccctggtcagttctgttccataaacatttattgagagcagactgtgagcctagctctctcctttgccctttcctaccttagattcctgttctcccccttggactgcagctgcccggtggcactccctgccctcaggcttgccctccataatcgctgtcactccagtgcctaaaatccaggggggctctcctgcatccccctcaacacattcttggccctttctgcctccccaaccccatcttcacccttcaggcagtccatgcaccacccacgtgtactctaaacccccaacccaaccacaggatgcagttttaaaaaaacaaaacctttattttttagaacagtttcagatttacagaattgcaaagatagtatggagagttcccatttacccgacacctggttttccctgttattaccatcgtacattagtatggtacatttgttataattaaccaatatcgatatactattattagctaacatccctagtttattccactttccttagattttacctactactccttttctgtcccaggatcccatctagaacacaactgatctgaattgtcgtgtctccttaggctcttctgggctgggagtcgggatgcactttttcactccttgccttgcccaggttgtttcctcctctctagagattccccctctacccacatttcctttttgtttctcttcctttttttggaatagggtcttgctttgtcagccaggctggagtgcagtggtgtgaacatggctcactgcagcctcgacctcctgggctcaagccgtcctcccaccacagcctccagagtggatgggaccctaggtatgtgccaccacacccggctaatttttttatagagacagggtctcagttttttgcacaggctgccttgaactcctgggctcaagtgatcctcctgccgaggcctcctaaagtgctgagattacaggcatgagccactgcacctggcctcctcccccattttctatcagcaaactcccatttgactttgaagactcagttcaagtatcatctcttctgggaaacctttgatgacccacctccccgcaactcagtggcagttaaggaccctccttaactttccatactaaccagctgtattgcatgtgtctggaactcacctgtcttcctcccagactgcatgctccctgagggcagggaccgggtctgactcgggtctacagctccagcaccaggcacagggccttgccaatagtaagggtttaacaaagactggcaaaatgaaagtgagtgctcaagctaaggctgtatacctctcaaagttgaggctatctcttctctctgcacttgcagtgcctgatctctctcttggcctcagatcaagttttgtgccacccccacccctatcagttctgcccctcagtggctgggaggtctgaggctcctcttgggttagcctctctagaatgagtaggccactttcttttcttttttttttttttgagactgagtttttgctcttgtcgcccaggctggagtgcaatggcgcaatctcggctcaccgcaacctccgcctcccgggttcaagtgattctcctgcctcagcctcccgagtaactgggattacaggcatgcgcctccacgcccggctaattttgtatttttagtagagacagggtttctccatgttggtcaggctggtctcgaactcctgacctcaggtgatctgcccacctcggcctcccaaagtgctaggattacaggcatgagccaccgcgcccggccgagtatgccactttcttaccggctttcctctcagcaccactgtggacaccagtccagtctgatcatctgatacatatgagatctcatttgatcacaagaggaggtcttgtcatcctcattatacacttgaggaaactgaggcccagagggtaaagggttgtactttattaaagttgacaaatggactaagtgggccctgaatgcaggcttttgggactcattcccttgcctgggatcttcctactggaccctacttctgcatataaaaagtgacacctaacctcagtcaacaattaaatgctgtactagagccatcccaggacatcccagcctcctctgtgcctggctgaacccttcaggttcttcagctagaacatggggaggaagagataaggaaggtaagagagaagagaaagggaagatagagaaaattggtggcaattctgaggttggaccctgtgttcaggctgccacgaggtgccattttgtgaggagagaatatgtcctctcaggataccggcctcccccaccggtgtgttgccgtgtcaactgattgagcccaaaggctggcttggaaatttaccaccaacggaggcttaattagccctttaatttccttccagcggaagtttgctcaggtggttcctagccctgctttcttgggctcctccctcctctcactttcctacagctctagctcaccaggaatctgaggcccattctgggtgttgacaccagggggaagagcagcagattactgagggcaaacagtaaattaaatgaacacgactgtttatacagaactttaccaacacactgtcacaacacttatcttactttatcctcccaacaataccaagaaaaggatattattatgaaacctgttttgcagttaacagatctgcagctcagaaagtcaaagacagcaactggtccaaggtcacatgccaagaagtggcaaagctagaatttgcttgaccccaaaatccatactctttctgctgcccttcacactgtctgttcattaagtgcttacagtgtttaatgaaatgacacataagtgctgaagggacactaaaattaaggggggaggatgagaatgagggtaattttaagaggcttcttggaggatgtgataaggacagaagtgggtgccaaagtgcagggaatattgttaaaatatatttttgtcttgttcccatagggatttaaagtggcaggaaaagatcgacagagtgagggcctgcaccatttttttcttcctcctggtttggtcctgactctagcctaagttttccaccagttgtgctgctacagattatctcccagcagttaatttgatcactcaagaacaaacagacaaaaccatgaaaagagtttatatagactttacataaaaaccactagaagattttatagtctggtggaaagacaagcacgttggcaattcatatacacagtttcattggagagaggatagaagagaagttaggaaggctgtgaagtttgactttctggcttgggtcttttaccagctgtatggcttcaggcaaggtgtttaatctctgaatctcattactttatctgtaaaataagtatgaaaatgggacctcgctcagaaagttgtaagaattagcacagtgcctggcacagcccgtctaaacaaatggcagccagtcattatttctgcctgtgggtatgggaggaaatgcgagtcatacaggaggaagcatttgagctgaattggaatggtaattagcgactgccttggcagggaaggggaaaaggctgatccaggcagagggtgcagcatgagcaaagcactgagacttagaggaacacaatgtttggggcctatggagttgtccaggttggtcagaacctgaggagaaaagaatggagaggggtggcaagagctgaaggcagtgaaattgttaggttagaaaaccagggataagtttagcatcctagcaggcagtataacttaggggttaaactcccagctctgacatttgctaacctgggcaagtacttaacctccctgtgcctctcagtttatttgtcttactccaaagagctggttatgaagactgatgaagtagtgcatgaaaagtgcttgtcacagtgcttgacacttagtaagtactcaattcgtgttaacaattattattatttgattataacaattattactatttatcctgactccttagagctagaaggggccttaaaaaagtaatctagtctaatatccctatttaaagaggagaatccaaggcgcagggtgcacagtattcataagcccacaaagcaagttagtggtaggattaaaccatacccaggcctcctgcctcccagccttacagctgtgtggctcccttgccattcattgtcaggctgcctctgacaggctcttcctcgctcctcagatgtttgtcccctgtcccttgtaaataaatttcaaggcatttgctttgtggagatgagtgttgatcctatttttagaacactctgccacctgtatgcaaatgatcctcaggggactcgtctgctatggtgacttgggccaactcctgaaagaaagcagctatgagaccagagggaaaacagcccagggtaggatggggatcctggactcctgatttctctatctagttaagtctctgaactcctcttgcctgctctgtatatgttaactccttgtgtctccatttggaaatgagttcagaaataggtccctggggccaggcgcagtggcttatgcctgtaattctagcactctgggaggctgaggctggcggatcacttgaggtcgggagtttgagaccagcctggccaacatggtaaaaccctgtctctactaaaaacataaacattagctgggtagctgggtgtggtgacacatacctgtaatcgcagctactcaggaggctcaggcaggagaatcgcttgaacccgggaggcagagattgcagtgagccaagattgcgccactgcactccagcctgggagacagagggagactctgtctaagaaaaaaaagagtaagtaagagtaagtccctgggccaggtgccaagccaaggttttggctttggaatgtcatgtcagagggtgctgtagaacccagggctgtgggcattcacatcggctatggtgttggctcagcttctggagaaatatttattgttttcaggaaaatagaagtaattgggggattagagggagaaaaatcaccttaatatacaacccaatgattctgccctgcaaaacgggagagaactggaactcatgagatgacaagaaggagagggagggcaaggcctcaaacttcgctcataaaggtcaacgccccctggcctttggcagaagcagcagtgacctgatcctcagtggccttactatttagcacacactaactgaatgtcttccgggtgataggccctatgttggacacactaaacccttcagtggctttctgttctcgtcaggacgacatccaagcaccttgacctggcattcaagacctccgtgatctagctacagcctcacttcctacttcctctcctgtctactattttaagtactatgtttccaggaatctaagatgctatcaattctaagatacatccttttttaaagatattaaaatgtgaaaaagtggacatctgagaatctatgaaatatggtattttacaaaccattgaaaatggaactgcttgctttctccccagatgctgtgctgtttcaggcttctctatttttttaagctattttattatggaaaatttcaaacacacactcgagtagggagaataagtagtacatgaactctgtcctccagctacaacagtgatccactcatggttggttcacatgcttttcctatacttccttctccctggactggtaataataataagaatagcaactgccagtgcttactaaggatttagtttttttcttaaatgtataagttaatatatgcttatttaaaacatattttgaaatcacagccaagcataaagaagaaaatgttactgacatttgggttggtggttggttcctttccagtttcttctctatgaatttttaacatagttgaggtcagattatatattcaattttattaaacatagcattataacataagcgtagctaacattgttagaaaatctttatatgtttttgatgagttcattgtactttatacaaaagacgaaccatatccattcattcattcatccagcaatatttgttgcacttaccatgtgtcaggcactctcaacagtggtaaaagagtgaggcccattctctggcctctcaaagctcagtttccccccattgtttgacattcaactactttccaatttggagctgttatcaataatgttgcagtgattatccctgtgtgtaaaacttttcctaggtttcagatgatttcctttagacagattctcggtagtgaaattcctattttactttacctttgtgaacactgaatgttatcttaattttagtttagctaattcagtaggttaaaaaagtatctcataatttcaattgcatttctttgattatttatcgaataaatcatctgtatatttattaaccattaggtattttttagttttttgtttttaagatggagtcttgctgtgtcatccaggctggagtgcagtggcacgaccttggctcactgcaacctccacctcccagcttcaagtgattctcctacctcagcctcccaagaagctgggactacaggcgtgcgccactgcactcagctaatttttgtatttttagtagagacgtgttagtatgttggtcaggctggtctcgaactcctgaactcagatgatctgcccgccttggcctcccaaagtgctgggattacaggagcaagccaccgtgcctggcctaccattagtttttgtgaattgtcttttgacaagagtcttacttttatcacctgcaatttctcagcacaaggcctgactctgttcatttccttttgcttgctgtgatctggggatgtattaagtataatcatgtttcatgcttctttttttcctcctggctctcttccacctcacttctctccccacattttcctgtctcaaaggggagttgggtgagtcacataaagggtacagcaggtggcatatgaagtaaattccccagagagacttctcagaatgctgtgaatggtgctgatgtcaatttggaggcaaaaagagtgatgaggaaatggattggcaactctgatgctaaatttgtccatgccaaagcactgggatattatgaatgatggttcattctgcaggcatctttagaatactgctatatgcccagatgcgtgtggggtactcataagggcttaatagctggagaagacacaaatgaaataggtcataattaatagtcaaccatatacatgttggatggtttcaggctaagtggagatgcccagcagacagttggaaatttccatctgaaacttgaaagtgagggcccaggggaggataaggagccagtgtaggagacacagcaggaaccggcagagctgaagggagagaacaggggaagagaaacttcacagaagctgaggaaagagggagtttccagaaaaggggtgtgtttgggggtgatgtcatgtttttaatttagggcaacaaaaaggttatattacccatccttcttttattttcatttttcttcatttttatcttttttcttcatttattcattcctttgttcattcctttattcatttattcattcctttgttcattcagtatttatggagtaccttccaggtgccaagtattgcattagacactgagggtacagaaacaataaggcacagcccctcctccagtctaaatgagagatataggtgagagtggaagcaaattcctgatataggtgctatgatctattcattaagaatatttattgaatacctaagatacgccacatacattgaggaaaaatgcaaggaagccctatgaccttcagctaatccacttgaagtaaaaagtagtgcctttatcttggtggaaatcatggaaatcaatagctatatccatgagtgtttttgagtttagagtatttgagggctttgtgtgagagaccaatgccaaaaataagaatacagggcattcatctctctggggtcctgtttcccatctgtgaaatgggtatgtacacctctcataggattcacatgtgtctaactttcccactagactgtgagtgttctgaggatagggatcacacatggcacaggctaagatcagtgaatatatgtggaattaattactctcataagggctttctgtctttaatggcctgtgctctgctgtcactaaaataaaggtccaagtacattctgtggaaggccagaagcaatggtgatgaatttagacagggtcctgaaggacttcccaaaaaaggtgcactttgacctggacctcaaagattagataggattacagagggcagggaggcgctttagaatccttaatcctggattccagtgacttcttttctaccctctgccctcaaggacctaaccagttgctacctaagtgttcttggactccaatttacttatttatttttttgagacattgtcttgctctgtcacccaggctggagtgcagtggcatgtctatggctcactgcagcccccatctcctaggctcaagtgattcttccatctcaggctcctgagtagctgagggaccacaggtgtaggccaccatgcccagctaattttttgattttttgtagaaacacagtctcactttgttgcccaggctggtctccaactccagggctcaagcaattctcccacctcagctgggattacaggcatgagtgactgcacctggctgactccatttttattacctgtaaatcagtagtgacaatgacacatggtgggctagaaagagcactggatgtagagtcagaatatttgaatttgagtcctggttgagcctaaaaataaagagctatgtggccttgggaaagtcactgagtgtctaggtctcagtttttctatctgtaaaagaaaggagtcagactggatgaactttaagattgatttcttctggttctaaaatgtctgcattggggacaagggctgcaaaactgcccattgggtactatgctcattacctgggtaatgggatcagtcataccccaaacctcagcatcatgcagtatacccatgtaacaaacctatacatttacctcctgaacctaaaacaaaagttgaaattgttaaaaaaaaaaaaaaaagtctgcatcacagaatcattgtcaggctcctgtaagatgatgtaataaaagtacttgtaaactgtagggtgctctataatgtggtctatatggctgaggacggataggtataatattaagctagctccaaaggaccatttttaccactttcagtcctctgtgtctcccaagctctattgaactgctctttccttcctaaagagctctccccttccagtttccttccattcccatgggacataatgtctcagctctcagctgctgcagaaaaacaaagcacttggagctgagcagctgtgggtcggagggtagcgcatgggggaaagctagcttgaaagttctcattacctgcctccctggtgctcatcatccccatccactaatcttgcctggattgaagacgggaagagagaggagtctggctggaggaatgcacaggcaacagggcacgacccagggatgaagaccccagagataacctctcactttttgtgtgacctctcaagttgtcactgctctgggcctccctttctttgtctatgacatggaaagtgcccagaaaaaggaggtgatatgtatgagctcacagaccctattccaaccaatcctgaagttctaaatgagctttcccttttcagcacagtcagcccttgagtttcttttgctagcattcttttaagttcctagtatgtggcaggtgctatagttgagggcctaatagttagctaaatatgacttgattttagggtgctcatagcctgaaagaggagacagaaaaacaaactggtaactataacaaatgtgatgtgtacagtgatattgatagcagcaggaggcagacaaatgcctaggcagatagggacaggtccctgatgaaaccccaccttcaagccaaaaacagcctggactgctgctggttctggatgaaacccatgacccagagtgagaacttgtgttcctgtttgcccaccctttcctggttggttctttttgaataatgctttttaaccaattaaatgttgccttttccagtagtactcatggcccacccctcacctgtcctgtgcctaaaaataccccagactcagccacactgggagagatgacttgactttgggtgagagaccccacattcctgatccctctctactgagagctgtttcgtcactcaataaaattctccaccctcatcaccctacagttgtcaatgtgacctcattcttcttggatgtgggacaagagcttaggaccctctgaatgcaagtacccaaaaggctgtggcactgtggccccctgccctccactggtggaaggcagccaccccgtgcgacagaagcagtggtggggccaagccagtcccggagctgtgggctagagtggagcaaggagctgactgagctgttagcatgccactgtctgttgggctgctgctgatggggctgcaagagctaattagcacactgtaacacccctctggagctttggggttgcaggcacccctgcctgggcactgccaccttccccttggggtgacatgcctggtcaagccacaagcccctcacaaagcctgctctcatgtcagcactcggaatggctggctggaccctgcacttgctcactcacacatcccctccctccaggggccgaaggtgcggttgcagtggccacgggatttgtgctggaagcttgccctcagttgcagccctgagggccagagttgatggggtgtctccttctgtgagcctggcaaagtgactgagaaaaatcctgtgccggtgtaatggcaaacatttaaagggcaggggaggaattagtggggaaagaaagttagggaaaacttcagaggatgtgacctttgaatatgtttgtgaattatagaaggcaagggcattccaggcaaagatcagcatatgcaaaggcccaggggtgcgaaggagctgcgtgtttgggaaaccacaagtagttaaggcaaaaactggagctcactgtttcagttaaggaatgacaggaaaggaactagcagggaagcctgagctagatcctgaagggtctttatctactgagaagcttggactccatcttgtaggctttgggaggccagcagacggagatgggaaggtttggatttttccaaaggaccatctgacattctgtgtgctctatccaaattgttacagacacccccatacatttatcctttcaacaaatatttattggaacactctggccctgtgttccaggtgctgtggcatgcactggagatgcaatagtaagcaaaaccagacatcctgttcttgtggcactggtagtttggcaagggagacagaccttaatcaaataattacacaaataaatacaaaattacagtgggagtgagtggtacaaaggagaagctcatggtgccaggaaagcatataattggagcatgtgacttttccaggatggtcagcttctttgctgagctgagctctgaagagagagcattacctcagggaagggcactaggaaggctctctgggaatgggcctcttccgcttcagaacccccacccaatacatgtttacctcctatggtaacagacactgtagactttaagcaagtaccggcttgtattcatctgtttgtcttcaggacctaaccaatgcttggcacagaatcagtaccaagtgaagatttgaaagaaaggaaaagagaagtgcctttaggcactttaaatagttgaagatagcagtactatcccctcaatggctaaacatcttccttcacctggtttcaagttcccttcactcttctctggctgttctgctaatagtcaaggcccctgtgacaagagatttaaatcagtgaagtagccttgtgaaagaggatggtctgttgggagacagaagacctggttttatttaagcccgttttcatgatttcctgtcattcacctcttcaagcctaagttgccgtttttatagaacagagatattggtccttctctcacagggtttctcagggaataaactgagataataagaaaaaaacattgtaaactgtaagagttaaggaagtgtaaggatttgaatatttggagggctgccacatgagtaaagaattagatttattctttgtgtctccagagaacagtattaaatcagtgggtagaaattactgtatgtagatttcagctcaacgaaaggaagaaatgttctaataatcagaactgtccatcagtggaatggctgctttgtgagggggtgggtgtccaagttggaagcactcaatacaaggatgttgtggaaggaattcctattttaagtgagaggatggattgaatgacttctaaggtttccttttaaccctaaaatccaaaaatctgatggtcaagacaagcagagaagctgggagagggtgtattgtggcagagagtagcatgaacagagatatagagcagaaatgaatgtggcatgtgtgacgaccgtgtggaaaactttacgaagaaatgaagagtgtgtgttggatcacatgtgatttcatttaagctttctaggtgatttccaatcttatgctctggtggaggggagattgttggtccctggaagccttagacatggttagaggacttcctgtattgggaggctgcagaggatcttgggggctaaagagaatcaagaatacaaatcaggttggactttaggctgtgttgaaaatgcacaggctttggtcaagacagaatttgaattttttttttttttgaggcaaggtcccactctgtcacccaggctgatgtgcagtgtgcaatctcagctcactgcaacctccacctcctggcctcaagtgatcctcccacattagcctcccaactagctgggactacaggagcatgccaccatgcccagctaatttttgtattttttgaagagacaaggtttcaccatattgcccaggctggtcttgaattcctgagctcaaatgatccgtctgcctcggcctcccaaagtgctgggattactggcatgagccaccgtgcctggccagaatttggattctgtctgcctccttattgtttgtgaccctagcaatttacttaacttccatgagcctcagttaattcatatatcaactggggactcaaacttgtcctccttcaagctgatataacaattaagagaaatgacgtaaacggcatcctggaaacagcacaagctttggaatcagacagaccaggtttgaatctcagtctgaaatgaactgactgcaagatcttaggcaagttatttaaaactttacctcatctgtaaatagagatagtagtatttcagaagggttttttgaaaataaaataaaataagaaaggtgcctactaacatgtgcctggcatgtagtaatgctcaactaacagtgttattttgttaccacaaataatgtaatgggtctcatatataaagcacttaccaaagtgctcagaacatagtgggtgttcagtaaacattagtccccttctgtcttgcccacatgtctgtctgccacactgagcaggctatgggagactagagcagtggtgctcactctcgtgtctgttctctggcataatcctctgcccatatgaagagctcaatgaatgtctgttgtgtagaagtgaactgatttctcttgatgacatggtctccttcctcaagtagccagtgagtcactcctctttctttctcctccttcccatctcctctgtgattctatttctgactctcatcagtaggaggagaatcaatgttcctcagtgtgatttttaaaaataaaagggagagattcaggagtgattctctgggctgctttccatagagcacaggatagtgagagctggagtgttgtgtttccaacctcgcttttctttaagtgaaataaaaatgtcaacaatatcaacagtaatagcagcacttactatgagctttattgagcacctaccatgtggccagtgctctgctaggctctacccctacattatctgtcattctcacacagtcacttcaaagtataatattattatcaccacctcacagttgaggaaactaaggctcaattacttaaaaaaattaatttaaaagttaaataataaatacttctatatttggatacctattataagccagacacttaaaaaatatcatattatgaaaaccctaccaagtaggcatttttatttccattccagatgtgaggaaactgaacctcagagagataaaataaccaactagtccaaaatcacattgctgatgaatggcagagctgggagttaggccaaggcctgctcaactcttaagttcacccattctctttctaacaggtcatgttgctactctttaagggaaacattatattgacactctggctggaggcagccctgggtaggtttgaatggaatgggaaatgacacatatagcatgagacccatccactctagcagggcagaccctgggaagctggccctgctcctggaactgcctttggaagtgcaaaaacaatagctgatgcctatgtggtatttactacacagcaggaactgttctaagcatttcgcatataataacattattaatcctcacaaaactctgaggtaggtacaggcatacctcggatatgttgcaggttcagttccagatcaccataataaagtaaatattgcaataaagcaagtaacatgaattttttggtttcccagtgcatataaaagccacgtttatactgtagtagtctattaaatgtgtagtaatattatgcctaaaacaatttacatacattaattaaaaaatactttaggccagatatggtggctcaggcctgtaatcctagcactttgggaggctgaggtgggaggatcactggagcccaggaggttgaggctgcagtaagctatgatctcgccactgcactccagcctgggcaacagagtgagaccctgtttcaaacaaaccaacaaaatactttattgctaaaaaatgctaacaatcatctgagccttcagtgagtgttaatctttttgccagtggagggtcttgccttgatgttcatgggtgctgactgatcaggttggtggttgctgaagactggggtggctgtggcaatttctgaaaatagggcaacagtgaagtttgctgcatcgattgattcttcttttcatgaaagatttctctgttgcatggtgatgctgtttgatagcattttacccatagtagaacttctttaaaaatttgagtcagtcctctcaaaccttgctactgctttatccaactatgtttatgtcatattctaaatcctttgttgtcatttcaaggatgttcacagcatcttcaccagagtagactccatctcaagaaaccattttcttcgctcatctgtaagaagcaactgcatccgttcaagttttatcatgagattgccacaattcagtcacatcttcaggtctcacttctaatcctagttctcctgctatttccacaagatcttagatctgcagttacttcatccactgacgtcttgaaccccataaagtcatccataattccaaagtttggaatcaatttatttcaaactgctattaatgttcatatttttatctcctcccatgaatcacgaatattcttaatggtagaatggtgaattccttccagaaagttttcaatttactttgcccaggtccaaataagccttgaaagtcaaaattactccttgatccatgggctgcagaatggatgttgtgttagcaggcatgaagacattaatctccttgtatatctccatcagatatcttgggtgaccaggcacattgtcaataagcaggaatattatgaaaggaatattttttcctgagagtgggtttcaacaatgggcttaaattattcagtaaaccatattgtaaacagatgtgttgtcatccaggcttagttgttcgatttctagagcacaggcagggtagatttagcatagttttgaggggcccttggattttcagaatggtcagttagcattgacttcaaattaaagtcaccagctgcattaacccctaacgagaaagtcagcctgttctttaagctttgaagtcaggcattgacttctctctagctatgaaagtcctagatggcatattcttccagtgctgttttgtctacattgaaaatcacttatttaatgtagccaccctaatcaatgatcttagcaggtcttctggataaccttgctgcagcttctacatcagcatttgctgcttcaccttgcacttttaggttatgaaaatagcttatttccttaaacttcatgaaccaacctccgctagcttcagacttttcttctgcagttccttcacctctctcagccttcatagaattgaagagagttaaggccttgctctgaattaggctttggcttaaggaaagattgtggctagtttgatcttctatccagaaaccactaaaactttctacatattgccaataaggttgttttgctttcttatcacttatgtgttcgcaagagtagcactcttaatttccttcaataaatttacatttgcatttacaatttggctaacgtttggtacaagaggcctagctttcggcccatctcagttcttggcatgccttcctcactaagcttaattatttctagcttttgatttaaagcaagagatgtgtaactcatcctttcacttgaacacttagaggccattgtgttgttgttgttgttgttgttgttgttgttgttattattttgagatggagtcttgctctgtcacccaggctggagtgcagtggtgtgatcttgactcactgcagcctccgcctcctgggttcaagtgattctcctgcctcagcctcctgagtaactgggattataggcatctgccaccatgcctggctaatttttgtatttttagtagagacaggatttcgccatgttgaccaggctggtctcaacctcctgacctcaagtggtccacctgcctcggcctcccaaagtgctatgattacaggcatgagccaccacgctgggcccattgtagggttattaattggcctaattttaatactgttgtgtctcaaggcatagggagtcctgaagagagggagagatgggggaatggctggttggtggagcattcagaacacacacaacattaagttcactgccttaatatgggtgtggttcatggcaccccaaagcaattacaatagtaacatcaaagatcactgatcacagataaacatgacagatataataataatgaaaagacttgaaatattgtgagaaataccaaaatgtgacacagagacatgaagtgagcacatactgttggaaaaatagctctgatagacctgcttgagatagggtcaccacaaacattcaatctgtaaaaaatgcaatatctgcaaagtgtaataagttgaagtgcaataaaatgaagtattattattattcccgcttcatagataaagaaactaaggctccaataggtaagttgcccaaagagaggattacacaaaagcatgaatatcaggagacattttagaagccattttagaggctgtgtactatagtcacatagtgagtaagtggtagaatagggattcacacccagaagcctaactccaaagatcacagtcttaacctcaagactatatggcctttttgtttaacaaacagtggttaaattgctactgtgtgcacagccctgtgctacgtactggtagtactgagataaaactgactccatgtccaaactcatttatggggtatataccagaatttctaattagttgggattcagttgggtgacaagactcttggagagcttgggcacagggctaggctccaggcagagatggaagactcgacactctcacagaataacagggcatagtttagggagactgaggagagctcaggcctgatggcagtgcaggcgctcagaaatcctgcctgggcttctagaccaggaagagtggcttaattccaaatcctgcaggacaggatttagggactgaacctacagatcagtgggaggtctattctttggagttggctctgaggagctcaggaagcagaggcaagggcataggaggagtggatcaaatactgcgtcaatgtttcttagtcacaaacacacagagctttgatgtggatatggcagatttctctcaataatgtctaagatttccagtgttaaatgttcagaacctcatttattcattcactcatttatccattcatctattcatttatcctcccactcactcatgagctggagaaaatatcttccagaactcatagggagaactgctgtatgtggtcagaaggaatactttgataagctgattgaggtggagagtaagatgcttaaagacattgctcaatgaaaagaagatggtgattcatatgctctccaaggagggtgagtatgttagatgcaggttttgttttatggagtaaggttatgcaagtctgggccagagctgaattgctgaggacatggagaagccaagccctgacagaaacaactgctatctttgtttttcttctcttcacatctaatctatcaccattccctataattttacctcttaaatacctcaatgaatctgttcttactctatgcctgttgttaccactctagctcagattcttatttagtctgacctgtactactgcaaagatcttctaaccagccttcctgcctcctatctcttctccttccagtccattctctacaccattgttagagtgatctttctaaatctcagatctaattacgttaatcccttggctcaaaatctttgatcttaaaaaatcaagtccataccccatagcatagtattcagagctctttctagcttcatcacctacctatgtcccatcccctaccgttcctgaagttcttcaggagtactcactgtcaaaaactctcccttctgccaaaataccactcctttacttttctgcttggaaaaggaaaattcttctttagaaaagttctccttatattgccaaataagcacactttcatgtgatgctcctgggctcggtgcagattccacccatgggaatcattatgccttctaccatatagtcccagttttcctcctcagcatatgatagtattgcactttcttaccccttgaaagttgggtgtgggtttgtgacttgctttggccagtgaaatgggaaaagtggaagttttaagagccaatacatgactcacatacttttttcccctctggtagttgctctgtcagtctttatcctggaataaagatgacaaaaagcagagcacccagccagtccttaatggatatgtaataataataaaaaataaaaccttgttgtttaagctactgacatttgggattgcttgttcctgaagaacccagcctatcctaaaggatatattatctccactttgacatcttccataactaccccaaaccaccatgtttctactttacctgaacttgtgtgactctttttttttttccttttgagacagtctcactctttcacccaggctggaatgcgatgatgccatctcagctccctgcgaccctgcctcctgggttcaagtgattctcgtgcctcagcctcccaagtagctgggattacaggtgtacaccactacacctggctaacttttgtatttttaatacagacaggatttcaccatattggccaggctggcctcaaactcctgacttcaaatgatctacctaccttggcctcccagagtgctgggattacaggcatgagccaccatgcccagccaactcatttttttttataccacttatctggtgctgatgacatattacctcatattgctaattatcaatttgctgttatatcttagccaccttcacaactctattgaggtttcctgagggcaggggtggtggttgttctatgttattatcacactaagtatagttcatggctaaggcaatatgttgtaatgggtgcaggagagagacagattagttctgaatgaatcttagtttcctcacctgtaagatgagagtaacaacatatattctccagggttttctagtatttgtggataacaggtgcaacctgtataaaaatagtggcatactgaaattatttttctccttatttatttttattataactatagatggtgttcagtagatgcttgtgaataaatcaatctttcattgatggagttgtggtggtacctgcattagacatggaatcagaagtcctggatttggctgggctttacaggctcatgcctttaatcccagcactttgggaggctgaggcaggaggatcacttgagttcaggtgttccagaccagccatggctacatagtaagaccttgtctctacaaaagtaaaaaaaattagccaggcatggtggcacatgcctgtggtcccagttacttgagaggctgaggtgggaggatcacttgagcctgggaatttgaggctgcagtgagctgtgatcatgcactcaggactggatgacagcgtgacatcctgtctcaaaacaaaaaaagctgggtacactggcgagcgcctgtagtcctagctattctgcaggctgaggtgggaggatcacttgagcctaggagttcaaggctgcagtgagctatgatgattgtgccactgctctctagcttgagtgacagagtgagaccctgtctcttaaaaaaaaaaagtcccagatttaaggcctacctttttgtcaccagctttatgaccttgaccttgggaaagtcacttgccctttctgcaatttttgcattctcaactataaagtgtaaataataatgacacctacctcactggaatctcatagaatttaaatgaggtaatatatgaggacatgttttatatatgcttaagcatcacacattctgagactgtaatgatatagagaagattggctggtccctcacacgaggactgtgtggaaaatttggaagcatcccaatgtgccctgataaccctttgctgttggtcttgtctttgttgcttgcttacgtgtttgtctttccaactagactatgagctacttgtgattaagaattgtcttaaagtcattttttgaaaaaatgtttatttctccttacataagagtaatatgtgctcattgtagagataataaaaatacatgaagaagtctgggcacagtggttcacacctgtaatcctagcactttgggaggctaaggtgggtggattgcttgagctctggagtttgagaccagcctgggcaacatggtaaaacgtcatctgtactaaaaatacaaaaattagccgggtgtggtggtgtgctactcaggaggctgaggtgggaggatcacttgagcccagggggtggagattgcagtgagccaagattgctccactgcactccagcctgggccacacagtgagaccctgtctcaaaaaaaaaaaaaaaaattacatgaagaaaatcaaaatctcagtaattcttgtctcttattcagagaaaatctctattaaccttttgatgtgtttcttctatttttttctgtgcacatatagttataaaactaatacatcacacatacaagtattgtctcatatcgttattcttacatacatgaacttacataaaaattcttacattttaaccattctcctattgttgaatatataagttgatgatatgttttcactgtctagataaagttttaacaaatgtgtttttgtacatacatatttgtctgattttctatttttatagggaaaatttttctaattttgtgggaaaaattcccagaaggaatatttctgggtcaaagagtatgaacatttttaatgctcttaagacttccaaattgattcccagaaaggctaaaccaagttccactcccacaagcaagatgtgaatttgtatatttcactgcatgcttatcaatcatgggaattattattaaaaataaggggctgggcacagtggcacaaaaccttaatcccagctactcggagactgaggtgggagcattgcttcagcccagaaattcaaacttgcagtgagctatgattgtgccagggctctcagcctgggcaacagagtaaggctttgtcttaaaaaaaaaaaaaaaaaaaaaaaagaaacaaaaataaggttaaaactttttatgtaataattacccactcaacatttcttatgtgcttgttcatgcctcttgtccacttttcctttaggattttaattattcttattaaattctatgagatttaaaaaatcattttaatctagtcagcaagcacaatacaagacacataatagatgctccttaaatatgccttgggttgggcgcggtggctcactcctgtaatcccagcactttgggaggccgaggcgggtggatcacctgaggtcaggagttcgagacctgcctgaccaacatggagaaaccctgtctctactaaaaatacaaaattagctgggcatggtggtgcatgcttgtaatcccagccactcgggaagctgaggcaggagaatcacttgaacctaggaggcagaggttgcagtgagctgagatcgcgccatggcactccagcctgggcaacaagagcaaaactccatctcaaaaaaaaaaaatgtcttgggttattagttaattgtcctggggactttttaggaaccaaagcagactttctaagagattgtttcttttcttttcctgcccaggacacagctgggcaggagcggtaccggaccatcacaacagcctattaccgtggggccatgggcttcattctgatgtatgacatcaccaatgaagagtccttcaatgctgtccaagactggtatgagactcatattcattcattcatttaacaaactgttcattaaaacctaacatgtgctaggtcctgtattgtgtgctggggaagcccagatgaatcagacatggttcctggcctcaggagtttacagacgagagcagaagacagatccataagcaggaatgaaaatatcatgtgataggccgggtgcagtggctcacgcctgtaatcccagcactttgggaggccgaggcagccagatcacccgaggtcaggagtttgagaccagcctagccaacatggtgaaaccccgtctctactaaaaatacaaaaattagccaggcgtggtggcatgtgcctataatcccagctactcaggaggctaaggcaggagaattgcttgaacctgggaggcggaggttgcagtgagctgagatcacaccactgcactccagcctgggcaacagagtgagactctatcttaaaaaaaaaaaaagaaagaaaagaaaagaaaatgtgtgctaggtgcagtgatgaagcgaggcatcagggctgtgggaacccagcagagggctctctgacccagtttagggagtcagagaaagtgccctggagttgctgacacatatgctgcattttgtaagatgaacaggagttagcccgagggacaaatgaataaggatgttccagaaaatgagtacagatgtgcaaaggtgagaaggtaggtgcgagtgttgaagggcataggtcatgaagggttttgtgtgctgctataaggagtttggattctgtcccataggtgatgacgtatgaattagaaaccaataggttcacatttgtgtttcaggaagattactgtagctccagtggagagtgaatccacatagcacttaaagtttatccctgggctgagccaggtgtccaggagcacatacagtccaagttcatcaaggctcaatatgcaatggaaatcagtacagcaccccagagttgcaacctctgagcaacttatagctttcttcctggggcacgattcccaggagaagggagcctgaggggaaggacacatgagagggagggccaggacccagtgtccctgctcagatgaggatgggggaaggtgggacatctgtgtggtggctgtccttcagaatcggagaggctgagcagaccaggcacacagcagcagtgctggccagtgctgggcttgtctccttctcccttttgcctaatggtgaccttcgaggacttcgcttctcccagggagcagttgtcataattgtgttggcttcacatacacagcttgagctgagagtgaccttgtgggctgcctgctgcactcccctgttctgaccagcagttcagggtgtcatcagcatgtctgtcattcctgggggtctgtgttctccttttctgcctcctggttatcctcttcttcctcctttctgtcccttccttttaaataactctttcttccctctaccttgggtctttctcctctccttcctctgttctcttccccttccctttactctctccactcatcattttcctcccttcctcccctctccctgctcctcctcttctctctcatcacatctcccctgaagtgtctccacgctgcccatttccctgttggccttgacccccttcccttcctccctcagtctctgttcattctgcctcaggaacacggtgactttaacacctggtgacgattcctccaagaataacctgagtttgttgctaacctgggagctgagaggaaatggggtgggagaagggaggaagatgaaagaaagagtagcatgggagataaggagagctggccccagttacctgccttgagtctgaagactgagggtctatctctcccaagccctggcctttgagttttgtctgtgggtaacttggtctcagtctcacccctacctgccatccaagccccagtgcccagaatggggcctggtttcctgtgggcccacaagaagtggtggttgagtgaattccatcctttgagggaatggcttctcaccataaatgagaaggttggtggtaagatcaactttaagagcagggtcagtagtaggttcaggttgcagttagggttgagttaggttgtcagtgtcagggtagagtcagattcaagatctgcttcaggactgaccattcactggctcgttcatttatcagcattcactgacaccttcttcgctgtgtgttctgtgctgggtattggcatcccaaagatgaataggccggtccttgccctcagggagagagacaaattcagccaagtgtaataggtgtcatggtgaacgtgcaggagaccaaaagaggaagtaatcatttctacctgatggggtctttggggaatgttaggcccatctccacaaaaagatgtcttcataatataagagagtccttttttatttcctcttaaaattttgtttttaattaaagaagtaatacatgctcacttttaaaaatgtgaaaagtacagaaatttgaaaaggttttttttttttttttttttttgagatggagtctcgctctgtcacccaggctggagtgtagtgatgcgatcttggctcactgcaagctccacctcccgggttcacgccattctcctgcctcagcttcctgagtagctgggactacagacgcctgccaccatgcccagctaattttttttttttaatttttagtggagacggggtttcaccatgttagctaggatggtctcgatctcctgacctcgtggtccgcccacctcggcctcacaaagtgctgggattacaggcgtgggccagcgcacccggccaaaaagtattttttaaaagtcttataatcatcttatatgaaggtaaccactgctgacattttggttcctgcaaataatcataatccgaggcttcagggaaggtttatgaatcacataggaggaggtggaggctaagtggatctaggagaagcttgaagaggctcccctcaaggtgttgtgggatcagcactgggccctggaggatgagttagttgtggggaaggacttcccagtgtaggcaaaagcacaagccatggaagagcttttggggaatgagtaaaaaggttagggaggcaggagaatgggtaatgaggctggagagacacagcatgagtgatcttgaactgaggaatctggacttgatcacatagctagctgggggccagagaaggcttttaagaaaagattcattgtgatcaaatacctgttttagaaagacctctctgcccagtgaggagagggatggccagatatggtagaggtggacttcaaaaagatggatgaggtttgcagctagggcttaggagtcagcatctgtgacagccagcagggacaggtatctgtctgtcctcagctgaattaattggcaataacttggatgttgctagtcctgtggaagagaaaccatttcttcacacttcacagttttctttttgtcataggagggtatgtgtcttggtcagtttgggctgctataacaagaatactatagacttggtagcttaaataacggacatttctttctcacagttctggagctaggaagtccaagatcaaggtgccagcagctccagtatctggagacagccagcttcttgttgtatcctcccatggccaagagagaaagagggctctagcctctttctcttcttatatggacacatttattaggactctagcctcattgacataattacatcccgaagactccacctccaaataccattacattggggattaggcttcaacatgtaaatttggaggtggggacacagacattcagtctataggaatatgattaacatatctctttctatctcattttagggctactcagatcaagacctactcctgggacaatgcacaagttattctggtggggaacaagtgtgacatggaggaagagagggttgttcccactgagaagggccagctccttgcagagcagcttggtatgtacatgacacatgtatgtgcatgtgtgcatttgtacacatgctcatgagagtggggtaaacagggtacgagtgtgtttgtatttatgacattagtgttgtgattgtgaattatgtacctatgtgatctgtgtgtattgttttatatttgtatgaggtacatatgggctttgtgctgtgagttttagataattcatcatttttgatatgtatatattttgttatattgaatgtgtaaataaattttaaatttataaactctttttttttaccagttccttccacaaaggacttgagatatcttataaaaatggtcacaatacaacaataaaaataaataagtaagtgagaaaattggagcaaagggaaagcaagggtgagggaaaaataagaggaagctagggtaagtattaagttcttggacacctgcaagagttggggccaaaatgttgtctttgagcttcctagcaacctttgccaagagggaaacataatcagctacatggtttagagtgtcctagtataaaaacaaacccattattccagagaagcactactcttcatcatcaactgtagagcagactctgtatgctgaatgtgaccatgtcttgaatatcaaacatccttccagcactgagtatttatatgctgttcttacagtttatctcaatgcaaattcatgcttctcaccaaaacacaattcacaacaaaagtaatagtatgaaggaacaaaactatgtggtttgagtatgtagctcatcggtgtcctgactttttccaagcttaacatattttgatccttgtgctcctttgaggcctaggtgcccaggcatgtctcagtggccccaaagcagaactctacctacctttgcttaaaagaagagcttttattttatgtattggggtccagggtaaggttgccttacaaaaagagttccatgcctgtaggtttgaaagtttgaaatcttcctctagaatagatgtactgcttagcttttagacagtctccctaagtatatctcacatccttagtgttgtaagtattgaggagtggagagtttaaagtctctgacagtttctgaagaacagatatttgggcttataggtgggtaatctgtataaaatacaagtgtgaattgtgtgttttatatatttgtattatgagtatgtgggtgtgtgtgtgttgtatacttttttctccccaaggtgtcctgtaaactgtagcaaactataagtgcttaataaacagggaggttgggtcatcttgggccttgctgtctctacactatcacagaggttctcagagtccagaaagtgcctccatgtggtccattgaccaataagcaagtgatgaagcccacacctggtgaactttagacggtccctttaggctttcaacctgtagtctccctggaggctcccagcactctccctggactgactatatttcatctgcttggaatgctctcttctactccccatcttctaccctcatccagctggtgagaccccactcagctttcaaaacagcttacacttcacatcttctatgaaacctttcccagccccctgccagagctctttatttgttctctcaatgcaccccatacgtaaaagagtcacagtacccatcacagttggatgcactcatttacttgtctgtctcccgaaagttccctgcagacaggaaatgaatcttgtttgtctttgtgcctactgtgcctagcatatggccgggcacggaggatgcaaaaatatgttttggttaattttatgatgttaagtatttgggtacttcattttattgtccagtgaagacttcctgagtgcctactctgttctaggccctgagctgtgaaataggctacatttcctggtctgaataagctcgatccagtgagaaagcctacagtaacagtcatagtccaattggtcagggctgtgacagagggatgttgggggagcatagaggaggaacgtcattctcctgggatcagagaacatgatgcccaagtggagtcttgaagataagtaggaccagtccagtgaagaagaaagttaagggcattccaggcaggggcataaccctggcagaggcaaggagctgccttgtgggtcagggaaccataaatcactggatggtgtgagtctggagtagtgttgcccaaagaggggactcacgccactggaattgtgcaggatgattttctgtatttattttctaatacatatttggatatgtattagaaaaaaatataccagcatgccaagcccttctcactaagatttttttttttgagatggagtttcactcttgtcacccaggctggagtgcagtggggcgatctcggcttactgcaacctctgcctcccgggttcaagtgattctcctgcctcagcttcctgagtagctgggattataggcacccaccaccatgcctggctaattttttgtattttcagtagagacggggtttcatcatgttggccaggctggtctcgaactcctgacctcaggtgatctgcccacctcagcctcccaaagtgctgggattataggcatgagccaccttgtatggccattctaagattttttaaaggtgaattggttaaacatttattaggtgcttaccatgtgtcaggcactatttattctaagtgtttcaaagtattatgcatctaatttaatccctctaaaaccctccaagatatgttctttccttatctccacattttgtgtgtgtgtgttttttttaacagatgagaaaagtgaggcacagagaagttgagtaacttgccaaagtcacacagctagtaagagggtagaaccagtatttcaactcaggtggtagtctggctcccagagcctgtgctcctaaccacttaactttactacacagcaaatgtggtaatcatagctgatatatattgaacaaggcactatgtgaaatgtttagcattaattatctcatttaagtctctttataaaccttcaagctaggtactatagagcatgtccaatactctcaaaaatgaggttcagagaggttaaataacttgctcaagctataccattagcaagtggtggactcagtataaacctatcaaatttatttaggaacacagatagaacacctgagattaaatcttagtgccatgtttttaggaaggcacttgaagaagaccttaatgaattggttagatttgggcaggtcaaagtaacccatctctgcctaactcgactccctgagctttctgctattgatcaccagaacttgcctatttacatgtttatctctcctcctaggcttctactgcatggattgtgtctgatttgtttcattatcctaaggacccagcatagggtagatattcattaatacattttacttattcagtgaaaaacatttattgagcacgctgagccaagttctgccctggcacttaggatataatgaatgatgaacaaacagctgcaatccttactgtcatggaactaatggggaaagagacattaaataaatacttacacaaatattaattaaaaattgtgcaaataaatgggtgaattgtatggtatgtgaattatggctcaatacagctgttaaaattgtgataagttctacttgagttaggactcttgttattgcaagtgataaaattgcaaatcaaactagctttaataaaaaaaatagaattggctgggcgcagtggctcacacttgtaatcccagcactttgggaggctgaggtgggtggatcacttgaggtcagcctggtttgataccaacctggtcaacatggtgaaaccccatctctactaaaaatacaaaaattagccgagcatgtagtcccagctactcgggaggctgaagcaggagaatcctttgaatccaagaggcagaggttacagtgagctgagattgccccactgcactccagcctgggtgacagagcaagactccatctcaaaaagaaaaaaaaagggagagaatgtattagctcctgtaactgggaagtccacaagacccagggctcaattgcactctccatttctcagctttacttatcccctcagcctctttctatagccagactctctgcgtggggagttagagggatgatggcagattcatggcttcccaattcctgcaaaaagagaccttctctctcccaaccactatgaatcaatcccagagaatactatgattggtcacctgtgagtcatgtgcccatcccagtggctgggggaggcaagtatggcaacatagtcccaatataactgtttaaaatggtggtttcctaaaggagggaatgaagggggcagatagaagttaacataagtccaccacaagtgctatgaagaagtgcaagagagaaacctaattttaggctggagagttaaggttttctgagaaagtaacacttaaggtgagaacaaaaggatgagaaaaggctagccaggcaaagagtagagtgtagggaggggcatattccacatccagaatagtcccaatgtgggttaaagcatgaaatattcatgaaattgaaagaaggccatggcacagggactaaataatcaagggagagtagcatgagatgaggatggacagatggggagagatcagatgatgcaggatcttgtagaccacgttaagaattttgcaaggatatgatcagatctgggaacagtgaagggggatgttcagccttcctcaccctcacccagtgactacccctctgctgtctcaggtattaagtcagtttcagtggtatctttgccagtgcagtaatgccattctctgctttatgggatccctcctcaggattccctttcttgtagcttttctcagctctctcagtcaagactattgatatggccaacaattcgtgtttattaaagctgtgaggctgggcttggtggctcacgcctgtaatcccagcactctgggaggccgaggcaggtggatcacctgaggtcgggagttcgagaccagcctgaccaacatggagaaacctcatctctactaaaaatacaaaaattagccaggcgtggtggtgcatgcctgtaatcccagctactcgagaggctgaggcaggagaatcgcctgaaccggggaggcggaggttgcggtgagcagagatcgcaccattgcactccagcctgggcaacaagagcaaaactccatctaaaaaaagaaaaaaaaaagctgtgtgttgtgattggccttccatatcctcaaagttcctgggacttggttgagatcatatagatgctgaggcaggtgggtgtttggaacagtagaggagttttagggacttttatttcaagaagcatgaccttttagggttctgcctccatgtgctcctcggaaaggggcttcttgtccctttcctggatctgactggagatctgaccagaacccagggaggctagtaaaagggaaatatgcttctgcctacaaaggaaggagagaccatccacaatgtagttttttgttttattttgttttgaggcaagatcttgctctgtcatccaggctggagtgcagtgacacaatcttggctcactgcaaccttcacctacgggactcaagcaatcttcctgcctcagtctcctgatcccaaatagctgggattacaggcatgcaccaccatgcccagctaacttttatgtttcttgtttgtttgcttgcttttttggtagagacggggtttcactgtgtggcccaggctggtctcaaactgctgggctcaagtgatctgccagctttgatctcccaaagtgctgggattacaggcttgagccaccatgcccagcccagaatgtagttttgaaacacacacataccagcatagtgtagtgggaaaagcacgcccagactaggaattaggagattcagagttttatcctgcttctgctactactttactatgtgactttgagcattgcatttgctgtctctgggtctctgtatttacctatctgtaaaacatgcagtttggattagttgagtaggaagatctgtttggccctatcccactttgattctgtgatttcagtttacccaattccgcattcatgactcagaccccacagactctcatacactgccttgcttattttaggtgctcaataaatctgtgtgtgtgtgtgtgttttctagattgagatgaaccaaggaaccttgtgtcattgagtctggttgcagagaaagaaaggcctagttggcattgataataactaacagtgacttaaaattcacaatatgctttcacgaaaatcctcttgtgacctttgttgtcacttctagcacagaaggctgcattatcatcagctattgtaatacagtatctgtattgctgtatagtacatagtatattatcaccagtacagtaaaccagtgattttcttgatgaagaagctgagtccagaccacttgcattttcttgcacacaatgagctgtgccacacttctgtgcctttattttcccactctaagattatgtaacttttctaagccatgtaagtagtagatggcaggccccgtactcaaactcagactttgacttaaaatcctaatgttctcatatcatccaatggtgttttcccaaaagcctgtcatagtttctcttcacatttccaccctcagccacaatattggtgagatttctttagattatgctgtggtaacacacagcctgagtcaggagaataagggtttctttctcactcattacataccagctacaagtcagctgcaactctgttccatgcattttcttactctggggtccgtttggaatggctaaaccacacaaagcctcttaaagcttccttgggacttggatcacatcacttctgcccacatccattggccaaagcaagtcacataatcaaactcgatgtcaatggagtggggagacgtattcttcccacaaggaggcactgcaagctagtggtaatgtggaggtataaaatctcttgcaggcagggcagttcacagtcactgaacacatcatggactctggggacacagaggtgaatgggttcccttccctcaagatgcacactgactagggaaacaaaattgcaaacagataattataaccttctttgggtcgatggctatgccagtcctcatcctacttgctattatttttcaccctctcctgttgtttttcctgcaaccccttctgagggtttgacctttgcaggctatgtttcccagcctcctgtgatggtagcttctggctgggactagccaaaggaagatattggcaggtgactggagatgcagcaaagggagaaatccaggtattttccccctgcctcagctggccccccagcaggggctgctcctctactgtgactcctgctctcatggttccagcgtcttttagctctaatactagtattttttgcttttgataatctctgggtttcctcaatattctgtttagcttcttagttcttccatcacctatataagcaattccttctggtttaaagaatagttcccatttttctggttggaatctgactgaaacaatcacacaaagtgccatgagagtacaggggagagagacattatatgttctgagtggtagaggtgttgtggggaagaaaaagtgaagcttctctgggatcagtaattccacagatgaataatgaagatgattaggagtagtagctagagattaataacatgagcaatggcacaaaatcaggaagcactgatgtttctggagcatagtgtgagccaggaagatgaagctgggggagtagagaccaggccatgccaggtcttgggtgttcagccagtgaggctggatattgaattgatcagacctctttcaattccagtgacacaaatccaagtcaaaatagctcaagttatagggacaggtgaatagctgaagcaaaatggaagagaaggtccatccaaggtgccggatggattgtccacatgacactcaaagttccagagaatgaaaacaagccttgagtagaaaggaagacagtgagtcccactgagcccaaatcatcagtgaccagaggatgtgagttgaaggttgataaatgacagagatgaggtggtgtcagagcaggatggagaagggatctgaaccgtggaggagacatgttctggagcagtgttgggatgaggagaggtgagtttagctggttgcaagtttctgaatagaattctgaggtcgtattcagaagcaggcagtgtggatgcagtctatgggtctgtgacagctgcctttggacagagtagataaacgtgatcatttttggggggtggaggaacatctcagattcagttaagaattgagccccattaaaaacagcagaaatgtcattgttctgaagccaattaggagaagaaaaggactgggggctagtctggataattggttgtcatcttcctggcctcactagattctcagctcctaaaagtccttattaatgaacctgaagaaaaggttaccatatggacctactaatgaagaatatttcaggaatctgacagtaattgggtggggtgcatttggggttattctgctaagcaagagaggcccttgagctggctagacccatgagttggtaacttgagtcacagttctcacattccgggtacctttgagatgacagtaaagacatctctttggcatgacacaagagctccccctgtttggccccctgctgactcaactctcaccacttagggttttctgctctaaggataacaaactgctatggcccttttggcatagaccaaggctgattttgcccccttatctgtgctctattcatgctgtctcccctgcctgttgtgctatgctagacatgcctgtgctcacacatacactcacagtgacatgtctttgtctagctgatatctgcttaagcatcagcttctccaagaaaccgtccctggtctccaggcttggttagatgctttctctgtgccctgacaatcccctggcttccctccattccaacacttattgccctgtaatattgtcaatgtgtctatcttccataacacactaggggctcctcaaaggtaagggctgtgtctgattcaccttgctgtccccaatgcccagcaccgtgctcattgagctgagctttcatgacccacactatccgtatcccctcaaccacaccctccttgctcattcccacctccttaattcaactattcattccaccaacattcactaagcacctactcttccaggtggtgctggggctcagaatgacatagttcctgtttggggagctccctgtctatatggacttctgccatgcagggtaaaaagtgctatggcaggaggaagcacagaggagaatgaagataccatatgtaagctgagtcctgaagaatgagaagaagttaggtgaagagttttgtttaattatttttaatgtaatttatttgtgtattcatttatttatttatggtctcgaacaactggccttaagcaaccttcctgccttggcacccccaaagtactgggattccaggcttgagccactagcacctagccagttttgctcagttctgacttttttttttttttttttgagacagagtctcactctgtcgcccaggcaggagtgcagtggcgcaatctcagctcactgcaacatctgcctcccaggttcaagcaattcttctgcctcagcctcccgagtagctgggattacaggcagtgccaccacacccggttaatttttgtatttttagtagagacagggtttcaccatgttggccaggctggtctctaactcctgacctcaggtgatccacccacctcggcctcccaaactgcagggattacaggcgtgagccactgcacccagcctgagttctgactttaaaggctcacatcctcactaacttcaagaagcttcctcctcctctccttccctgccagcctctccctctcctgcatccctgcatggcctctggtttcctctacctgggttagaatgttacagcttgttctgttgctgttccaactgagcgtgagacaaggaggcataagggatagacccctggcccatctctgagtctcagttttcctgtctgcaaattacaagtgctaacccttgccttgccccaccccactcacatggttgttttcgtatttgtgaactgttaatgtgaactgcagatgggagagactgatgcctttattagcatgtcttttctacaactataattgatctccctgtgtctgtatctctaacactcaacacaagacatggcacaaggtcaatgctcaataaagacttggtgggccagtcactgtggctcatgcctgtaatcccagcactttgggagaccgaggcgggcagatcacctgaggttgggagttccagactagcctggccaacatggtgaaaccctgtctctactacaaatacaaaaattagccgggtgtggtggtgggtacctgtaatcccagctactcaggaggctgaggcaggaaaatcgcttgaacccgggaggcagaggttgcagtgagccgagattgtgccactgcactccagcctgggcgacagagcaagactctgtctctcaaaaaataaataaataaaaatgaaattaaaaaaaaaaagacctggcttattgattgaccctaagtgatgaagacaaagagatttccccaaaggccctggagacagtagaggtgcaaggaagctgggagtaaggtgggccaggaacatataggaaagagaattgccatgtattcacatgccaatcatgtcatatactttcatggatttaattttcattactatcctatggggtaggtagtattcgcctcattctatagatgaggaaacagagactgggagcaattaggcaacttgtccaagatcacacagctagtagctgccctctgtacaatgtggcatgtcctcccctcagtgccacttcctcacaagggatttgtgcccctggccttgaactgtgtcctcatcttcatctgagctgaaaacctatttacttacttactggtctgcctctttcccaaataaacaatacactccccgcacctccccaaacactgccacttgtgataaggcagtcaaagactggggagtccatttttgtgacgttcattaaggaaaaacgatatgctggagggtctctgaagctgactgggtttctatggcctgagtataatgagccagcagctgcctccttcttcatcacatgtccacaattagcaggcacttctgctgcttgtctttctcaggtcaggagatgggccacaggagaggctgtcagctggaggtgggctggcaggaatggcatgtgccttccagccaaaaggctgggaaaagagaggccttgtttatacctggggggcttcagccctctctatggatggtggaataatagggagaaagagggaggggggaaagagatccctcctttgttagagaagatgataaaagaggatgttagaaagatggagaggaggtgggaggaacaagttgaaagaacagaaggaaactgtctttataacaggccacttttttacagcaatgtattcatcatctcacacactcctcccacctgttcttggtaggaagacactgttgtttgtcttatttgacaacagggagtctgagaattggagaggttaagtgagcagagaggtgaagtgacttgcccagactcagatactgttagtcggattaaagcagaggaggccaaagagacttgtaaaggaagaaaaaggtataatcaggaaaaaaaaatgcaaagtgaaagagaaaagggggaagaaatgagaggcagagctgtgtgtggactttggagacagccaaacccaggtctaaatccagtttccgctaatacagccacatgactttgtgtgagttatgcagtctctcatattctcatttataaattggagatgatgttatttacccaactggttattgtgaggattaaagaagatgatatcagtaaagctcctagcatagtgtctggcatgtagtagttgccccaaagatattaggaatcccaaggagaaaatgcaagggacacaggggaaaggctccaaaagaagggaaagaggaaggcagacagacaacagaagtgggagagggctggggactgatggagagggccacttttgcttctaagggctgccaccaagctgaccaagattccttgggtggaaagcagccttttggaatcaggagggcctttgctgtgtctcttgggacaaccaagttcttttcatcacagaaagtgacgctaagggtctcaagatacaaaatagacaagaatgttgcatacctgagatgtagttttccctgggccttttgttgggtttgtggagggagggtgagatctattggatcgttttagtggaattcagggaggaggaaccccactgagtggaaataaaccagtgtggctatgggtggaaagggcaaagaagacttattcagtgtgaatcttgaggtgcctcctagagcccagactagagctggccagcctagggggaatgagaggcaggggaaagaggaggaaaatccctgcgaaaaagtccaaaacctgggcttctcatactggtgcttttccttatcttgggcaagctagcttacttctgtaagccagtgtttgtattagtgaagtggagaggatctgactgagactccttcctcaggggcaacatgaagatcaaataaaataatctatgtgataagtgctttggaaactgtaaggtgctgtggacacacgtttatgcatttgctctgtcagcaaacactaatgaccccctctgtgtcaggcacagggttatatatttcacatacattgtcttgcctgatccttgaaataattctatgaagtaggtaaaattatccctttttacaaaccaggaaattgatttgtaaagagaataaatgactcagcccggaattaaacagctgggcggtggtagagctaggatcagtctgactgaaagaccagtgcaggaaactcctgccctgtaccgtctccttgaagcagaatcccatgtccgtggaatttagcctctttgcttcactgctgagcactggacatattaatccagagtgcttgggctgagggcacagaagggttccagcagaagggatgggaaaagtccttatctgtatctctcctctttccagggtttgatttctttgaagccagtgcaaaggagaacatcagtgtaaggcaggcctttgagcgcctggtggatgccatttgtgacaagatgtctgattcgctggacacagacccgtcgatgctgggctcctccaagaacacgcgtctctcggacaccccaccgctgctgcagcagaactgctcatgctaggcaaggcccaccttcctgacctcccctcattgtggccccacacccagtctgcttctccctgttacacactgtccgctctcagcccactctccctgttacacactgcccacactcagagcaagatgagttgctgctattctttgcctgcccctggggttctctgcagatggtcccagtaatagatactcagcactagactaacataacaggtcactacacgggtgcagaatcactttacaaaagaagactctgttttacgaaggggattcactacagggacttagagaacagtctcttttctgcctttaaaatgagagttcctccatttaccaaaatttgacacgcacacattcttcaggggcatgccaattgcgtaaagtgaggctcgcctgcatagctaatcctgttaaagacaacttctcaaagcacaacgtgcttgtttcctatcgggctccctgcggggctttctctcactacaagtcaagcttgggctctcaaagccctgcgcctgttaccacggatgcccacagggcctgggcagttgctgtggcgacaggaagagctaatcttcagagagctcagactctctaatgatgctgaaggagcaaaggctgagtcagaaacacacttaagagaaaaggattggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaagagaaaaggattatcccctacaaaatgtcagaggttcctgctatatgaaagagcaagtaggtatgctcaagaaagacaaacagagaaaaagagaaacaggcaagatcaagaaacagatcatgagtttctgattttgctgctttccagttggttcttaactgtgggaacttagtgaaattggttattagttcttagactcctagaacctgaggattttagatttgacgggatgcccaaatttacctagtctgactagtcagttctaaccttcctttttctgacaagtgactgtcaagcctaacaatcaaatctctttcttttaaagcacaccttctaggcagggacaggagctcattttccacaccatctttgtcaactctcatagaaagttttccttgtatcgagctcaaatctgcctcctggaaattcttcttcttcttccctccctgttggtaccagctctgctgtcagagacttcacagtctgtgctccctctgccctgtgacgtcttcagactatttgagaacaggaatcatgactcctgggacttgccttttctctaggtcaaatacctctataattccatctgctgttcttcatagggtcttctccctatcctgcccttttcctccaatccatcttttaactgctcttgagcagtctaactgagaagtatgattcaaagcaaaataaatcttaaggtggcatgactctgaaaaaattgagaaaattgaactcagagatcccgatcccaacccctttctcctgggagtgaaaccttagtttctaccagagagtgtgggaaaccacttctggtggaagccccttaattaaatacctgaggaaaaaaataaaagaaactcagagaccagaataaattagctcattattctagcttgcttggccacagggacatattttgttttggctgaaataatgacatggaactggcagtgattccagaaaacctttcttctctatcatggcctgaatcctcagccacctcaaaagtcagcgggcaggaggagtctctcgccagttttcttttcatttcaaatgaggctcattgtcctagaaaagtaattaactagcaaccagtccaatgactaaataaaaggaccatcca

SEQ ID NO: 15119 - DNA, 15632 bp, Human
acccatctctacttaaaatacaaaaattagtcacgcctagtggcggtgcctgtaaccccagctactcaggaggctgagacaggagaattgcttgaaactgggaggtggaggttgcagtgagccaaagattatgccacagcactccagcctggatgacagagtgagacttttttttttttttttgacagtctcgctctgtcgctcaggctggcgcaatctccactcactgcgatctccgcctcctgggttctggccattctcctgcctcagcctcccgagtagctgggactacaggtgcctgcaaccacgcccggctaattttttgtatttttagtagaggtggggcttcaccgtgttagccaggacgatctcgatctcctgacctcgtgatccacccgcatcagcctcccaaagtgctgcgattacaggcatgagccaccgcacctggcccagagtgagactctttctataaataaataaatagtaaaaattcttctggtctggtgtggtggcttatgcctgtaatactagcactttgggaggctgaggtgggcagttggcttgggaccaggagttggagaccagcctgggcaacatggccaaaccctgtgcctactaaaaatacaaaaaattagccaggcatggtggtgacgtctgtagtcccagctactcaggaggctgaggtgggaggatcacctgagcctgggaagttgaggctgccgtgagccatgatcactaatgtacttgagcctcagagacaggatgggaccttgtctttttttttttttttttttttgagacggagtctcgctctgtcgcccaggctggagtgcagtgttgcgatctcagctcactgcaagctccgcctcccgggttcacaccattctcctgcctcagcctcgtgagtagctgggactacaggtgcccacctccacgctcggctgatttttttgtatttttagtagagacggggtttcaccatgttagccaggatggtctcgatttcctgacctcgtgatccgcctgcctcagcctcccaaagtgctgggattacaggcttgagtcactgcgcccggctgggaccttgtcttaaaaaaaaaaaaaagtctttttttgagacagggtcccgctctgtcgcctaggctggagtgcagtggcacgatctcggctcactgcaacctccacctcccaggttcaagcgattctcctgcctcagcctcccaagtagctgggattacaggtgcccaccaccacgcccagctaaaataaaccctcttctcttaacttgtatccctttctgaaacaagtgaagaatgaataaatactccaagtctccaaagtttcctgcttttccctctttctctgtaattctttctttcttcttttttttttttttttaaagcaggcatctaattcctttgtaattcttgattgggaaatctttttttcaacattaatctatcccttcaagcagagacaagggaggtcaggaaggagttagcgaaaccgggcagtgggggtgtggtttactgaggaatgttccaagcttaggtgaggcaacagcacgtgtttaaatcttttggaggccaaaggaaaaaaaaaagaggataagttctcagtaggggcaggcctgtctacctgggggtttgggaacgaactgggggataggctgcgggggtttcacgtgaaaccaggaggtctagaaagcacagggatcctctcctcaaggaagaacttgccccctcccccaaagccaagagtgcccctgcagagcgaggcagagagcaactaaaagaaatttctcctgattggagggtgggtgggatgaggctgggggagggggccggggtgtgtgtcccactgtcatgtaaatatcccttccaggcagggcggctccagtgcagatttaagccgctggcacctggggcagtctcagtgttcagcctgcttccggacgggcgaggagactcgtggtctggttctgggacttccctaacagcatggcccctaaacgccagtctccactcccgcctcaaaagaagaaaccaagaccacctcctgctctgggaccggaggagacatcggcctctgcaggcttgccgaagaagggaggtacgtttctgcgctaagttttattggagatttaagggatttgcaaggattgactctctgatttttaccccccaatccctcttgagatgtgacccctaagcacccccaaagggttttaaacctgggatggtggattaagtttgcgtgaagaaccagaagggactagactgggagaacgggagtgcacgggagctcatccctgcccccaactcaacactgacccctgagcttgtctccccagcccccaaacttcctcctctggggctccctttcttggcaaggggcactgccagccagcctgaggcccctccttcacccctccacatccagccaaatccccgattcctggtggttctacctcagtatctctcagatctgtccacctctctctctgttcttgctgccgacggcggcccacaactctggcctgaatctctgccacctcctcatcttggcttccagcttcctcctcctccccttcagcctgagcatagccaatcacgtggcccactccccggcttaaacccctcccttgcctccccgcgtcctccaggtgctcagaaacttctctggcccgccaacccggtccccgccgacctctcctggttcacacttctgagactccccacctggaggcctccctcaaggtggtacccttcaccttgacctcttgggactctaccctctgatctcggggcctagacacccacttgccctttcctctccttacctgtgcaccacctccagctctctgctggaaagtcacttcctgtgggcaatctgtgagccccaacacttgggagttaggagtcccagagtcatgctgcctcaccctcttgtcattacattgtaaccagcagtttcatgcctgcccttccccccattaaacttagaggtgagggctgcattttgggagacgtagctggagctggatagagagttgactgttctggtgactaggtctggctcataggggagggttgtggtggagccttcctgggctgggtgtggataggcccagggcctgcaaggaaacgggaagctttgattggctgagggcaggcaactcttatggaagaagcactgaggaggagtcctacctcagggctcagtgtggacctgttggcacttttactgggtctcagtcccttttcctccacatgggatgcagagacctcctgcccagcttgaaacctaccttgctgggtgagccacataaaacaacttgtgcttgttttctcttctataaaatgggatccacagtactgatctccaggcttgctgtgagtctgaaatctaaggggagcactagacagcgcctagcacatcatcagtgctctagagtgcatttgtgcgcagcaaaatgtgggtgagtcttcctagtttccttccagtgagcttcctgggagcattaacaggactggaagggatggaaaggtgtgagggggttcatctaaacccaaagaacagctcctgctgcttagtaggcactgatggcatgccagaagctgtgccaagcacttctctatcctcacagccgtatgctgtggacatcccaattttacagatcagaacaggaggctcaaagagatgtgtatgtgtctgtggcgggggagatgttccaggctctggagattttttggtctgtgcttgggacactgcagcactgtgggggaatgccagcctctctctgttccagtctttctggcggtggggttctgtcctcttcaaagggagccgggggccgggcgcggtggctgacgcctgtaatcccagcactttgggaggccgaggtgggcagatcacctgaggtcagaagttcaagaccagcctggccaacatggctaaaccccatctctaccaaagacagttagccaggcgtgacgatgcatgcctgtaatcccagctacttggggggctaaggcaggagaattgcttgaactccggaggcggaggttgcaatgagccgagttcgtgccattgcactccagcctgggcgacaagaacaacaacaacaacaacaaaaaaaaaaacaaccagaggggccaggaggagaggagagaggcaagggaggaattctgagtgaggggagaggccaagaagagagaatgcagagcttctggtgttggagacggggagagagcagagtcctaagagtgggtgaataacctctcagtgtgcccccggctcgcctgtgtttactcacacccctggcccttttgctttctctttctcttcaacttcctagtgtgctcatatttatcttgagaagcactgtgtggggaagggcaggaaaagaggggcagggaggtggcagggagggttgggaggccagaaagggaacctgaaagcccactcccccatcagaaggcattacagggttccctgggacccctgcaggtgcttgggaaacaggcagataaggcacttaggagacattgtgggtcaggagtgaccctatgggtcaggctttgaggatggaagcagccagcccttggcatagtgttctcagacagactcagcccaggagcgggtcgtgaaatcaatttggtggggtgtgacctgcattttaaataggaaattagaatcacatcacccttggtaagggtaagttttggtttgtgtgtgctaggtcatgatgtcaaaagtacttctgactgttggtcacattaaaaaaactgaggcagggtgcgatggctaactcttgtaatcccagagctctggaaggctgaggctgaaggatggtttgagctcaggagtttgagaccagcctgggcaacatggtgatacctcctctctacaaaagataaaaacaaaattagccaggcaaggtggcagtggtgcttgcctgtggtcccagctactcagaaggctgaggtgtaagaatccccagagcccaggaggtcaaggctgcagtgagccatggttctgggcgacagagagagaccctgtctcataataataacaacaataaaaatagaaaaactgttttaaggtaagggctttgtcaattgctacttggtttagaatcttggttctgtcacttgcaacaaagtttagtttatgctaggcacagtgggtggctcatgcctgtagtcccagcactttgggaggccgaggtgggcagatcacctgaggtcgggagttcgagaccagcctggccaacatggtgaaaccccgtctctactaaaaaatacaaaaattagcttggcatggtagtgggcgcctgtaatcccagatactcgggaggctaagacactcaccgtgcactgtcttgaacatgaaagatgctgcttgagctttaagagctgatagtgggccgagctcagtggctcatgcctgtaatctcagcactttgggaggcagaggcaggtggatcacctgaggtcaggagtttgagaccagtctggccaacatggtgaaaacctgtctctaccaaaaaatacaaaaattagcagggcgtggtgactcacatctgtaatcctagcaactcaggatgctgaggcaggagaatcacttgaacccgggaggcggaggttgcagtgagctgagatggcaccactgcactccagcctggaagacagaatgagacttggtcccctcccccaccaaaaaaaaaaaaaaaaaaaagagccaatggtaaagtgtgagttctggaaggcagaattccaaccccaagttctggttaaaaatgtccaaagagagatttcaggtatttttttgtttttgttttagagatagggtcttgctctgtcactcaggcttcagtgcagtggctgcattggggctcattgaagcctggaattcctgggcccaagcgatcctcctgccttggcctcccaaagtgttgggataacaggagtgagctattgcatggccaggatttgaaattggccagcgtatcactaaaatcaacaaatggtactggccgggcgcagtggctcccgcctgtaatcccagcactttgggaggacgaggtgagtggatcaccccaggtcagtagaccagcctggccaaggtggtgaaactccatctctactaaaaatacaaaaattagccgggcatggtggcacgtgcctgtagccccagctactcgggaggccgaggcaggagaattgcttgaacccgagaggcagagcttgcagtgagccaagattgcgccactgcactccagcctgggggacagagcaagactcccgtctcaaaacaaacaaacaaatgctactaatcagggtttttctggctttttatggttcatgtcttggggtgctggagggacagaatgtggggcatccgcattacttgaaaagtattatttaaacaaaatgctttggccctccttagtggttcagaactttgcctctcaagtagaacttgttggcccctttcatctctatgaacagaacaccgcctatcgcttggggctgttgtgaggcctcggtgagataaccgtgccatgcgctgctgaaactggcacttaacgctcagtatgattcttgcgggcgctgggcaccgcggactaatgtggtacctccctgccttcacaggacttcgagtttaatgtggcttcagtgtcgtaacctttatcatttcataacagaaacgggttcagagaggaagggtgacttgctcaagggtacaagcttgctgggcagggcttggactaaaacccaggaatggccctgcgcgcggattacacagcctggggcttcgcacacgagcccgagtttgagtccgatcggcagttccccatctggcatccagaatggggtgccccctgctttctccacgaagtggaaggcgccgagaggccgggcggaattcggggcccccatacgaggccgggcctgcactttcggggtggtgggcgccccgctcccggtgccccgcggagcagggaagccgctcgctcaccacgtgacgcgccggccgggggcacccgcgcctccgtgcgacgccccgcccaccggcctgccgcgcgccagtgtcctgggtcgggccggagaggggagagcgggggaggggacgcggcgcggggggcggccgtgcgtcgccgcgcgccttcctcccacctctcgccgggccctgtgtctccgcgccgcgactccgccccctcatcccgccgcccaggccaatggcgccgcggcgcgagcctccccggccggaggcggagcatccgcgcggggcctggcgcgcctgcgccctgcgcccgcccctcgccgtaggaggaggtggaggaggaggcggctcgggagagcgagcagcgagctggctggatcgccgagcgcgagtgagggagccgagccgcccgccgccgccgcctccgcctcccctccgcgaacaggagcccgggccggggcccggcacgccgccccagcccgtccctcggcgtcaggccgcgagggtagcgcgcgcgagcgagcgagggggagggagagcgagcgagcgccgggaggaggcggccggaccgagcgggcgcccgcgcgtgtggcgtgaggggaagccgcttgcccgcccccttcgccttcccttctctccccctccccgctccccccccgaccgcggagcagcaccatgtcggcgccggcggccaaagtcagtaaaaaggagctcaactccaaccacgacggggccgacgagacctcaggtgagagcagcgagcccgggggccggcccgcgccgccatcttcgccgcccgccccggcccgcaggccgccggcggggcccggggcgcgcgcggggggcgccgggcgggggggcgcggcgcggccgggcgggggcccgcggactcggcgcccttttttgtgcgcggctgggctgggggcctgggtggcccgcgccgcgcggccggcgctcaagcgggggcggctgcgcctgctcggcgcgggcggagagacccccccttcctctcccccctccctcgctctcctccccctccctccctcccgagaagcctctctttattgtgctccgccatgatgcctcgctcccatcagccgccgccgccgccacatggtgcggccggacgcggccccgcgcccgacctcccgcgcggttccgcttcgcgcccggcccgcggcggcgcccccggcacccccgcccagaggctggccccggcggggcttctgcctggagctcgggtggggtgggggcgcggggaacacgcgggcggccgcgcgctgggccttggccggccgggaggatgctctggccagcccgggcgcactccccacgtggggcggccgccccgtcgcgccagcgtgcggagaaacctggcgccgcgaccagtgtatcgggggtcttggaaatggctaagaaagctggcctctgcctaggaggctctcggcaggggggctgccaatccgggatggttaccggaaatgaaccgcgcgatctggccctttcacacccacttagctttgtagggggtttgtagtctttacaggacaaaagggcacctattccagagcacacccccttttcttcctctcccttctgtgcctcactgctttccgatctcatagttgctcccagtaagtgctccaaagtcgtgtggggccgcatctgaggtctgcccgcctgaattgggttggaggggttcatgttctgagaaggcgaaggccagggtgtaggatggtgccccgtgactttccagtctttgtaggcgtgcctggtatcttcatcgtaatagcagagtcgtcaactttctatgaaaggtggttttaccttgataggtggtagtggtggcctaatttgtatcattgtcatgggtttagtttccatattctagttagcagctgctactgttctcttgcaagtgtataatgtgaaataataaacgtgaagacttctgaataaggttattctgtgtctttcatagtagaaaccttaatgatcggtctgttgtagtgaaactctttaaaaaggcgctatagaaaaccaatttctgagtaaaccagcagacagcatgacttgtaaatggtcttttaattaattaaaaagaaattagtcagctacaagcatgaacatgtggaacgcttacctttgtactaggcgtttttgtttttgttttaatggcttttggaatattatagtattaacatctggaaaactaggtaaatttatcttagaattaagttttttgctccttttttgcagaaaaagaacagcaagaagcgattgaacacattgatgaagtacaaaatgaaatagacaggtaacatttttcttaatatacttcggagaaattttctgagatgtgtctaatagcccggtaattatcgaagctatggtcaaatctatccactgtcaaaggggaaatgattctaacttggttggaaatacttatgtagattcagtgttttttggtgaagtgattgtacagaagtttttgaaagtgcattgaccttacaaggtttgggtttgctttcaaagactgaaaattgtctgaattgcagtgtaggtcttctgatggtttagcagtgtggcatcagtggttgctctaacttgccttacaactttgttatggattagccactttatttagaaatcgcgcttgagggaaacaattgaaattggactggaaatggagtgggcgaagtaaatacacacgttaccagagtgttgagtttgggcactcttaacagtcattattactcagtgtttattgataaatcagacaaaattgccatcttagttttgagtgtctaaattaggtgataatggttattataatttggttattttgcatgactcaagctagtaagtaaatacactctgtaatctcaaccaattttttaatttgttaaatactatcattgtcaacatctcttttcatttgcttcagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaaggtatgttttggacagggcattgttaaaggataaacagtgtttgttagaatggaggaagcttggtgaagacttagtccagcatgctgggttgcgtgcaacaaagacaggctgggtgcggtggcgcacctgtaatcccagcactttgggaggccgaggtgggtggatcacttgaggtcaggggttcgaaaccagcttggccaacaggttgaaaccccgtctctactaaaaatacaaaaaaaattagctgggcgtggtggcgcgcgcttgtaatcccagctactcgctacttgggaggctgaggcaggagaatcgcttgaacccaggagggggaggttgcagtgagccgagattgtgcgcttttgcattccagcctgggcgacaagagtgagactgtctcaaaaaaaaaaaaaaaaaaaaaaaaaacctcaaagacgggaaaagatatacagctactgctttctattctgtttaggagaagctatattctaattgcttgatgaaagatagtgacagtctgatattgagcaattgcctttagtcaataatgggtttataaaaccaaagatgctcactaagttcggaaaaattttaaagggatcacttaaattgttgttagtgtgtgcctgttgaaaattcagctgacctgtaattttctggcctagtgtctgcactgcttggggaggaagatgaagaggcactgcattatttgaccagagttgaagtgacagaatttgaagatattaaatcaggttacagaatagattttgtaagtatctctaacttaatcttgtttgccactgtggaaattaatgtgagctttggttggaagacctgttcatatttctaatctttcaattatttattacagtattttgatgaaaatccttactttgaaaataaagttctctccaaagaatttcatctgaatgagagtggtgatccatcttcgaagtccaccgaaatcaaatggaaatctggaaaggtatgttttgaggaattatttgacaaaaatagcattttgcctatttcagtttagttttaaccacttacaagtgcttgatactttggtcatgtggctaaatacaaaaccttaaaatataaaacgttccagtgtgctgaagccaagtattacagtagtttagggttctcattagatactacagatgtaggcaggaagatctcttgagcctaggagtttaccctgggcaacatagacccttaccttccaaaaaacaaaaaaaaagagaaaaatctagcccaagtttaagaattgagaactggactaaattttttgttgctgttgttttctgcagtggtgactgagctcttcaaatggcttgccatttctcaaaatcatttacatccgtatttaggtagtaagacatagtttagatatttatactgtgttgtgctagtggctgttaacagtggaactaattttatggaaaaccaaatgtagttgatactacctctacctgctgtacagttttataattgctcttaggtaataatggtagcgtagatagtatactgatatttgttttgcttagcttttggggaaaatcttattttttaaattatagggagtttgggtgttatggagagattgtatcaaaagctcttctggtattcatttaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggtgagttctaatactcatttattcaaggttggacttgtctcggttgtttaaaaatgagtccttatattgtgcttttttttttttaaggttcccgatatggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggtaaaagaaaatttggctaaacccacaaagataacttttaaagaattcatgttattttggggtgtatatatatatatatagtgtggtagaactgaccagaactgattgtggaaaaaaagtaagccattttgttgttcaagaattaaggaaatgtttgataagcacatggtactaatgtttaactaggttttttttggtttttttttgggtttttttggttagacttatcaccacccaagcttgtttttccctagccagtacttaggcaatataggcagtgtagctggtcaaattctgacatctctgaaataacaaagtttcatgtattttcgacaaactgcacaatttctgaatagtcaaattaggataggttggttttatttcggattatttgatccgaaatatacctgatttggttagaactgaagttactaattaatctgaagcaacatcatcacgggtgtttccttcgatgcagctgacttacaggtttagaaactggagtgcccccaggggcactcgtggggtccattgtggtccatatgaaagcaagtctcagcattaatcctgaagattaactgcccactttttctttcaggaggatgaaggagaagatgactaaatagaacactgatggattccaaccttcctttttttaaattttctccagtccctgggagcaagttgcagtctttttttttttttttttttttttccctcttgtgctcagtcgccctgttcttgaggtctcttttctctactccatggttctcaatttatttggggggaaataccttgagcagaatacaatgggaaaagagtctctacccctttctgttcgaagttcatttttatcccttcctgtctgaacaaaaactgtatggaatcaacaccaccgagctctgtgggaaaaaagaaaaacctgctcccttcgctctgctggaagctggagggtgctaggcccctgtgtagtagtgcatagaattctagcttttttcctcctttctctgtatattgggctcagagagtacactgtgtctctatgtgaatatggacagttagcatttaccaacatgtatctgtctactttctcttgtttaaaaaaagaaaaaaaaacttaaaaaaatggggttatagaaggtcagcaaagggtgggtttgagatgtttgggtgggttaagtgggcattttgacaacatggcttctcctttggcatgtttaattgtgatatttgacagacatccttgcagtttaagatgacacttttaaaataaattctctcctaatgatgacttgagccctgccactcaatgggagaatcagcagaacctgtaggatcttatttggaattgacattctctattgtaattttgttcctgtttatttttaaattttctttttgtttcactggaaaggaaagatgatgctcagttttaaacgttaaaagtgtacaagttgctttgttacaataaaactaaatgtgtacacaaaggatttgatgcttttctctcagcataggtatgcttactatgaccttccaagtttgacttgtataacatcactgtcaaactttgtcaccctaacttcgtattttttgataagcactttgcaggatgacctcagggctatgtggattgagtaatgggatttgaatcaatgtattaatatctccatagctgggaaacgtgggttcaatttgccattggtttctgaaagtattcacatcatttgggataccagatagctcaatactctctgagtacattgtgcccttgatttttatctccaagtggcagtttttaaaattggccttttacctggatataaattaattgtgcctgccaccaccatccaacagacctggtgctctaatgccaagttatacacgggacagttgctggcatgtcttcattggctatataaaatgtggccaagaagataggctctcagtaagaagtctgatggtgagcagtaactgtccctgctttctggtataaagctctcaaatgtgaccatgtgaatctgggtgggataatggactcagctctgtctgctcaatgccattgtgcagagaagcaccctaatgcataagctttttaatgctgtaaaatatagtcgctgaaattaaatgccactttttcagaggtgaattaatggacagtctggtgaacttcaaaagctttttgatgtataaaacttgataaatggaactattccatcaataggcaaaagtgtaacaacctatctagatggatagtatgtaatttctgcacaggtctctgtttagtaaatacatcactgtataccgatcaggaatcttgctccaataaaggaacataaagattttttttggactggggtcattctccttgttttatagagaaatgttacttgctattggattcagaaattgttctagttttttgtcttcacatcgttagtgactggggaagcgtgggttagcgctaatggtatgacattggtttagaaagctttgagctggtcggtgtccgagtaaaggacaaattcaaatatcttacttggatacagtttctgagtaaacagtttctgagagggtgagtatagcattttcattctgaagtctcaaaaggacttttcactaggaagaaaattgagtacagtgggtcctgttatctgcagcttcagctacatgtggtcaactacaattcagatactttgagactacattcacacctatactgtatgttaaatgtgtgaatgtatagttatagtatacaatagtcaaaattatcctataccgttaatctcttactgtgcttaatttggaaattaagttttataggcaggtacaggaaaaattgtatggggcttgatactcctgtggtttcaggcagccactggggcatcttagaatgtatctcctttggataagtggggctactgtagtcatttgaatcaatatccacaagcctgtgataactttctcacaaacttaacagtgaaacttagcacaactagtggttttacatgctggtgagcgtctagggctgtcaggttataggtcacaataacgtttattttcgggaatgtaaaaaatcgggagccctttaaggtagtagtagttcactcaactattgtgatctcctgaggtgccactaatatctgcaaatcttgtaagagaactaggctgtgagaaaacaaaatggcaaccttactgtaccaaaaacttccatacacagtagccagcatgccttgtgtccaactgcaagacaagttcttgggctggtctttagtgtgtattggaatgggctcagctccttttctcaaggacatttgaaaatagacaatagaagttgggcacagtggcacatacctgtaattgcagtactttgggaggcccaggctgaaggatcgtgtaagtccaggagctctaggccaacctggatgacagggacatcccaacactaccattaaaaaacaaacaaacaaaaaaagaggtgtggtggc

SEQ ID NO: 15120 - DNA, 6466 bp, Human
  misc_feature (1)...(6466): n = A,T,C or G
tttgttactgcttgaaatgtttgccttatatggcatgatcagatcagttagcagcctgtgactggctgagacccagctatttgttccaaaatatactcataggttaagcttttagcttgtttctgtggtacattaggttgcagtttgttgttacctagaaactcaaggcacagaggcagcctgttaattgagttaatttaacagttcaaacaaatacttatgcaccagtgtttataacagcactattcacagagttagtttgaaagcaatctaaattccttctttggatagcctagacatttctcctggccataagaaggggtgatgccctgacacatgctacaatgtggatgaaccttgaaaacatgctcagtgaatgaagccagacagaaaaggcattaacccagaaacaaatattgcatttccttgatatgaaatatccagaacaggcaagtccattcactgagacagaaaagcgaccagtggttgccagggcatgggaggagtgtggaacgggtcgtgactgcttaatggatgggagttttattttggggtggggaaagtgtttggggacgaaacagaggcggtggtggttgcacaatgttgtgaatgtcactgaattgtttactttaaaatagttaattacatgctatgctgattttatcataataactattttaaaattattttgtgaaaaactgtgatgcttgggatttgcttcaaaataatgtgggtggggtggaggttcgaaaagttaccaaaaaaaaaagaaagaaagaaagaaagaaagaaagaaagaaagaaagaaagaaagaaaactctggcttgcaaagaagaaaacggatcggccgtggatccctctccagctcgagggctggagctgcggcggaggcaggagctggaagcgaggcgtctgctggcaaaggcgggagtgcacgttgcgctcgaagccccggcagccgcggcaggaaccggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagaaaagctaccaggagagcgagacgggccccgagagctccatcatcaccaaggtcaaggggatcaccacgtccgagcacaaagtgtgggacgtggaggagtacgtgaagccccccgaggtgcgggccgccccctgccccccgccccgccgtgcaccctaccctagtgggcggagggggcagcggctgccgcctggccgaccgccccctctttactgagcccaggggggcagcgtgttcagcatcatcaccagggtcgaggccacccactcccagacccagggaacctgccccgaggtgaggggatcccgcggcgctgggggaccccgcctcagctaggcgggccagctgtcccttgcggggtccctgactgggccgcctccaccctagagcataagggtccacaacgccacctgcctctccgacgccgactgcgtggctggggagctggacatgctgggaaacggtcggtgtgcgccagctggggctgggcgggtggggcagggctgcgtccccgctaatgcctcagtgacctctgcctcccaggcctgaggaccgggcgctgtgtgccctattaccaggggccctccaagacctgcgaggtgttcggctggtgcccggtggaagatggggcctctgtcaggtgcacctgcgccccggcctggggcccagcctcccctctgatccttttcctctgaccagaggccaaacgggcggggcaggagtgacaagagctggggaggggtgggggccaatgccaggcgggggctttgcgggaagaggggactaaacaacccttctgtgcctcctcagccaatttctgggtacgatggccccaaatttcaccatcctcatcaagaacagcatccactaccccaaattccacttctccaagtaagagccgcggggtgtggtgacggcccagcctgagggctgccttctgggaatggggtatttggggtgcaggtctcgcctcctaccgcctcctcaggggcaacatcgccgaccgcacagacgggtacctgaagcgctgcacgttccacgaggcctccgacctctactgccccatcttcaagctgggctttatcgtggagaaggctggggagagcttcacagagctcgcacacaaggcagggcaagcgcaggcagggtggggccagggtgggctcccacctgcacagagagggcctggggtacaggggaccagtccctcctccctcctgaccagctggccccgctcaggcagaggaaagaaatgcgatcagcgcaacccatccggtgtggcgcttgctgaattattgacactggccatggggctggctgctggcaccccttgtgcctcagacactggacgcccaccagtacccctgagctgccccatgggcccctcagtgcacacctcacatgcagcctgggactgacccgggctctcgaggggcctctcgtgtgccctcctgacccccttctctggctccttcttggcagggtggtgtcatcggggtcattatcaactgggactgtgacctggacctgcctgcatcggagtgcaaccccaagtactccttccggaggcttgaccccaagcacgtgcctgcctcgtcaggctacaacttcaggtgctgtacttgggacaccgctgtccacactggcatagctgtggtggggtcccgagaggcccaatgcctgtggggcagccctggagtgcagaggacgagtgggcactggcgttcccattgcaggtttgccaaatactacaagatcaatggcaccaccacccgcacgctcatcaaggcctacgggatccgcattgacgtcattgtgcatggacaggtgcctgcacctgctgggggtgggtggccagccctgctagcctgggtctgagctcctcacgccccacccctcccttaagccccatcagacgccgtcagacattctgaccacgacccccattctccccaggccggggaagttcagcctgattcccaccattattaatctggccacagctctgacttccgtcggggtggtaaggaaccctctctggggtcccagcgggtgcggggggtccaccaggcccttacacaccggtctctgctggccccagggctccttcctgtgcgactggatcttgctaacattcatgaacaaaaacaaggtctacagccataagaaatttgacaaggtgtgtacgccgagccacccctcaggtagctggcctgtgacccttgcccgtgtattgggccaggcccctcccgaacccggccaccgctccgaggaccagcaccccagccctccatcaggccaggagggccaacaaggggcagagtgtggcccagccttcccgcccctgcggccttgccccatctctgccccttctgagcagatggtggacactcctgcctccgagcctgcccaagcctccacacccacagaccccaaaggtttggctcaactctgagctcctttccatctcactggactgcagacccggcctggtggggccagagagtccccagctagggacctgcacgtggacgtgggcacctcagtagcggagcatctccacgaaacggggcaccacaggatccctgtgcaagggctgggggcacgctctggccccaggcttgtgccccaccctggcatacagcccctgacacctcctccccagctggtccctacagggctgctcacttcccatcacctctcacagccacctggaacccaagccagctgagctctgaggggctctgctcccggtcttgggccctgggaaccccaccccaccccaccccacaggcgttgtaacctcgaatctgcccagactcttcccttagaagtcacaacatactcagtccaataaacctgtgagcagaaccttctggcctcgttccttggggaggagcatcgtgagcctgtcaatatgggatgtcaggccctgtcggcctggagctgggctgcacggtgacctctgtctgggtcatctcccctctaagcagcctgcgaggtgtgcagggcacatgtctgcctgccccatgacacatggtccccacagccagccaggccacggtcaggtctgcccaggctgggagtgcactgggacccaggccacctcctcagtgcacttgcttctgacagggccaccccagactccaaaccaaagctggctcatctcaaaatgtgggaggacagcatgactcaggaagagagaaataggagggaggccgggacagctgcacacaaggaaaacgaaagctcagactacagcagtgctcagaccagtgttcattcctactccatgggagggggcaggaatgccgagatgggaagtcaggccaggcgggggtggaaggacaccagcccgggagccagcactaactgcatcagggcctgggggtaatctggttactgcatcctcagatgctgcagtggttagactggtgcccactgggtggggggaggagcccagaacagcgtcatgatgtcacctgtgccagtgacagatgacatcctgcctctgaagggaaacccagtctcaggagagcaacaccacgcccaaaggtcaaagagcggagaagggcgggtaagacgaccctggtctgaccctaaagcctgagtttggaggtctcagcacaactccagagtcctcatcccagcgctgtgttcaggtggcgagaacatgtcttccatgggccccatttcccttgactgtggcctcccagcctcgggcatcggcctcaggtcaccccacggcctgcacatgctgtgtggctcacaaatatccagctcatttttggagaaactggctcttctggttgagccgctgcttgggaaccagggccagagcttcccgtttctgacccctccaccactactcaaatgcccgcagctagcctcacagtgaacccaggctgactggcgcccacggctgcaccgggcgacccctggtcctgctaggtggccttcctgggggacgagcggctgtcccccggccccatcactcctcattcctgagggttctccagattcgcttccaggaatgaagcctagtcagccagcctccctcctcccctgcttgccctaatttgatttgatctccactctggaggcctcagcactcctccatctgagcaggcatcaggtttctccaggcaggcggccccagcagcatccaggggccaaacacgtgcccagtggtacccagtccccgatctgaggcgctctgcacaaatacacagtgacaacctagagaaacttcagtatgaaatacaaataaaaacaaagtgtagcagcgatggcctcagacagtagatggcagggacaaactaaggctggctctgggccaaagacacgagcctcctggggagcctgtggggccccctccctcctgtgaggctctcgtctggggtgtctgcatttctgatttacatttcatacttgtttggtgccctgtgaaattggcctttctt

SEQ ID NO: 15121 - DNA, 6466 bp, Human; identical to SEQ ID NO: 15120
  misc_feature (1)...(6466): n = A,T,C or G

SEQ ID NO: 15122 - DNA, 75431 bp, Human
gcccaatcactattttaatgctacaaactaacacagagtgcaagatacaagctagacacagccaagatgcagaaaggaaaacctcaacacatccaaagcagttgctggtctctcactggggtatgaactctgcacttagtggttttaatacgggtgtggtgttgaaggtgtgaggttaagttccatcatggtgagaatggctgtgggtacctgactgactcttcagacaccaggcagaagtaccagtaccaggagggcctggtgggccacccagtggtagagcctctttttttaagattccccatactgactcaagaaggagaaaaggaccacaacccatgacatgtgtcctaagtgaaacaaccttcttgatactcccagggattttaggatgatggctttgctctgagttgtttcgcctttggacttgtcactatggccaaaaaggcaccccataatcatcatggagggccagactgaagacacgcacacctcaaaagcagcagccaggttagctcccactgtagggatctcctcctgtaggccatcatttgattttctagggccaagaaagagcggcactatttactccaaatcttcagccttgcagagtacaacaacacgatctagtggtgtctgaccgccccctagccctgatccaatcattttctcatgtggaattcaagctagattaaacaatgttggtgggtacagagggattctgactgattcaatctcctgattcacagcaaattaatccaaaatatcctttccttaatacaatacttttgttgttgttgttcactactctaccttcagcacctaaaacacagcttggcacatgcaaggcacccaatgagtattgctgagttacctttgttaaaaacctatctaggagccgggcgcggtggctcacgcctgtaatcccagcactttgggaggccgaggcgggcggatcacttgaggtcaggagtttgaaaccagcctggccaatatggcgaaacccctctctactaaaactacaaaaattagccgagcgtagtggtgcacgcctgtaatcccagctactcaggaggcttaggtaggagaatctcttgaagccaggaggcagaggttgcagtgacccaagatcacatcagtgcactccagcttgggtgacagagcaagattctgtctcaaaaaaaaaaaaaaaaaaaaaaaaacctacctaggaaatggctgtaaggggcctccagtgaggattccgtgtcaccctgaactgccccgcaggagagaagtggttgtgtgaactgagagcgcaggaaagacttccctttacccatgctctcagctccagtccacttccagcaccaccttctcagctcaatcgagctcagggcagtcctcagatgggcttgcagacttgcaaactactacctcaaccgtgggggcccttgttgaagaagatgaggtaattagccaattcagactgtttgagcacgtattttttggaaacttttctaattacagtcactataacagatctgctaaaggtagtttcatgattaatggctgcccgaagttaccatcctcaaactattaagccattggaaaatgctagaggcttaatactcgtgtatagacagaccctcattcccctgaatatttgctatttggggttctgggtttttagctgctcccaggctgtgtttatttccccaataactggggaaactggggaggggcacgaccccacgggagcctgcgcccacctgcccaagtactggacctggggctagcttgccgcttgctccttgccacccgccaggccccccgcccatcgcttcgcccaaatcctttcaaacaaggttccctcctgccacctgccggcccactagggtctgcgccacaggctcggcgccaccacgcagctcgcggggaggtggcccccacctccttactgcacatgcccggcagaagtccgggcgcgcaacttcgcagaacctcactgcccgtccctcctcgcctcagtctcctctgtcctctcccaggcaagaggaccggcggaggcacctctctcgagtcttaggctgcggaatctaagactcagcgagaggagcccgggaggagacagaactttccccttttttcccatcccttcttcttgctcagagaggcaagcaaggcgcggagctttagaaagttcttaagtggtcaggaaggtaggtgcttccctttttctcctcacaaggaggtgaggctgggacctccgggccagcttctcacctcatagggtgtacctttcccggctccagcagccaatgtgcttcggagccgctctctgcagagccagagggcaggccggcttctcggtgtgtgcctaagaggatggatcggaggtcccgggctcagcagtggcgccgagctcgccataattacaacgacctgtgcccgcccataggccgccgggcagccaccgcgctcctctggctctcctgctccatcgcgctcctccgcgcccttgccacctccaacgcccgtgcccagcagcgcgcggctgcccaacagcgccggagcttccttaacgcccaccaccgctccggcgcccaggtattccctgagtcccccgaatcggaatctgaccacgagcacgaggaggcagaccttgagctgtccctccccgagtgcctagagtacgaggaagagttcgactacgagaccgagagcgagaccgagtccgaaatcgagtccgagaccgacttcgagaccgagcctgagaccgcccccaccactgagcccgagaccgagcctgaagacgatcgcggcccggtggtgcccaagcactccaccttcggccagtccctcacccagcgtctgcacgctctcaagttgcgaagccccgacgcctccccaagtcgcgcgccgcccagcactcaggagccccagagccccagggaaggggaggagctcaagcccgaggacaaagatccaagggaccccgaagagtcgaaggagcccaaggaggagaagcagcggcgtcgctgcaagccaaagaagcccacccgccgtgacgcgtccccggagtccccttccaaaaagggacccatccccatccggcgtcactaatggaggacgccgtccagattctccttgttttcatggattcaggttagttgcccaccgctaaactggggagcctgagggcggtgtgggagcagcgcgggtggaaaggaggtgagaaggaaaggcaggtcaggggcgagtgggaagagaggaggctcagctggtcagcctgggatcgggggtcagggtgaggcggcgagggctcccccaaacttcccaggatgccaggggcgccctggtggccaaaggcttgttggacggcggggcgcacgccgtgcgtcccgctggagacaacctgaggtctccgagctggtgccccggctacgcgactgaatcccgaacgcaccccagatttggagctgcacacccaaacggcattggtaagtcacttgttttgcgcgcttttcttcctcctagaaagactagtctcaaataagttggccttctcaggtgtccaaaatgtggttcggaggtgcgcgcgccaactttcacgatgtgagagcagccgcgctgtagagacaccgttgaaatgtgcggaaagtaatctgaatgggaatgggcgagaactctagagactgaccacccgggagggaagtcacgcgcgcgcggcgcctaagcagctcagagccggagcccaggtcccagagctgacaattaagccgcgggacctccgcgccagtgcctccagctgccgtgcgccagccttggccgccacagcccgcctcccgtcgctcgcgggacagagaccgcctcaaagagcgtgcgcacctgcccgcgcgcgccggagctgacctctcccggcggcgggcggttaggggaaagtacctgggggaaaggtagaggaggtaaggggacccttgggggtgcccctacgggctaccagggttgaacgcacaggcatggtcacgtcggggtattgccaagcttttggcgcagctggtcgggtggccaggctgcatgcggcttagcaggagacgtcctgggctgtttgcgcaggacctctggaggccctcgagatcgtcgcaagtggaaaggtaaagcggaacaagggacaggctggagacgggggtcgcgtctaacatcaggataacttacaattcgtttccaaagagcgcggtacgcgcagagctggggaaaggtgttggatccggcgccagtccttggacgatcagtcgtcgaaaaggaggcaggggccggcggctccggcagccttggggaggggaggcgaggcggcgtgctccggccattttcagcacgggtagagttaagtttaatctgtaacctggaggggaatctgctctgatgacccagcacaaaaacggcagcaatctggtaacgcaccttcggaagggaaggcgtgctctcctcgccagtcctggggggaaagactgataagtgaaatgtctttaaaaaatctcatccgacttggaaattgattttttttttcctggtgtgcgtgtctcattttgcgccggcttaattatacggatgacaacgatttggaggaatagtaaagcgttttgagggcttgagatgaatgacggtcaggttcttaactcctaagaaaaggatgatgatagaaggaaaataccttaaatggtcttccttccaggacctattccgtaggaaaggcgtcgcggcgcccaagacttagttctgccgggctgcagcgcagactgtggttggatgcttttgtggtcttccctagtaaatacggagaaactagtttatttgcaagtggttttctgcgacagcaatgttagtctcagaagtttggaggctgcggaagggctaggcgtgccccgcttttggcttgcccctaagtcgaaattcctgcttaatgtaaacaatgatggtgtgttggctttctgtgacattaagtgttcagtttttcctctggtaatgtctcagcctgagttcaccaagcaaaatgtctctagggacaagcaagaaaaactagggattgtgttgaatttctttggtgtgcctttcaagtgtgggagctatcttcagactgggtattccgggagacccgttttcccacagagaattattcattagagaaatgagcatgttgccttgttgcaggatgaataaacaagttttttaaaagccctccgtgtcgagcccacacctcacacccatcttgctgttttttaaacagaagcccaacatagggatgtttcctgaactgtaagcaatgtaccatgttcacatgtagcgaggaggggcaatctaggaacacacactgtctttcagacagtcttccacaaactgcctcgccatctgcattacagcccaattgtaaaaacctgttacctaccggcacacactctcccccgctcaattcccctcccccgctcaattctcctcccccgctcaattcccctcccccagcttccctctttacaccctgattcaagggtggaaaagccagtgcagaccatatgaagcaactgagagctataccaacccccgaggaaagcacctatggccctccctgagaagacaggattttgctatatagacttcgcaaaccttctctctgcctgagagactggtactcagctccttccttttccagagccatttttagcaacttccccaagcattcccaactcactagtctcccagctggccctttgccccaccctgctcaactggggttagcatctgaataggcccacttgccccttttacataggtgaggtctgcggggtgaggataggctcccaagaaaaagcagatcttatggtgaaccacataggtgaattaccagccacttttaatatttcaaatggagggtgagggaggaggaggagcaggagaataaagctagctaaacatgatgatatgcccccaatattgaagttgtttcctttagtacattaatcatttgcttaatggaaatttgcttttgtgggggaggggagggcgacccaaaggtgctcttgtaactgaacttatctgagctgggaatttatgttgcaatgttccaatattgtgtggggtcaacctgatgtaggtttaaagttttgcaaacaaaactcttttatgttcatcagaattcaagaattagaaatgttacagtttgggattgttttgagatgtttctttaatgcactgcaagcctttctcaccctggagttgcttacagcctttaactcttcagccttcattttctgcagctgtgtggaaggttaaggaggaagaaagctgaaacttcagtgttggtaagaatgaggttttttggttttttaataatctacatggatttacctcaattatcagttattattatactgctcttcaagaagagggaagcttttgagaggaaactgagcagaaaccatggtgtgagtaaagcatgtctcctaactgcttacctggaaggtgacctatcacaaaaaccaaatcactaaaataaaattaagcttccaggccagtgatgtcatgtgctggctcaactgctgctcttctctaaaaaatcacccagcagagggatgagatgctcaaatgacatctttaatccccatgttcaagaatgagagatggaatttcttgttctgttgtggggttttgacactaatgactctatttcctataacttgatgtcccaaactggagcagtgggatctaagacgaaaggcccagggctagcagcccaggttgcttctagccatggtcaagtggccttaggtcagacccaacacccctctgcctcagtttcttctaaaatgagatcgctgaatgagatgatcctatttatccctttcagctccaaatgtctagattgattagcttaagaagcctggggttgtccaatttgactctacactagtgattttaaccctaatggaactcccaaaaaacatcgaaagttgctcaaataaaaagcaccagctaggtatcgcgccattgcactccagcccggcctacagtgtgagactccatctcaaaaaaaaaacaaaacaaaacaacaacaacaacaaaaaaccccgaaaaacaaaaaaagcaccagctaggaagaaatctgttttgtgttggcttcatgtaaattttgtcaaatctgctttacagttggttgcaaaatggtctcaaaaggcagtttagagaatgcagaattccactgtgtcctttccctaaactggaaacacttagccatcctgagagtcgtatttagtgtgtgttttacgtgtgtgtgtgtgtgttccccaccttctgtccctgaccttggtgtctaagaacaagcttttcagagcaggagcaggcagcaaggttgcaagtactgacctagtactgcagcttggagaggctaaccactgtgggggacggcagactgatgggaacattggttgagtgaccacaagtgctgttgaaagttttttggtaacagttttaagtgttttggttaagctagacctgaaaaaaatggtatagaagctacagctatttgagataaaccagttttctcaacctttgtttttttcatgatcactcccctcttagcttcttcagacatatgcttcttacttgcccctccccatgacattttaataccatggacatacagctagaccccactgtctgtttatgcactgcaggaccttgtcacagctaagacttgtttgcgcaccgcatcccccaaaaccagttttgcctccatcatacatgcatgggataaacaaagcaagcatttcaaaaacaaaaaaatctggttctgtcaaattaagtgatgtagcacccatttttgttttataatttctttcttacatatcaaaaggccatatgtggggggtggggggcataaattttttactggtatttgttttctttcccttgtttaaaaatctcatgagttttttcaaacgcctccaatagctatgctggtccaagcactagtggccattaattcacagggcagagaagccagaataaacagcctagtgacttagttctcccaaggccaagagcctgcaatgcggggccaccattacctgttgacagtgctcagccagcagaggcaggactctgcctgcaactattcccgggtagaaatggggaggctgccttcccagctcccactgggcatagcctgtgtgtttattttttgtgtttattttagggtaagtatgttacaaattagcagggcacatggctatgagaaaggccaacataaacccaggcagcagggacagagggtaagtggtgacagtaaagtggggagagatttaaggaagacaaaaggaaaagaagaatttgagggatcacagaaaagaaggaagatgtgggtagataagagaacccctgggaaggagcagaaaagaagatttagaaatggggaagggggtcacaaagccaggaaatttggcggttataaagaaagtcgtttgaaggaataaagagagtcttgaagagagaaaggttgagggcagcttcaagtatctggtggctaagggggttagaaccaggtgcatcaagggacagacttcagctcaacattaggaagggcatttttaaaagccaaatatggcattggagggctaccaatgaggctcacagattcgacaccattaacatcactgtccccctgagagtttcgtacagacctggtccaaaaattccaatttcataggtgtggagttttcatgcaagtacttcaattgctacactcaaagagaaagatttaacacctagaaatctagctgtctagctccaaggctaaagctttgggttttggttcacagcaaggttggtcttcaaggtccccactctcaaacttgaggggtccaaggggcacaggccaaagaccggcagccagcagaagaccacgtttcttctcccctcaaccccatgtgagagctggtttctgagtgtcctggcttatgtcgctgtcttaattagatttcattaggaaaatttgccctgggtaattgaggttgttctagaaggtgaaatataccattccccttaaacaatgatgcccagaagcccccagggtggctggaattcccactatgaattgcagaaattttaagcagagcttccactaaagccaaatttaccttccgagattccctctttcccctccaacccccacttttgcctctctcttagttgctttcccatggtgctgttcatcttttctggaatggcctctcctcccctgaaattctttgctgcatcatcagctagtctggagaaggaatccacaaatgtctggacccactgttcaagcacaggtggtcagaggacagtggcatgccttggctgaaacagaatttggggcaccttttgagaaggttgctgagctacagctaattagctgagtgaaggggtctgaactcacgatgggggccttttaatctgagcatatcaagtattttcataaagactttttccactgcctctaacctggtatcttgcctcatccatttgaggcttttttcctttagctggcatttgcttcaaacagcctggccacgcagacccctctgcagatagcagtatgctgctgcctccaccggccaaggcgggcagaggagagtctgaagggaaaaggatggcagcagcaagtcttgattgaaaagtaattaattgtacagcttcaaagtctattactactcactcagcactcagaaaacatttgtcactgggaggctgagaagcttcatagttgcctaaattcttttctaccttctctttctgcttttactttttcctcaattgaaagaaacccactgacaaccaatgacatgaatgggctgcagagaaggcacttctgcaaacttcaccacccacctcctccctgcaaagccgcagaccaaaaggaaaatgactaccaaaaaaatactgtttttcgtggtttctgttcccttccctttcacccacctcccttccctctctctactttgccttctctttgttggctacagggataaacccagaaagctgacaggtagctacctaaacttgagatatgccttatgcttttggtaatgagtaagaatcccagaatgtaagtagaaacacaattactcgttgaatacatatgccatgaaagcatcaatagagaggtgagactgtttgggaggcccagggcatcacgtgcggcttccaaggaacggggctgtaatggtgctgttcagagagtcaatggtaaagaaatacacacattctttctattgggggttccatattttcaaaacgccactgtttgccacctgtggcacctgggccatttggctttcctcagacatgcagagtttaatggaagcatgagaaattcttcccatgcctttcttagtacatcaagtgcagacgctattatttttaagtagccaagtatacacaattttcaagtaaaccatccctgggtttcgacagccaatcctgtcctcccctacttgacacatcatctcactgcagccctacactccagcacacagcccctcatgacaggggtcaagaccctggcacacagcgtctatccatcccaactcggccttttttttcaggcaccagcctctcctgacttcctcttccttagctgcataaacacattaatagactttccttcctcagtcctatcacatatttatcttttcccatgatggcaatccatccagcactggaaagctatgtttaaggtactttgctattatacaattataatggcagatcctaaaaaagccccggcaaggttaggccccagacgatgctgcccactaacatccagcactggccatctccctccagatcaaggccatgtttctgtcttgagctagcaaaattatcagccttcaggaggatcaccagacaagccaaccaatcaggccaatcaaggtggaccccagtaaacccactagccgatcacccccagctcttactataccggattcctcaggtccctgtggccttgcaggtgccacaggtgggtcaactcctcgaacatttggccacacttctggggtccctgaccccattactgatgtttcagctcttagctccactcacctaaaggacttaggtttttcagagtctggtagccagtcactacagagaaataacaggagtggaaaaaagggggaatatcagggttaaatactgggatttattcttcctagtcttaatttatctttaaattaaggcaattcctatttaaatctaagggtcctttctcagcttatagtggtgattttcaactgggggagattttgccccccagaggacatttagcaaagtctggagacatttttggttgttaaaactaaggggatgctactggcatctagtgggtagaggctagggatgctgctcaacatcctacaatgcacagggcagtcaccacaacaaagaattgcctggccccaaataccaccagtgcagaggctaaaacaccaagtctagatgagatgtgctgagtggttctgaaaccccttcctctggtgtgctcccatctctcccttctgagtcctccctactcactcctggactgtctccctttttcctgtccagtgcgccaattgttcaagattctattaccaaatgtatttctcccctaaagagttttctctgactccataaattcatctttgtaagtacgattgccaatttgaatgtgtgatctttatctttttctgaacttcagacctttcctcccagaaaatgggctgcaaaaatctccatcccaactgcccaaagttccttaatctgccatgtctaaaaccaaatcagcactgccaccttgccagcccctcccactgacttccctgtcccactcccagtgttccatccatctgggtgccacactttggctcctccatcttttgtgtctttctagcataagagctgctccaggaggatcctttgggacccctcttgagtgccgtccttcagccttcctgcttccttcaccgtgctaggtctctcctttaaacatctcctttgtgcataacccctttcctttgttctcgatcaggatcatcctccatgctgcttctgcttttcctaaaagtaggctcaaatcctcacttgcagaacaaaaaactttcaacatcctttccgtttcctgccaaaatagcctcaaaagtgcttgccctcatactccatggcatcctcagagagattctatctaatttctcctaacttttctccccctgctccccaagagccagccaaggtggccagttgtgtttacccagccacgccccatgtttcctaccattaaatcctttgttcgtggtgggcaaaccgtctcccatcccccactaccaccttctattcatagccaaggcgtctatccttccttggaggcccatataaaaagtcattttctccagcaagactttcaaggtccccccaggtggagttcttttcttccatttgtatgctgctctactctccaggatgaggaactggtatttgtctaacttgttaaatttgttttagtcacctccatgcatgtgctcccctggcaaagctcatgatatcagaaagaatgaacaaaggggtcccacagacccatgagggtgtcgaacagagaccctgaacccgttcctcgacaaatggtactttgggggtgagcgcgaggcctgacgaaagcaaacaacccctttggagcacccatggcagcctccctggggctccaaccccaatgtctactgaccttccacttgtgcaggctcagcatccctggggcctcaactccttatccatcctgggctgctcctcgcagtaagccctctccttggggtcctggccctctacctcccagccctggaaatcttcttgctcctcaccttgcccggcagtggcaccccgttggctgggttagcctgccgccatcaacacacccaagggttggcccctgggaccccacctctcccccgaggctcggcaacctgtggcatgaggaagagtgaccccacggcgctagcggtcctcgtggtcttccaggcctagccgccatacacccgccccccaccggcttccaaccaccccagcagcacctcttcgggcgttccaacgcggcgccccctattggacctcccacccatatccggtttccggtctgacgccccctgctcattcgccaggcagccttgattggcatgacccctgcccaatggctgacccggcgctggggtcggaggggagtgagttggtgttgggacccagttgggccattcagtggatgctcaagtggttaagccgtcttgcgtgggtgtagttggccaaagtttgaatcaaagttcagtgttgacatctggaagtgtgtagacccatagagctaaagcgatatatctttgggggatcccaaacgtttcccagggtccaactgtgttcgcctccttccgtgctgcgtggccacatggatggtggatgcaggggtgcaaggatgcacggtgcctgtggtaccctggctctaagagggatgcattagactaaacgggatcgcaacttgcggtggttcgcccgcctgcagctcttatacagcagcccgtgccgtgcgccctgcttgctgcagcccgccctgtgtaactcatccagcctcccctcccccagggttctgcaggtcagatgaccccctgcctcctgcccagttgctctgtgcctagacgtggctcgccaatctgtctcactggtgagaccgacctgatgcgcacctgccgagttttatgtgacccccttacagcagcttttctcccgggttccaatccctctgcagaccccagaccagagcatagcatgtgcacacatcaaggccaccaggtggtgtgggcatttacctttggctagctctgagctcaccgcagcatggtagcgggagcgcagctgcgcgggcaaccgccgggtttgtggccggttggcgggctcagtgccgcctcagtgggctctagcagtagaaaagtaaagcgactaccctaagatacccagagcgagaggagaggggctagaagggtgctggaggcaggctgtagtggggctaaaggagctgactgaccagcgctgcggccggtgcccgaagcagcgagcagcgcacctcagctccggttgccgcgcggcatggtatttatctgtgggttcagtgcgcacagcgttgtccagtctcgaaaccaccctaaaccggcattaaaccccaaccaaaatcccctttaacccttccctagaacagcaggacctgcgaaactctgaggccgctttgtgaggtcctcctctgcgcagcacgccccccacccctctcttggtgccgccgcagctactccctagggggctttgctcttggtggtacgcacccgagaccttcttattcccctgcgtcaccatccacataaacaagagagcaccctgcttgcgccgctgtgggccactgcggagacccctagagtgtgatgggggtgggggctgttaaagtgctttaccggagccaacctcagcaagtgacaaacaaaagcagcaaaaagtacacccaaggcatttaaaaaacaaattgcgtgcttgcatactcggcatcccctctccctcgcctctctctgcttctttggtgggctcacgaccacctgtcgcatccctacgcgtgcctgcgccccttcccaggcaccaaaagccttgcgctccggactaggggcttgagatccggggctgcctggaggctgggggctatgactcagagtttcaggggtatcctggggtgatgaaatccttcttcagtcccccctcccccgaggagtcggttgggttggggagggagggtttcagctcctgtactccagcgttccgaggcccacgtcttgcgtcacgtgtcccgcaacgcaggagcgctttctctggccagcggagaagcgaggagaaagactccaaatcagtcagggagaggagtggaaggagccaaaacgtccctgcgaggcctgcgctcaccagcccccttacccaaagtcccgggcccctggcgccaggagcaggctcctggagccggagccagctcggcactggaaccggcgtcctctggtggcagagagagagcgctactggcgattttcggaccgaatcggcacgctcgtcagatccaagcaggcgggactggcctggagcaaaaagaaagagagaggagggcgtaaggatagaccaaggaagaggggctggggggcagcctgggggcatgaaaagtggccaggaaggagccaagactccaccagcaacaattgagttgcttcagcctcagtctagggttccttccaggccttgaaccccccaacctcacaagggttggaaagtgaggccggtgaactttccagctggtactttgattttaaaataataataataattttttcaccctagttcggttgggtgctccatcttacggagccccaaacttattttgagaggccgccaccgtgttatgggcgtgcgcaactgcctctacggcaataatatgtcaggacaacgcgatatcccccctgaaatcggggaacagcccgagcaaccacctttggaggccccaggggcagctgcccccggtgctgggcctagcccagccgaagagatggagaccgaaccgcctcacaacgagcccatccccgtcgagaatgatggcgaggcctgtggacccccagaggtctccagacccaactttcaggtcctcaacccggcattcagggaagctggagcccatggaagctacagcccacctcctgaggaagcaatgcccttcgaggctgaacagcccagcttgggaggcttctggcctacactggagcagcctggattccccagtggggtccatgcaggccttgaggccttcggcccagcactcatggagcccggagccttcagtggtgccagaccaggcctgggaggatacagccctccaccagaagaagctatgccctttgagtttgaccagcctgcccagagaggctgcagtcaacttctcttacaggtcccagaccttgctccaggaggcccaggtgctgcaggggtccccggagctcctcccgaggagccccaagccctcaggcctgcaaaggctggctccagaggaggctacagccctccccctgaggagactatgccatttgagcttgatggagaaggatttggggacgacagcccacccccggggctttcccgagttatcgcacaagtcgacggcagcagccagttcgcggcagtcgcggcctcgagtgcggtccgcctcactcccgccgcgaacgcgcctcccctctgggtcccaggcgccatcggcagcccatcccaagaggctgtcagacctccttctaacttcacgggcagcagcccctggatggagatctccggacccccgttcgagattggcagcgcccccgctggggtcgacgacactcccgtcaacatggacagccccccaatcgcgcttgacggcccgcccatcaaggtctccggagccccagataagagagagcgagcagagagacccccagttgaggaggaagcagcagagatggaaggagccgctgatgccgcggagggaggaaaagtaccctctccggggtacggatcccctgccgccggggcagcctcagcggataccgctgccagggcagcccctgcagccccagccgatcctgactccggggcaaccccagaagatcccgactccgggacagcaccagccgatcctgactccggggcattcgcagccgatcccgactccggggcagcccctgccgccccagccgatcccgactccggggcggcccctgacgccccagccgatcccgactccggggcggcccctgacgccccagccgatccagatgccggggcggcccctgaggctcccgccgcccctgcggctgctgagacccgggcagcccatgtcgccccagctgcgccagacgcaggggctcccactgccccagccgcttctgccacccgggcagcccaagtccgccgggcggcctctgcagcccctgcctccggggccagacgcaagatccatctcagaccccccagccccgagatccaggctgccgatccgcctactccgcggcctactcgcgcgtctgcctggcggggcaagtccgagagcagccgcggccgccgcgtgtactacgatgaaggggtggccagcagcgacgatgactccagcggagacgagtccgacgatgggacctccggatgcctccgctggtttcagcatcggcgaaatcgccgccgccgaaagccccagcgcaacttactccgcaactttctcgtgcaagccttcgggggctgcttcggtcgatctgagagtccccagcccaaagcctcgcgctctctcaaggtcaagaaggtacccctggcggagaagcgcagacagatgcgcaaagaagccctggagaagcgggcccagaagcgcgcagagaagaaacgcagtaagctcatcgacaaacaactccaggacgaaaagatgggctacatgtgtacgcaccgcctgctgcttctaggtaatgcggcggactctgcctgcgggcagcagggccgccggggaaccggggagggggtggcagggctgcctggtggggctaggggctccgcagtgggaggagggggtccagccaaaggcgggaagaacttgctagaaagttccagggagggaccctaactgccctgggagcgggaggggatctttggtggattcgggtggccgaagtatatgccctccagggagaaaagtggtgccgagcgacactgagggtcgtttccggctggacaggccagcgccagcaaccgtaagctggacaggcaggggcttcaggtgagccaggaactgccggggaggggccccggggccccgggactcccctggctaggctggtggggtccacggtgggctggggtcattggggaaggcgcgccccgcctcgcctggcacggctgcttggactcagacagcttgtcgttggtgtgtgttggtgtccatattctgtgttcgcctgtgcatgatacgctgaagtgtcccctgttcctatcccggcacccccaaattacccgccgactgtgtacttgtacttgggaacgggctgtgttgtggtttgcgccatggcccgggcaaaaaactttcgctgttcgcacactctggtggtacctgcgcccgggcgctctgcggcaagcggtgcggaggacacgcggggaaggtggcggggcctcccgggaaataagcggggcccttggcctgggggagcggggaatcgcttttcgccggcctccgcgtaaccttgtttctgtatgtctttctctctttttccttttgcgctaagcgtttcctcacttctcattcgttcgccaaaccctcccgcctttacagttgaaaaaccagacacacaggtatctggggcgcccggggctgcacacctcagttcggtattctgcacacacacagctcgcctggtcgggggatgggggaaaggggaaacacaacctgctgtaggcaagtccggatcccaaaccacttgggggctggttccaagggggtgggcgtggctgtgtttaaaaaatatgaaataatttttcttcctagcgaagagcccgaggtaagccaatcatttttacaaagagtacagtaggaggggcttggtttaaaaagatgggggttatgtgttgtgagtggaatgtcacctttgtgtttgaaatgcaactaaaataaaagttttcaaaaaatgctctgagtgtatttgaagtgtgtggacaaagtatggcaaaaccgtgaatatgacttgtgaaaacaagtaaatgtttgcatgtgaattttttcaggcagctttagctgggggcaaagaggcttgtcaaaggtaaggtcttctgcaaattggctctggatacaaaaaatatataaaggtattttgattacagaagttaaaaatcatgatattcttgtcaggagggtattttggtggccttctaccttccccctcctcctctgctcacatttccccacctctcggtgccctcccctctccaggatccccctcctcaccccacagcaagaccctctcctgtatctcccagtctttccctggccattcccagttccccaccctccccccagccccccaagacttcttaacttcaaatctggggcattaaatatttttgccacatttaaacaaagcatcaattagcaatggtctgaatatgtggtttaaatgaaaacttccaaacaaacttcacaagcttaatttttacattttattctctaagactttctctaagaccttccaagggatttcaagatcacagtttttaaggctgcgctacatttgttaaatatgttagaatgtgtgatggttttttattaatggcattattggcatataactgtgctattgtgatgtggctctcacaaatcacaattttaaatgtgaggatcattttgtgtatgcccatccaggtagatcatgacattgtcatttacctaaagacatataatatggtcgttgttttaaatttcaaatgtctcaactacactaaagctaccaaacattaaatgacaatgcactggtttccctgcagacaactgattttgccataacagacccatttcaatattccaagcacagctctgggaagcaaacctgtagattgggggtgggaggacataaatgcatacagacaggagacccaagtgacagtgtgcacctgacccctaattgtcaaattggtgatgtgccttacatgcggggcctcagttgcctcctttgtgaaatgaagctttcctagcagatctccactaaggaatgcttttgcaccatgatttgagtcttctattcttcctggaggtggggggtggaggagacacagtctacttacatcaggactggagacttataccatagattgtgcagccatcaatcctgcagcaaactgtccatgtttgggaccagtcttaagaatattagaagtttcctttgtctccccttattttgtcaccaggagtaaaaattaactttaagaaaaggaaatttgctggggtcaccttgtaccttgtcctggctttgttctcgggtgctggtagccaaacacctttggatgcagcatagtccagaaggtgggctggcaaaccatgggccatgtctaacataagcctgaaatatgatagccagtgttagctgctagctgaaactgtaccactgcagtttgtcaaagcaggctacagtttttgaccaggcttccttttgcagaggtgacgtacctcttctggacctgaattattgatgggggacagggagaggaggaaggatgaggacttactcacatgtaggacaagactttttactaactttttagtcccaacatataaaacaagacatccatacatccctaccactgaaaatgcagatcaaatggctgtcctttgatatggttgctaatttgtgacatgcagattcatctgttgcttgaaaaaatgtatgttcatgtgcttatcctttctgtttttattgccgggacaatttaatctcattacagggaatcctaagaaatcaaagagagagagagagagagaaagatagatagaaatcagtaatatgattaaaattctaaaatatctaaagagttctttttaaagaagcctttttcttactcaacactatccaccaatagactgtttccatgtttctgttacgtttttaaataattttggtggcttaaacattttttaaaacttcatttaggtgtgatttcctccttaagaactgaatggggctaatagatcagagtttcttagtatctgccacatttattaaaattgtgtaggcaaatgctatatataataatggctattctgctatgatgctttatttatacagtgaatcacaattaattgtatgattatttatgccaccaagtgcaacagtatgcattgtattccatcttgcagaagcacctttttatttttcttttctctctctctctctctcttttttaacatacagccatttttttatattctaaatgcctccactgagcttttggtgtggtaggaaggacatggcttatcaggccacaaaattttggagtccagatagatttattattttctcttttcagtctcctagtaagattcatgcttctcaaagtctgaaattctaccttggttttaattcttacagatttctctcaaaaaaaattttcccatataggtagattaatgtttaaaatttacccccattatttacaatggaaaactggttttaagcaaaaagaattgggggtcatccccttactgtatgtatcctcctaacttgaaaaggaaaatctcactgctctcagtatgattagtaaccagtaataataataacacattctgattacattttttgtttgtttgatttgaaacaaagtctccctctgtcacccaggctggagtgcaatggcaggatttctgctcactgcaacctctgcctcccagattcaagcaattcacctgcctcagtctccagagtagctgggattacaagcgtgtgccaccatgcctggctaattgtttgtatttttagtagagatggggtttcaccatgttgttcaagctggtctcgaactcctgacctcaagtgatctacccagcctcccaaagtactgggattacaggcatgagccactgtgcctggccacattttacattttttaaagcctttcatctagtcatatttgtctcttgaaacagtcctgggcaataaaaacgtgatagggccccatttcataggcaaataaaccaaaagctcagagattaaatatcagacacttttttttttttttttgagaaggagtctcgctctatcgcccaggctggagtgcgatggtgtgattttggctcactacaacctctgcctcctgggttcaagcgattctcctgcctcagcctcctgagtagctaggattacaggtgcatgcaccatgcccggctaatttttgtattgttagtagagatggggtttcaccatgttggtcaggctggtctcaaactcctgacctcgtgatccgcccgcctcagcctcccaaagttctgggattacaggcatgagccatcgcgcccggccataaggcacttttactcaaagactgcaaggtaggtaaaggatcacaaatttcaaattcagataatgcttaccagaaatgtgatgataagctataaagcattatttaaatgtaaagcatgattattctaagtatactatgtgctcttaaaatcccttgccaaatgacacgtgtcgagtagtctgctactttctgaattatagcaaaacgcacagatccctggttataaatgtccattgagtatacatgaaacatgagctcccccatttctgagatggctgtcattgctttggtaatatttcatttacacatttgctttaactcatctgccagcactgcaacgttgcagtcttagtttgttgggctactgttttcctttttttttttttaaatgcaggtttttttaaaagttttttggtttttttgttttgttttgttttgtttttttgcagggtctaaagcttttcttcttgtttaggtttccactaaataataattaatcattataataataaaatgcagttacttttctgcatagctctattataagtatagcgttagaatgtttagaatcctggtctggatctcatgatcttatcaaaataactctgctccatagtctttgtagtgatttttttttaaaagtatgccttacttctagtccaggctaatttccatttagcaagagtcagtgcgtggtcttagaaatcacctttgacttttatgcaggaaggttagttgttgttgttgttgtttttaagatggagtctcgctctgtcacctaggctggagtgcagtggtactatctcggctcactgcaacttctgcctcccagttcaagggattctcctgcctcagcctctcgaatagctgggattacagacatgcaccaccacacctggataattttttgtatttttagtagagatggggtttcaccatgttggccaggatggtctggaaatcctgacctcaggtgatctgcccaccttggcctcccaaagtgctgggattacaggcatgagccaccgtgcccagccaggaaggttagtattaagcaaaacataaatttatttttagagaaggtaacctagatttgaaattcccaaaggcagccatgctccttcttctttttagagttagtttttcctccaaataaaacttacccccaaccccagcaaaattgtggctcttcaaatgcctctaaataactctcaggagacacatcagtagtgaacaacaattcgtttctacacttcttggtttcttttagctgtagtagcaaatgtgaggttcctctcaaacccactcacgccatttgcccatttaaaaatcaaatttctcaggaggagtagcaattttcaagagagaagggacagggccaattgatgtcacaaggtcctcaccatcaattaagacaagtcaacggagggaactaaaagcactgggcagcctaattgaccatctctgaccccttggaatagggactaggagactctggccctaacacgcaccttcacagatttcattaaattagactgaatggagcttttgttcccatcagattcctgttctggcctgtggtcaccctaagcataagatcatgttctctttaggaaggaagaggagaatggacctgagcctctctttgggagttctgctgaaaagtctgcaagtcctaagtggcctttatgcaatttagagactggaaggaaggcacgaatataaattgggggaaagaagcccctgaacaaaggagaggagaggtatttcaaaaagaggatatattcttttttttattgagacggagttttgctcttgttgcgcaggctggagtgcagtggtgcaatcttgtctcactgcaacctccgcctcccgggttcaagcgattctcctgcctcagcctcccgagtagctgggattacaggcatgcactaccacgccccactaattttgtattttttgtagagacggggtttcaccatgttggtcaggcgggtctcgaactcctgacctcagatgatctgcccgcctcagccacccaaagtgctgggattacaggtgtgagccatggcacctggcctttttttcttaattcccccaaaaagagggccagctactagaagcagttacaatttgagaaatctggagtcttttttaaagggtaacatgttcaacccagtgcttggcacatataagtaccccaaaacatgttttgggttttttgggttctttttgttgttttttgttttttgagacagggtctcactctgtcgcccaagctggagtacagtggcatgatctcggctcactgcaacctctgcctcccgggttcaagtgattctcctgtctcagcctccccagtagctgggattacaggtgcctgccagcatgcccagctaacttttatattttttagtagagatgggatttcaccatgttggccaggctggtcttgaactcctgacctcaggtgatctgcccaccttggcctcccaaagtgctgagattacaggtgtgagccaccataccaagcctcgacttttaattttagaaatttattttcctcctagatttttttttttctccctgctccaagtgaggttttgggtttggttagttttctgttgttgctgggttttttttttgtttgtgtctttgtttttctgttttttgcatttctcattagactattaacatgtaagttctaaaagtgccagccatctcattctgtctttctgtctccacctttcagagtacattctttgtttacattttgtaaataaaggtcaactcaagcagtagacgaatgccaccttgccacatttataattgtgtgaagtcactctcaggtgaatgatgtgccagagagagatgaggagataacttactttttgacttgtcctgtaaaagtgtcacctgtcacccctgcctatccagctcccccttctgttttgattagctcctaactataaatcaactcaataccgaggctgagctcaaggacctgagcttggattgttctatggttattacacatgaaaaaaaaaaaaaaaagaaagaaagaaaatgtgtttagtttcctttccaacagccagatggtgaaccaggccagctcatgggaattgaagatgaagagacctccaagaaagaggtagggaacaacacaacaaaacaatgtttgacttttcattatgttgatcgtcacatgctctttgagcacacacgagtcacacacctttcaagttagaatcagtggagcgcttttctacatgcaacaactgggagctatgctatgggaagaatgttaggcaactgatctgtgacagggcaatggaaattaagggagtgtgcctctgttgtacttccttagagtaaaatcccaaattgcattgcagagtaatttgttaaacctcaggagtatttaaattcaggagtattttgacttgtggagttctgcccacagaactgcacattcgatcttactaaatgttttttaatgattcaatttggggcgaggagagaggtataaaggtagtataaattgttatccaatctcaaatttattatgagtcagtcaatgtttccgacattgtcacacacacactgtgtgtgggacagagtaagtacttttaacttcctttaatgagttgataatgggaaggaaaaaaatctctgtactactttctaaagagtgtcacagttgagctttcacaagctcagtgtcaccactgagtgagcatcgattcttacaaggaaattaagacttgggctgcaagagcctcgcctctctcttctgatttatctggctcttgcctctccccctccatcaaaagaccacactatctctctcctcttttccatttgaacgattttgccattcatcaaactgattgctaatgtgcaaattacatgatggtatttttacagggaacctgcattcaggtaagtttgaagctgtgggatatttgagggggaaaaaatgaataatgcttatcatgatccacagaaactaaagtcaggcattgtaggacagtccagaacccaagaagggccatggacaggacccttccaaaggaaagagaatctcgtgtcccgtgtgttagcgagtatccattccagctcccccagggctctgggacccacatatctgtgcctccatttttctagggttgtagtagctggtggtccagttgaaaaaaatgaaaacaggaaacctgtcaagaatagatagtgttatttaggaagtatataggtacttacattactgagaccacttgaacacatccttttaaatagataccttttttaaaatctatggttatgtaacatctgtgtccgagggatttaagcagaaagccctgtgggtttctcttttcaaaagacagaccttatttataatcagcccctcgatttttttgggggggccttcatgggcttttgaaatcttaggaagtgtccatcctaattccttatagctgctctttctgtggctctactagggccttcaagatgctgaattcacttattaattaaatcattgacgtcattcagggggttccttttgcccactgccccccaacatgggaatttttaaatgactggctctagaagggcccaaagatggtgaaggtgaattgatatttcaggtgaccactagatggtgagacagtataaggcagaaaacaggtggcacgtgtctgtgaaaatgagagggatggccagggctggcaaaggcaaagaagggtcccccttgacttttaatgccagcccccaccccaggacagaccttggattcaaataggccccaaagctttagccagaccagctttttacttttacgctgtgacttctcctagttagctatatgccaggattttagaagcattttggggggctcagtctaacagaggggtcctccaagtggctttattgacattttttcatggggtggttgtcctatgcactgtgggatgtgtagcagcatctctgacccctacctaccagacacacacacacacacacacacacacacaaacacacacgcacgcacactctctctctctctctctgacaaccaaaactgtttctagtcattgccaaatgtcacccctcattgataactactgccctaacatcatcagtatcaaattctggggacagttcaagatcatacatactgtaacttgcgtatcttaaaaatatatatattggggctgggcgcggtggctcacgcctgtaatcctagcactttgggaggccaaggtgggcagatcacctgaggtcaagagttccagaccagcctggccacgtggtgaaaccccatctttactgagaatacaaaaaattagccgggcgtggtggcgggcacctataatcccagctactcaggaggctgaggcaggagaatcgcttgaacccgggaggcagaggttgcagtgagccaagatggcaccattgcactccagcctgggcaacaagagcaaaactccatctcaaaaaatatatatatacacatatattttatattatatatatatcatatataatacaaaatatatataatatgatatatcatataatatatacatatataatatatatcatctataatataaaatacttttttttttccagagaaaagtttgtccactgcagttacttttttttttgagatggagtttcactcttgtcgcccaggctggagtgcaatggcatgatctcagatgactgcaacctctgcctcctgagttcaagtgactctcctgtctcagcctcctagtagctgggattacaggcatgagccaccgtgtccaaccctgcagaagtaatttctagaaatctcagagaagaaagtgacccagatgaccctaactagaatagaaaaggaaattatttcagggaagtaaatagtgagctgactttgattaaccaagtcagtcccatagctaggctaaatcaatgcttaaatagcctttacccttaaatgatcacatcttccacttagggtttcttaaggatgccttttcctgtagcaggctaggaattctctctctgactggtgcacactcaattaattcactctgcattgtagagaaggatgccaagacacgaaggacccatctgtcagatggctgctgacaacgtatcagctctagggtggcaggagccccactttatatgtgttccccaaaacaacagcagagcctttaactgataatgtgtacacaccagcaagcagtgtgtgggccccagttgctgggtctccctagtctcaggcccatagagaaccagcctactgcatggaggtgacctataaactttcagcaactgatctttcaagacagacagttagattgcaggagagaggggcagtggaaggaacggctctgaatgactggactgagaaagagcataagatctctcaggaataatacatagctaagccaatagaagtaacaatccaaggacatttcctggtcaagagtcttgcgcttggtctctgataaagtggacacccccttctccatcctagggcagactctgtaaccattatttcttggaataatcataataggactaaattgtgatcttaattttaaacagtggtctaagcccctaatttgcatctgaccagcctctctcaagtaaccattatggaaggggactttataacttctttgttatattttgacataacacatttacatttttgcccccatttggtctttctatagagttttcagattgtaacatctgaattcatctcatcaagttttcaaattgaaacatctgattgtaacaactgaaacagattcattagggatctaattttttcaaacaaaggagatttttttcttttttttttttccctagggagtttcaaatttatgacctctgacttcattgcaaaggccagaaaaataaataaatagatagacaatgaccactctccactccagacatgcaggtgtatttcaacactttagcttttactatcaggatttctttaggggaaggtgtagaaatatattggtagtttgataaattatatatcagacatgtaaaatttaaagtatcatttgaaatcaaaacttgtctgaagactagctttttatgtcacaagttcagctaagcaaagtgtcccctaactataaaacctccttactgcagaatcctagaaattaccaaaggcaagcttcttgaatgttgattttgaaattttgcctgcgaaagtgcaacatctttccaagcaaatgcttagaagactcagggcagaacccaaaaacaaatgccagacgttaggggaaaatttttaaaagttggattgccagaaaacttctagctatttataattaagcatttttagctgctaaaaggaagcacattagatcattttgttttgcaaaacaaatggccagtgtgggttttaggatggacactcccaggagggctcccctttctgagtgggagtctttggaaatgttcctgatgggatccagtcattctggagcgctcttacgaaatcgttcatcctagggcagtttggtgtttgtgagcttacagcgtttactccttgctgtcttctaccataggtctgatctgatgggggaggcagtgggcagaggagctccagctctttgggagggtcctagaatagtacaaacagcactgggttagaagttgggggttctcattcctgggaccttggttgattatagaactttattctaggattccatgaatttgccaagctgacatcgggaaaaggctaaagtttgattcttgaaagtattgacaaggccccatttaggaatgattctgccaagtattcctggggtcctgccatggtcaggagagcaccttaaatttgatgagttgtcagggaagaagcagagggtatctctgtgttcagctttatgtatgagaaagtcaagacacaagatgggggcaggacagggacagcttgagaaaggaggcttgagattgagacttggaactcaggtgccagggatgaatccaaaaggcttgcaggcatctcagcctcagacttaagctaacatatagcagatagtggacacctctcctgtttctttctttcttttttttttttttttgagatggagtcttgctctgtcacccaggctggagtgaagtggcatgatcttggctcactgcaacctccacctcccaggttcaagcaattctcctgcctcagcttcctgagtagctggtactacaggcgcacgccaccacacatagctaattatgtatttttagtagtgatggggttctccatgttggtcaggctggtctcaaactcccgatctcaggtgatccccctgcctcagcctcccaaagtgctgggattacaggcgtgagccaccgtgccctgccaatatttgtctttttagtagagatggggtttcaccatgttagccaggctggtctccaactcctgacttcagatgatccgcccaccttggcctcccaaagtgctgggattacaggcgtgaaccaccgcagccagctttttttttttttctggccctgcaatcttgattccccagagttagggtctgatttcagatgttaaggcaggctcaaagtggggcatctgctcgccacaagaaggtgagaggtcagaaagaagaagcaagaccattagggctgccttagttgaagaaagggggctcatctctcattttctcagaagtttcacaatccagaaaggggagaacggaaagcagcctcctaaggagttctcgaatttctttctcacttttcctttgttttctcgctctctcactctcttctaagatttatttttaaatggggttcttattttggggggactttctgagcaggaactaccttttttttggagggaaataaatgagaacacaaattattcagggctgggaagtggaaacaatgaaagaaagcaaggctactcagaaccggctggcagatggcgctcggcttttacgattgacagcctggctttcaaaaattcacccttgcgccggcgcctaaggcagaacccgcatccccctccctaaatcctccttcccaaggacacggcccctgcccctaaggctgaggaatgtttttaaaaggtttcagttgagcaattgacatctaaggacaaatcccggcaacttttaacgagtggatctgaagatcttagccaaggcaggaaagcacacgatcaggtaacctccagattcacagccctggtgccccggttctcctgggaactggtcctgagatcttggacaaatccctggttctagtttttctcaattgaaaaaacaggagggatgtctttctcactttaaaacttatttaattatcttataaagtttcaatagatgaggtatgccaaccccctatccaacacaaatttttttaaatgtctgttccaaaatggcagattgtataggaaatcaaatggtagggccctctgttgtcctttggtaaataattaatagtttctgggtcccaatcaccgggagaatctttgtgggagcagagtttggtggtaaactctttcacacctcaatcaagggctagaaaagaggttcataggtgagcagagctccagtttccaccagggaaatctaaggggcctacctggagaagttagcatttaagacaatatggagagatgaagtagaatttgaggtgcatggtcaatgattgtttacagagaagggacttgctagggatacatcattgcttttccattcatgcaagtatcattgtgtttttcaggatctctgagacctcagggctagttttaagttcttcccctcctcaacccctctccacttctcagtgcttcacggcacactggggcattctcactagcgaaggtgtcctctctaaggatgggacccctactgtccatctcaggctcagcactgccttggggcaggccacttctggcttctttaggcctcgtttccacgggaggggaagctgggtccgatggtgtctgggtcaaattccttggttccaagaacaggtaccgttgccattcccttccatttctgccccctgcaccaccccacccagcagctggaaaatgatgaggtcatctatttgagaagggccacacaggcctcccacacaaggacctacaaagtcctccaatgggaatttatttctttctgatcaaatttaccctccataccccattcatatacacattctttctcccctctctcttaagattgtaaagttaaagaaactgaatacacagggttgatttaaggtaaacgtccctcccacccatctatttaaaaaattttcttttacttgataactttcctacaacatgattctcttatgcccatattcctctgaggattctttaaagcttttcttgcactttctcctcctcacagtccctgacttctagccctgagtggtggctgagggcaggtgaccctgtagaccgtggggaacagaggaggccagggcaggtggctgcctctttccaacctttcctgggccatgggagctcctccccaccagaggtcagcagagagctcagaatggctgggtctgctctcagaaattgggatcttggaattctctagatgaaatgtaggatgcccaaatggaaaaaaagccccatgtttccagggtgttttggttggggctctcatcctgtcttgggtcccggggaccttacttttaacaccaatacagccattctgtgcttttctcaggggaggggtggttgggggtttggtctgtttatttggtggctttcttggtcagtcttctccctgcgccagacgcacaaatccctcccttagagggaaccacaccctcttagaactctcccttctggggcccaactgcccactttcgcttcccacatgacatggaacccacatcccacacttggccgggcgccttttcttctagttgtatttattgttaaaatgacatcataatattacaggaaatccccccagcctaccctcaccctgctgtgattttactgatcattatctccccctgttctttactcaggtgtatgcatagttttgagagggcatgaatcatggtgtgcagtttcatattaatccccctgctccacaaacacacactacaggacagtttccttagagctcttccatgttcgccatcgtccttccacagttctttcacttgttcagtcctttcgctagcggggaagagcagggaaagaattgaggttccctccctttgtttttccttctctgatcttttgaaatcccggggtccttgtgaacgactcagaaattaaaaccaattccctttggccagttgtttattgttgaaagagagagacaaagagaaattaaggtgcaaacggaaggaaagaagtaaatagagattaaatttaaaaatttgaaagggagcagtggttcacgcctgtaatcccagcactttgggaggccgaggtgggcagatcacctgaggtcaggagttcaagaccagcctgactaacatggagaaacatcatctctactaaaaatacaaaattagctgggcatggtggcgcatgcctgtaattctagctactcgggaggctgagacaggagaatcgcttgaacccgggaggcagggtttgcagtgagccgagattgtgccattgcactccatcctgggcaacaagaatgatactccgtcgaaaaaaaaaaaaaaaacaaacaacaaaaaaaaaaccaaaaaaattaaaagggagagagaggaggaaaaaagagggaaaggaaagagagaaggaaggaagaaggaagggagggaggagggagggggagaaaagaaaagaaaggaaaagaaaaaagagaagaaaagaaaaaagaaaagagtgcctttgccaagtttagctctaagcaccaaatggggtccttgccctctaggaacttctagtccagaacagaggagaggatcaggttgcaagtgattatccttctaccaggcagggggtggagcgctgccaaggagggtgtggctggcacagctgaggggccaggctggctagaccggacaggagtacggggaggagaggcaggttcacaatccaggctggggcatcctctcctccccatctcactgccccatgaggtcccttgttcgttcaagtgccaaccagaagagctgggacagaggcctctcttgtgtgccaagacgggggccaccaccaccctctgagctctgaccactgccctctcacctcttattgctttcccaagtgtttacctcctgattctaaaacgatggtccaatttttgttttattttaaagttaggaacacactgcatgtagcacacttcatggagcacaagtgttttcacatgccttatcccactaagtggttttgttttgttttagaaagtctggcacacagagaaccttctagttctttaaaaaaaaaaatcataaatttttaaatttgataattatccagaacaaaacaaagcaaaccctaaggttaaaagtgagcatcctataagttaagtatagatctttgatgttggggaaacctttgaattttacaaatcgatgtccttgagaattgggttccagccagacccactgtaggcattgttttctttttttctttttccttccttcctcccttccttcctttcttcctcccattccccctccccactttgaaaaacaagttttattctcttgggttatgttcattagagagggaagacaattctgttcagcaaggaaaggtgaggggaagagaaaaggggggaattcagccagaggagaacagggacaaggttgattgctctgtgctggggtgagggtggggggcagagagagaacatcacagccagatgcaaatcacaagagcagaccttcagcttcctggcattggtggggaaaatattccgtcagctgcctttctatgtcctgggcttcattcatcagctcaagagaaaaaaaataaaatcaaaatttcatcctaatttgttgtggttggaccccattctcccacattttggccttcttgtaaagcacaaccacaaaggcagaagtggcttcctgggctgacctgcctctcagttcattctcaaggcgttagcctcatcccatcaggaggagttcagactctccccaagcaccaagagttagaaatgtgttgctaattgatttgagctaaatttgtgttgctttgagacttagcaaaatggctgattaggggccagtgttggggaaaataattgctgatctaatagctatgaaaaggaactcattcacaaatatgtttataaaatgggccttctgtgacattttggaattgtcagggagttaggggtcacggtggttcttcaggaagaaagaaatgttgttgggaaatgtttagtggaaatttagcataaaatgacatgcctaatttaagaaaacagttaaatccatcatggttccaagtgaaaacagttgtcacaaattaatttttcaaatgtttgactattggcaggtctgaggtttactcatctgtaggttatgtccaacttggcaaaagcatggaatcctgcccagtccttggtacacagggactagcacatgtacccattttttctcactgataagttatttcctaattttttggttaacttgaaggtcgaaatagccttactcctttttgtctgtctagtagcatctctaagcttgcagtagctgctcacgtgtctgccacgccccttagaaggacgaatccttgcctggtcggtgagtttgcctcaattcgggcattttcatttgttcattcattcgatatacatgtattgagtgccaaatatgtgcccttccccgtggggaagacaaaagtatgagacactgctactcccttgatggaatcaaaacaaacccaggaagttaacaagagtgggcagtctctgctaagcgattacacagggaataaataaggaaagatggaaagattgtcaaccaaaagacttcaacaacctgctaagagtcttccagcccagttgagcacaccaaatcagaggttacctaaaagtgtcatgagtgctgataattaaactgcagaaaacctagaaggatctgctggggtcaaaacaagcaacatttgacaggcacagccattcagattttcatgccactctgaggctgaaaatttctgcacaaacagcagtgactgaacctttgctagtcacaggatagacctccctgttgatagggtagacctccctgttgataacttgtcagtcatgggactgaatgaggcctttctccaggaggcacagcccagagggttactggccatgctgaggaggcagtcttgcttccaggaggggctgcagaggcctggcccaagagtggtgctgagaactgccttttgccaacttctttctttcattgtgcactctctggagccaaactatgccttccaggatctttcaagactaaaattctcttaggaagatgggcccaatatttcccacctaaccttagaaatcttctatgtctaggattagtgttttgagagttagatgggaaagtgtagtttgcagccagatccttatgtactacagagtgctttcaccttagtgctttcatcctccatcttagctccaaccctccatcttagctcttgggctggcccccgtcttagctctagccttacatcttagctcctggcctgccctccatcttagcttctggcctgccttctatcttagctcctggcctgccctccatcttagctcctggcctgccttctatctttgctcctggcctgccctctatctttgctgctggcctgccttccatcttagttcctggcctgccctctatcttagttccagtcctccatcttagatcctgagctttgggtctcttttgttttgttccctaatgcagatagagatagtctatattcaaatactataattaatttccagccattgtggaatgaaaaacacattttaatttccagaatttaatttccaactttcctttcacaaatacttttaaattatctatttattacccttgaaataatatgtcttatggataggtctctgtaactatcacagcatatgatagtgacctttatgtttttttgaaaatatctgtgtaatacagattgctagctattttttatgttaaaaataagacaagggaaggttgtctggatgactgaactgaaagaactctcaggtgaactttgctccatagtgaatatgattgagatttatagaattattaagttgtggcttcttaaaaattgccaccgaaacaagaatgcctgaattttgtgttctgggtgatcgtggatgagcacatggcacatctgaaaagtgatttggccccaggcctccttacctccctgcaggtggctgtgttctcttcagttaatcccattagctggcaaaggctgatgaggctactcgtaagggacatgtgcattttcataaagagctttagaggcccaaaagcccagagagtcacatttttaatagtggggttcctaagagtagcattctaacaagaggcattggggggaacaggggagagcatttgggcagtcaccccctccccacttctagttccagccccataccctgttttcccaacccaagtctatggctgcctagcagccctctaagcaatgagttgactttcttccactgtgaccccaggacacgtggacccctcacaccagatctccaagtagcagcatagtgcttagtgttattctgcctggcagcggggtgccccccccaccccattcagtggcagtcaggttcagatcgtagccttcagggtgcctgactcattccggctccggtcgataatgacaagccccatgtttttctccagcgtccacggctatgacacatacaacagtcaggaaataaaagaggcttgagtactatacggttgctttactttctttaaaaaagaaatataatgtgaagggcatgggggaaggagcaaggaggcaggagtccaggccagcaaataagccagcagcaaaacaaccttgttgtttgtatgttacataaacagcccccccaactgtcctgcggttatatccttaggaaaaactggggcttagtggcgcttgggttgatttcacaccttagcttagagttactcagaggtgtattaacagctaatgattccattgagggcggcccagattgccatcttgacttgccagatattagcaatactcttatagaaacccaaaagcctgccaattaagttccccagtgtaagttaaaaggggcctttctgagatgcgtgatctttaggaaaaggaaattaaactaattttgaaagctcctaacactcgagtttccttataatgtaagtaggtgacagctgggatgaatattatgagtccctcccataatgtgtatttgaatagatgtcatggattctaatggcagagttcaaagtcactcagaggggcgggtttttatttttttaatgtcacccacctgaaattattttcagaaagttctgtaatggctaacaggattagaatgacattgtcacaaaatgatatgaggtgttaaaaagacccctacatgatgcggtgtccacaacgcacaagaagtacccccccacccaagcatgactcagtaacactcagtgaggaggagagcatcgaattatataagttacagttttatttcagacacacaagcacgtaggccagcagtgatagtaaacatgcaggcatgctttccctctgagcatgagaggcgtttggattttaccctcccagatgcagaacctctgtacttctaaacagcttcctcctgacccttagctaagtcaacggggaaaatcagcctccaagttttgctaaattgtgtaccatgacagtgacttgtatttaggagaccttgcgtggatctaaagcccagaagtagccaccaccaccgttcctcctgatgaaaatggcctcaccagcacctcgctgcaaacagacaccagctcaaaacattgattttctccccaccctcgcagggttaggattctgcttagaactctgctttaagctaaaatttccatcaccaaagggcctgatttcaggcagagaaaggaccactttagcaaatgagagaagcgaagaggagtggaggaggagggtcatttcaacagcagcaaaactcagccatgccattttccctgacagcactttaattatgatgaaagaacaagattttttttttccggtttttacagaggaggctcgtggtggggggaaaggagggggctctgaaagagatgtgagctgccaaggtacagagtgcaaagcggctgtcactgccaaatgacagatgcagttggagagggggagagaagcccttccctgagcctgtgcaccagtggcctattctgtgggggcccaggactagtcagccaggggcaaatggtgaataggatggcccaaaggagccacctgctacatgctagcttccccctttccttccgtgagattttaaccccagggctggttctcctagttgtgctctgctccaccagctttgaaagccttggaggggtttcaagtggtcacataccttattgttgaaaaggatgtttttctttaaagtcaggtgctaagtcaggtgtgaggttgaaatggacacttaagggcttcagagcaggataaagggacagagcccaggaagcccaggactgatgctctgatgggcagaagccagccgtgttttaggaatggggaaagagttggagcaccagatgttaagaggctacagtcagctcaagcaagaacgagagaacggcgctgtcactgacttcccacctcccggccttgccggtaatccctgctctgattggaggcatggggtccacaggaggcacctattgtgttgccacaatgcccaaaagtggcctgagaattctgggctgctagtgtttagaaagagatataagtgaaccctagactctcacagctggaaaaagcctttcttcctgggaatgggaagtaacaaaatgagtccaggttagctgtggagtccttagagatgaagggagcagagagggcggaaaaaaaacaaaaacaaagaaggtgcattattttgtgtttcctttcacctccctccttggttttagggccctttcctggcatgcaacaggaagtgcaggctgtgttgagagcctctggtgcagacttacgcagagcacaagagatgatgtgagcctgcttgtctgggctgcttttgtgtaactgaattacacagtatctatgttagaagtgatgtcacccaagagagccccatggccttgaactaaacaccaaggggcatcgggccccggccccaggaggcctgctatgcagcaacttttctgaacaatttgtgattttctgttcttattcccctcactaaattgtcatgctgctagagacacttctaatttgatggttattaatgggcagctggtaatgaaacagcaaggacttagggctttgcagtaggtgaattacggacatttacaagtaaaacaactttacttcttacatttagcaagaggtttaacaagcaaagtgcaacatctgcagaatcttatgggaggaggcagtggtcttgaaattgtgaggcagtactgcagggatagagatcgcctttccctagaacaactgcaatctccccatcagagccaactggaaatacaaatttgctcctatctccatgcgtggtgattctgcctgctacagagatggaggaacagtgatctggctgattttaatgggcccatttagggaaaaacacttaaaaaatatgtgaaaatgcattttccccctattccttctggaaagcaacattagggtccggcagttctgtctggaaggagggagatgcaggagcagcatcctggcttatgaccgcgtggctgcttagtggttttattttagaaagagttttaatgcagaggcagcggtggtggtgggggtgcgggtggggggggagggagacaaatcagatgtagaggtttgcagagcctggaggccaaaggaagcccacttcaggagaccacattttcagcatcagaataagtaaagtatttgaggatttttgtctcctcttaaaaataggcactttggaaaaggaaaatatgcaggcttttgagaaacacagtgaggtgatcagttaatgtgaggtggtggtgattgtaacgtcggaagaattggtctcatttttcatgtcacaattaatattgtttgagattagatagcttcttaatttagaccatttacattttacagagcactaaaaagcaagcctccaagccactttctggcagcacaaagccaaataaatgggaacaatataaccttaaaaagatccattctttcacttgtagctttgctctggtcaatatcgagtcatttagcacaatctaaaaaactcacatttttcactgctagaaatatgtaattcttcctactattcattgcctgcagatgtcctgttctggggacctttttgacttgggtttttgtcttcttgacaccaaagcatacaatcaatttggtcaaaagttcaatcgtgaaaaagcatctggatgttttgtctataaacaaccagtttgcctgaatatttgagaggatcagctcagccaaccacctgtcctgatgttaccccaacacagcccaaatgcactcagaggggtgcggaaggaagggtacacacaaacaaggtgtgggggtctcgctttctctgctgcagccatctgaaatcggctgcagaggaggggggaaatgaagcagcaggctagtccttctaggcagacgtggagagagaaccgtgtggaaagatatctttatggctagactctcagcaacatcactgtcagaatctggtgcctgcagccatcttagaatttagaggaagctgaaggcacctgcccacattttgtcttaggttacaaccagctcaatccagccagcaaaaaataaggttgagaagcatttcgcttttacagaaaaagaaaaaatttccatgattctgttccttgaaaaaaaagctgaccctccccaacccaaaccttttatttcaaagtcaccaaaactgagactagataatctctctctctctctttttcctcgtgtgcatagccagtttagactctcttggctggaatttttcctgatctctcagtgcagtaaaaagccaggcagatgggggaagaagggaacatggagaggcagaagaaggggcaatggctccttggcacatctccctttgtagttcagtcttacacagtccatttttatttgcaaatagctcagcccaaaagagggtattgatatgacccccagatgctgttccgaatccatcttacttattttccctcgggggtgcaggcagggcagagcccagatatgatcagaccttcaaagcgcagccttgatcctttatttttcatgttacagtcacagaccttgaaaatgtgttttcagcagtttaccacataccgagaatttcaggaaacaaaaggtcaagaattgatgacttagatttattagtggccccattaagcagacctcagaattctaatgatgggtctttgctagacaaatcaatgtcatgtttctaaaaggacaagcgtgacagctgggtgatttcacagaattatcaggtattgggaggaaggttaagcaggggttcaattactatcaattacaatgatgttcttgtttgtttccctggggttttcatgctgctagttgtgtattttttcccttgcatttgcatatttgctgttttgctttacatgttttagaaattatccatctatttttttttttcctctcaaaatctcttctacctttggcatcaattgtagaaactaaatgtctgctgtagagttctatcctttagtcatagttttttgttctgttttgttttgtttttaaacaaagttctcttctctgcctccccacccaataaactgagtggatgtatagttatgccaagttgtggaaaacacatttaacacatttaagaacgtgccaggtatgaaatataaagtatgttatacctaagattaaaatattaattcgatttggggattatgccagtcaacattttggttttacatgcattcattcaactaacttatggtatcttgttgaaatgatgcatttaaaataattactgatttaattaaaagaaaactaaggaacttttcaggctgagaatgacattaaattatcctgttcttgagcgcctcccagaggcgtgggttaaataacaccagaatatgaattgagggtcatttcggcttttctagactttgggatgcctccaatggttatgagtaaaaggagtggtgctttaacttagagattagatgtctctgggtcccaattaagttttatatccatttcctttgtatggttgagctatttggcaccatcttggcagaagacagggatccagggcctttgctaccagtggaagggattgaggaaagcttcctctgtgataagtcttggcttggcaaaacatagcctagccttcttccttccctctccagaccagggcaccacgtggagatagcgccgtttgcttgggctggccttggacatttcagagttcccctcttactacatgctgacatcatcccgcaactccccatgtgccttccctcactgttgccaagtgctcttgaaagtcaaccaccttcctgggtgactgctgctttctcacctcaggttaaacccatggacccagtgaaagttctcccaggggctcccatacccgggggtaatcataccttccatatgtgaagggctagttttccagagtttttatttcttggtgttaggtcactgcaaccctgggataaaaatagatgtaattagcatgttgcagatcagactctgcacttgtagctttgtgccactttctctaataataccaattttggtgacacatttcctagaatcctggacttgcttcaatccctaaaatcctccaagagctgaattgtaggacaaacctgtttgctttagaacctagaagggctttgtcccagttagattgtctcttttccctacctttctagacattgcaggtccatctccattttcttttttgtttgtttgtgtttgttttgttttgttttgagacggagtctgggtttgtcgcccaggctggagtgcagtggcgcgatctcggctcactgcaagctccgcctcccgggttcacgccattctcccgcctcagcctcccgagtagctgggactacaggcgcccgccactgcgcccggctaatttttttgtatttttagtagagacggggtttcaccatggtctcgatctcctgacctcgtgatccgcctgcctcggcctcccaaagtgctggcgtgagccaccgcgcccggcctcatttttttgtttttattatcagggagcaacggctccattctcccctaaggctgacatttttgttgaaggctgagcacgcatgtcttccgtgcttgtggcaaaaggccctttcctggctggctccagaatcctcaccagttaattgggaaaaaatttgagttaggcatcacaatttcagccgagctgggcaaacaacgagtacacctgtcactcgagccagtgtccaaaactcagccccatggatcacagctgtagcgttatttcagcatgagcaattcagtatttaatgttccttagaaaaaaagtaaatcattccaagctgctactgttcacctattaactctttcaggatttcatggtggtggggtggaggtggggagtaatctataatttgcttggctagcagagataatacccccttcccaagtctgtctttcttacataatggccatttcttacataatggagaagaggggctgcaaaacaatatcctcttgatctgtggcagccactgccttccagaatgagaagttagattttcttctttcgtttcatttatatttttacctgcgcagtacaggtactgcttcctacgatcagcagcttccatttcttccctctttccacggtagcttaaattagcccatcatcatcagcaaatcttaatttacaattaagtgctgggaaaaaaaaaagttcgtcattaatcagaccttctcattttatgtaaatggcccccaaaagcaacacacatttttaatctgtcctgccgatagctgagcccttctgtcatttgggtcctaataaatgaattggccatctgcaattaatctgcatagtacaaatcattggaaggccgagtctgtctgccttctgaaagaaactggctatatttagttttttaagcaagtctgctttgtgttctttgtaaagtcagcgacattctttcaattttttcggtgtaattagcacaaaaggagccgtaatctgagaaggtagtagagactaaggcaaccgaaaaacaggaatgttcaagaaagcaggcagaggcagccttcccagtattgggcggcgtgacagagaccctgggacgtggctgtgggtagagctgaggtctgtagctcataaaaaatctccttttcatctgatccccagactggttgcaaacgcttgccgcttgggctgaataattttccccttctcataacttccagtggtcagcaaggaccttagaaagacacagtgccatctgggctctgctgttgagtgggctcctgacaggccagtgagagttctgtgcacactgccaagccctcaataaactgctgagtgggagagcagagggcatagccctgagctccccagcaaatgctgaatttcaaccaactggaggctacatggaaatcaagcagaggaaggctgcagtggccttgggaaggagagttagagcctgtacgaaaagagggggcagccctcctcattgggagctgtgcagactgtgccccgatggttagttcccccctcaaaataaaagccagggaaataggtggagctaagcggtaattacacatttttcaatttcaactaaaacgtgtgggcaaacacaaaacgatgaaaaggtatctacatttctagatgaattaaatgtgtgactaattatgtcacgttaattgcttaattcctggtttaccaacagcagatggaagtgggactggagagggggttttagctctgaaggcgaatgacacctgaggcccagtctaaatctcagttttcccaaactgaggctagaccataacggcagggctgtttgaaaatgatcacctacatttggttggcaggtagataaaatctgaagatgtaaaacttctatttagcagtcgtttcatttgtatatgtccacaaagcagcatttaactaaacaaaatgaattgcctgattaatccagtgtttttaactgtctaaactccaattctatggagctaaatttgaagaagtgaataccatgaaaaaaaccctaaaatctttaaaataagaacaattataaagggcttcttttatctaaggaaattttattagaacctcaggcctcctgactgggctcaatatcacatctccaggtgcaccaactgcctcttattttttcctgttgtcacttgtttagtaagatgttggatcaaagtgtcatttaaataaggcatcttgtaaataagcaggaaagtaaactggtccatgtctatttttaactagtctccctacattattctccatcctggatgagtttccatcttcaaggccaagttaaaagttctaagcaacaggttttcccattaccttagtcctcatgaaaatttttccccaagggaagtgaaggatatttcagtttaggaaaattagctttcctgccgtagagcggcaaaactcttaaatatttttttctactcaattaagagctccattaagtgggtccattgatctgttattgatgttgatgtacctcaaagaaaatggagcttcctcagtcttctcctggatttgactttcagttttggagttacttgtggaagctgccgcctgtgttctgctgatgggtctgccttttggtcctgctagtgggtttgttttctgctccctgttgatatccaagttgtgtgtccacctagaatcttcaatgaagggtaacatgtgcatcatatcatttaggcttctaaaaggaacaaagtaatacatgtcatctctttttgttagcttcccccttcttgaggtagatggtggttttgttaaaagtccattcctgcccacgctggggctcatggggatgtggtgagaaaggcactgatggcctggggaattgggcgtctgtccacagagaccaggaagcctctctcacagatggtgcctccccatcagagagtcaggaaagatcaagaagggctgcaaaacgtcctctttgccctcatattatgtgccatgcttttaagtagatgtttgaacagcatctcaaagccactggctcaagaaattgggtccaaatacactggccaatgtacgtccacattctgtttgaattagagtatgttctgaattaaaaacagatcattttaaaatgagttgatggataataaataggaaaatgtcatatggccatgtagttaattcttcagtaattgacttcaagtcttctgaaatgaagttttatatcatgtttagttttgaatacaagtttagggttactttatggttggagttactaactagtgaatatgacaagaaaaaaaaatgtcctagataatcactacattcgatttctaagaacttttatggtctaaagtaatagagccttcttacaaggattaactgagactaggaaatgctttttacaattcctgctttcatcatctgcatgacataggctttgatattcatttgcaatagcagtttcagtcattctagctaattaaagtgcagaacgtgctttgaagacaggaaacactgtggaagtgctaaatactattattaaaaccttacagctaaagtttctgtttcagtggaaacctatttattgtttcctaggctattaaaataatattataattacatttgctctgggctcttggaagacaacttaaaatgaccccaactaatgaaaggccaaggataacattcttgtccaaaaactgagtgacagcattaagcagaacagtattttcaagattctaagctgtagcaagtccactgcttcaaaaggtagacaaggcattcttactcagaaaggaggatacccaggggccaaggaacacaaactgcctttatcaccacgaagctgacaagaccacagaattcaaaccctgatgtgggacgttgttcattgttgtcaaatatggaatgttggaaagaaatgtttcgaggccatatctccatgtagtgtgtgacaccatctgtttaaacaagttttttcgttaggtgacctagtgttttaggttagggatgtgttatgatctcaactggctggcttgggcatgaagcaagtctcctgagccagagatctgtgctttccttgggcattttatacccaagatattctgccctttgtccctccctgaaatctccataactcccttctcttcctgagccagacgaggggccccttccattggaaagctctctcatctggactgttccaagagttatgccaatagattgccccactttcaaagcataaactaggtacttaaaacagtaatgatcaattaaattactaactcatatgaaaaggtcacacatggtagcctccaaaactaaaagacttgaaaaaaaaaaatcacaacttttagggcctcaagaggtcaaatttgaggccaaaagctcagtaaaatctcttctttcactttgtgtggagtgaaaacagacagcctagctgaccacaaaccagcttgtgtttcagcactctgggtgtcatttgcttacctgtaaacccatgattccacctgctgtcatttatttacaaagtgaatgctttatttatccatcagtagttagtcataataaaatataggtgaaacctacacttaaaaaatttttgttttgaagagtggcctcatagattgagagctgaaaggagtaaagcctgatcttgcgttacccatttctaggacaatagtcccaattgtgccttgcctaggacgcatgttagtatatgacatggggcagtttcactccttttaaagttcaggtgtgatgtttatctaaaaggggaaggtggtaatggagctcagagatttccaaataaggaggctcttcattatattcattgtataactttgtagctcctggcataagtatctaggttgtatttgttactatttaccttgtacctcttaaagacaatgtatctgtgctttgccacagtagaagcaggaaggaagatgcttttgaacaaatggagcataacaaaaatgtctggcctattcttccctcttacaagtctttaacaatttttaaaaatgacaatcaatcaaattcagccaggaatttttaatttaccatctaaagatatagaacctgtgctgtgtcatcaagcggttctaatttaggtggtggatggtagtgagcctcactatcactagtacaggcagcctaggaatcatcgattctgaggccttactgctgagttctcctatgagcacattcaggtgtatctgcacaatatttttatgcatctttggttaggtgaaaagcatcaacctaggatagttcctttgagcattttcaaaataaggtgtatttttgtgtggaagagaggccatccatgatcaggagtgtgacaaaaacctggccccaacttttcagccaagttcaagaaagtcaggggtctgcagcagcccagggcaggacggtgtctaggctgcgcttcctgttcttaattccaagtgttgtttggtgactttgaatcgccctctgttgtcttttcagattcataaaaaagaggccttgtacaatgggggcagcagtgtacctgaaggggccaagaaaaataatatgtggcatcttcatctgtcacaccttttcttactcgaagtggagcaaactggggaaaaggggggaatttcagtcatccggttgaatggctaacagtgtctttttattttcaaagctaacttaaaatgatacaagtttgctcaaggcctctggtggtatcagccgccccatacccctggggactgttaaatgtgtttccatttataggtagacttttcttttttctccttctccatcaaacatcttaagtttcatgggctctgttaagaagtcaaagaaaaagttggaagacagtttgtggactttgcatatctgggctttccgggacgtaggcctgtgtcccatccaagacactgctcacgtcttagcctgattacctggccgcctcggctcacctgggcacatggtgagccgcggaactggcaggcaccaaacatttattgaatgaataaaccgtatcccagcagacaccatggtggcagcagatgacctaaccaaggtcccaggaaaggcgggctggggtcaactgcttgaaaatttagtaaccctgctcctaatcccgtgcactgctatatcctagtgtgcggcgggacacttgagagttttgaaagaaccctcaaacaagttcacgttccgtaaactacttttccctctgttccagagcccccagggcgcccaggcaaggccgccacctctcccacctgggaggacgcctcgagcaccgactccacagccacggccaccgctcctcggctcccgtgacaccggcgcgcctgctgcttcgagcaggggaggctttgcactcccatcgcacttttctcgtccgaagatacgaaactccgtccgggcgtcgcaaataattcgaattcggctctctgacacctacctcggcgggcgcgcgccgctgggagggcggggtgggtggctggaggtaaggaggcgcacagcaggggtaagcgccgccgtcgcacactttgcacgccgcccagggctacaccactcaccgaaaattgggaggcaggtctgggaggcggggttgagcgcccaccgccttgggcgcgcccgcgccccccgccatcgcggcccccgcgcccccggcccacgcccgcgcggtcccggcaccggcctgcacccccagggtgcgcggcggcccatttgggtgcgtccccggtgggccgatttttcgcgcttccccttcggtttataggggccgctgctatgggtcggtcctctgaagaggctggggcgtcatcggggccggttagaagctctgctccccggcggggacactcagtcgcgtcggcaccgcggagcgggctgcgtcaggtggctggccggcgcggcgctcccctgctctctggctccgggctgcggcgcggcggctggagcgagcccctgtcccggcgcggggcggcggcgggcggccggcaggcgctgccttgcgtgtgagtgcacctcactcacatgtaagtcggggagcgccggggcctcccgcggaagtgcgagtcgcccggcgcaggcaagagccgccgggtccgggacaaggcaggggcgcccgggcgccgctgccttgccccggggcgcctccgggcaccccccaattctctctcttttctcttctccattggcgtgcccaagagccaaaccaaggagcgcctgagggtaaacagactcctgccatccgcgcctttgcacttttctttttgagttgacatttcttggtgctttttggtttctcgctgttgttgggtgctttttggtttgttcttgtccctttttcgtttgctcatcctttttggcgctaactcttaggcagccagcccagcagcccgaagcccgggcagccgcgctccgcggccccggggcagcgcggcgggaaccgcagccaagccccccgacacggggcgcacgggggccgggcagcccgaggccgggggcaagcagggagcccgggccaggcgcgagccgagctccccgaggtggccgggccaccatgctgaagatggccatgaagctcaaagcccgggcggcggagagcgagaagaagacggccgcggcggctgccgaggtggctgccgaagctgcggcggcggctgcggcgttggccgagccgagagagccgctcgcgccgcggaagagcggggaccccgagaagctcgcgaagaaccccaagaacccggcgcgggaggcgctccccgaaaagttcctaacagacaaggagcgcaagaagctcgagaagaagctgctggagcagaggcgaaaggaggagaagaagaaggagaaggagaggaagaagatggagaagatgctgaagaagaagaagaagaaggtgccagaagcccaggaggaggcccgatgccccgaggccgccgccgccgcggccgccgccgacgacgacgagggcgccgaggagggcgccgtcgggggcgccgaggagggcgccgccgccgggggcacgagtagggcctgggctgactgggacacggactcgagcgacgaggacgacgcctactacgcggcgccgcgcgttgggggcatcgtgtggcggcccgggccgctcaaggctggcgcgctgagcgcccacctgcccctcgtggtgttcctggtcttctcggtgcgcagcccctcgtgggtgctcaacttcctgctgcagaagcgcacggagcagggccgcggctgcggcttcgtgttcggggcgacctgctgcttccgagtgttcctgggctgcgccttcttctcctacttgggcggccgcgccaagcgcagaggccgcgggcgctccggggccagaggcgccttcggctcgggccatggcgcccggcgccgggggcgcgaggagcggctcatctagtcagaccccccaccccgccaccgccaccagacaccaccatcgctgtgtagtgtgggtttttattcgtgttcgtgtgtgtgtgtggacacattttccttttcggttgctctgtcctttggttcgtgctcgcctcgctttttccacactcctgctctctggctctctgtgtctctcgctctttcgaaaattttcctaagtccgggcgcgcgctccctccccttccgcccaccccagcccctcggcggcgcccgcgggagggggaggaggcctcgggggcgccgggcgacgcggtccggggggtggagcgttggcgtcgtgcgaggggtcgtcactggcgcggagacgccccctctcccccctcggctcagccgggctgctgcccgagcccggggggtggggggcgtctccccggcccgtcccgtccccggccgggcgcgggcggagggaccccctccccgggctcccggggggccgcctccctccgccggctcccgccctcccagccgccgccgccgccgcggccgctcctcggccctcctcctcctcctcctccttccacccccctcgccgccgccgcctcctcctccccccgcctccccccgcccgccgcggcgcttttggctcggggcggcggcgggggcccggccgaggcaataagagcggcggcggcggcagcggcggcagcagctcccgcagctcctgctctggtccgcctcggcccggcggcggccatcagccccctcggcctcggctcgaggggcggggagctgcgcgcgcccctcggtccgaccgacaccctccccttcccgcccgtccgcgcgccccgcggcccgcggcccgcagtccgccccgcgcgctccttgccgaggagccgagcccgcgcccggcccgcccgcccggcgctgccccggccctcccggcccgcgtgaggccgcccgcgcccgccgccgccgcagcccggccgcgccccgccgccgccgccgccgccatgggctgcctcgggaacagtaagaccgaggaccagcgcaacgaggagaaggcgcagcgtgaggccaacaaaaagatcgagaagcagctgcagaaggacaagcaggtctaccgggccacgcaccgcctgctgctgctgggtaagggcgggcggggggcgccggccccggcccgggggccctcgaagggcgccccgcaggccgcgcgcgccgagcccgccccccgccccgggcgcgcgctcccgagccccccgcccgttcgcgggctctgtctgtggggggcgaggccggaagggggacccaggggcgcggattcggccgggcgggggctcaaaaacggggcggggggccgtggcgacgcgggcgcgggtccccctcccccggcctgcccgctcagtgtctctctcttgctctcgctctcgctctccccctctttctctctttctctctttttccgcgaggcctacacgacgccaggggtttgggtgcgtgttggggagggggagggggagcccatggggctccggagactgcgacaaaaagagggtttcggggacaggaaaccgggtggcgggtagagggagggggacccgcctccgtggggtgtgagatttgttgggagagggaaagaggggaagaaaggggcgaggagaggagggggtgacgctggggggcgccgtggtggcggagggggcctcgccaaagggaggctttggcggggagaagtggccgaggagagtgggggggctggtgacatcagcccctcggaaaggatcggagcggtaaaggtggtgcagtgggggggagggggcgcaagggagtcgtggcgccggagtcgggaggggggcggcgaggggaggagggagggcggttgccgctgggcgcgacttggtgcgtttcgggcaggaccgactgactgtgtgtgcgcggagcagacgtgtcccgggccaggccgggccgtggaaggaggagaaggagagtcaaataaaataagaccaccccccaacaccaaaaaatggatagagttagtacgagaagtgcccagtgaagccaaatgacacgtcattttacagtgtgacctttttttccccttccagacttgcaggctttttcaaaagcagagcggagaattaattgtagcagctgccccccccacccaccacgagcagcgcccccccaacactattttaataaaccattaaaaaaaacacattttcctgctggctggccacattgagagtgctttgtgaaaagaaaaaacaaagacattcacaaatcagataaaactggagaatgacatttgtctgtaaatggcttcttggtctggaaatggcgtggtttctttttttttttttttttttttttgtcctcctcaaggtgggaggggggattgagagtgctctaaggagacttttcctccaggtgggaagagataaaaagacattaattagttgtttatcaagtgacatttagttgtttggttttgggttttctttttttgattgcgatttttcctctgattaaaaaaataataataaaataaaaaaaggttaactataaggagatggcctttcctccttttttttcttaaggtgctgttttgggggaaaaaaatgtaatgaaatgaccaaaagaattacacagcattaattaaaaatggaagttttccacttccttgataatttggctatctgaataaatttgtgaatttgctaggttaagacctagttcgtggtcacatttcaacaaaacagcttgagtataaagaaaataataaaaggctgttcttatttattttcctttggtggcttttggtttgctctttttgcataggtcatgactttgttctcctgggtccagatttataaaagcagaaaattactaattaagtcaaaataagtgtctttggtgtttatgcatttgcaatttcagtaattaaatggtacatgtgttgctgtcttgtctaaaacttttaaaggcagaattatgctgttgggatattagtatgcgtataacttgatttcaaagtataaatctggaaaagtctagaatcttttctgtgaatgctatctcagtactactttaagtcaagtgtgatgctaatgatatcttaaaatttccaacaccttttgtgcagtgatcacaaagtctccacttaatttgagactgttactcagaacacgccttgcgtcacgggggctaatctaagtgtcctagtctatatgactacattacatcatgatgtattgattgcctctggcctaggaatctgcagcttaagccagtgacacaatattttgcatttttaaatggtgattctcaccaaataatgcctccccacaaaagaggaaacctaataatgccccaaatcctctttttactccatcttaatgacataaaaattaagtgaattagagaactacaatgatcttaaaataatttttcagccacatttcataaatgtggaaactgaggcacggatctgtttttgcctatgaaagataggtcctgtaactgttacacagtttaacacttctgaaattagaatattagagatcctgctaaatattacgtattgtttccttggcctctcttaatagtgccatttatatttttaatttaccagagttaggctcattaagatagtgtttgctttgaaatcaatgtttctgtggaaactaattttaacttttacagatattgattacgggcttgtgaaaaggcaagtaaaggaggaatgctgtgctatctgggcattaaaacaaaacaatacaattaaaagttaaaaagaaagaaaaaggtaataacagatttgtgtggaaggagggcaaaaaaacttcacacgtggattatctgttggagaatgtgcattgcaaaaaagatgcaaaatagcaatcctccctctagcttgatggaaatgtgttttttccatgaaacatatatgtatttttacaaatgaaagatgatttaaaatggaggcatgtgtttctactctttgagttgggaagggcttggaatctttcaaattcagtacttcccagggatagttttccttttgattaaagttttgttcttatgttactttttactgttgtttttgcagtttacctaatgctaatagggtctcaggaactgtatttgatgttaaagtgtggtttttccagaagatgacagataattgatggtctccccttttcctcagcaacatagttgtacccagagggaatttatctttagaaagatatagtttgtgaggaaagaggaggatggataagtggataaaatgtaatgcagttttaggggtggatttttaagtagcccaaggggtaggaaacctgcacagaaagaagctgcgttgtgaaaatgttgaggaggaaagtgctgcatcgctacgtgatgtggaagagactgcagtgtctgggcattgttgggaatcccgggtattttaaccatgaaacatctgacaacaaattatgtgtctagatatgtttatgtgtgaatgttcatgtatcagggattcagtttcacagttttaacttcaattttcttgtttaccccacaaatgacaaaattgcgtcattccttctctttgcccctttccaacaccaccccacaattttttaaacaatcaaaagaaaaattaaaaccagcaaaccttaaattcttgtttgttatttggatggtgaaatactgcaggtagacactgaattggacattgatttccttttctctgcgtcgaaatgtcaaggaaagttgcaagtctgtgattttgtgtttggttttttgcatgttgcttctatggaaaaacaaaacaacaacagcagacctccctgcccaaagtgttaaaatgcctccttcataacctgagacttactttcattttctaggtgctggagaatctggtaaaagcaccattgtgaagcagatgaggatcctgcatgttaatgggtttaatggagagtaagtgtcaaatctgtgcaggggggcaccaagtaagaggaacagactttatactaacctttaggaagtataggtgggctttgggggctgggcagccagttttcacttaatttttcctgatttacatattagaaaatcctgggaagggctctttagggtccctcaccccccacccccttggatctttggtgcaacaaatactactgatgaaagcaccagtgtttgtgacaaacatctccctatcccaagaaaatcgtgcctggttgcaggggacgcttgacagcacttggccccgtgacagcccctctccgggccaggtccctgccacagtcttcggacatcactgcagtgtcttcaacgtggctttggccgccccctcgtccggcccacgctgatcactgcaaattcaccccaccccacctcacgcagatttcaatgtaatgaaccaacacaggatgttttaaactattagggaaacattgtttccataatattctcaccagaaacagatgtggaagtggcagcccgtgtttacagtttctcattttttttgtccccctttaaattaccattatgggtaaatcattgtttccctttaaaacaaaaaacaaatcagtacccctgcctacagaaaagaagagggaacatttatttaaaggatggaaagactgggagttaggcactcccagcctcactgaggggcatttttgcctttgagaagtcctcccaggtatcctggtatagcacaatgtggcaatccgtagtgggaatgaagattaaacaggagagactttgtattagacctgtgagacgagttaggaagccctgcctggcatggggaatgcaaacagggaacattcaataaatcggggaacttgcttttctccccaagaccccagatggggcctacccatcgttctcgtgtaacaaaacgtgtaaaaaaaaaaaaagaaaaagaaaaaacaaaacaaaaaaactaagttgaccagtctgttttcactggtatgagagcattaaccgcactagatttcaagcacctgaaggcactagtttgtaattactagctggttggcacagtcctgttccctttcttaaacttggattcgattgaaaatttaaccttgagttgcttcagcttccatttcaaaaggggagttggagtcaaggtggtagcgtttaattataccaaccaccccccaaaaaaacaaacaaaacaaacaaaaaaacctttactagtcactaagcatccaggaaacaaaggtgaactttttcacctttcagagcaaggcaggcagctccttatagagaattctagaatttgttagatcaaataattgtttagagaaggatgacatcacccatacgaatagtcctgttagttgaggatgctttttctactttaaccctgaattcagaaggattggttgggatgcacagggggcttcttcactcatctgattatgactctcaatgggttatcaacatgcacatacgtgctattgagtaagtcagcatcacttgtcaccaaccaattccgaaattaattcttgacacacccctcgataaagccctgccagcggagactgccatcctgacaataaataaataaccctgagacagacttccaaccatgaatctgtcatttgaagaaaaatcttgcataaattttccccctgcaacttgcaggagtacttacttattcatgagagtagttaagcaaaaataatttgaccatgtatcctctagataaatattttgatgaaaactggacatggctagcatttttcaaagatgcagcagccactgtttaccttagcttgagtcggatggaagctaagtcacctttgaaataaattactgacagcttcattacagattgccctaaaatttaaaaatttttatagaaaggattctcctccctaagcgagccagcctgtaacaccaggcaagggttttaaaccagaacttctcttttctgttttctttttggaaagaggaagcaacattcccagtttgccttctttgcagacaagggcacagatacgttaaatttagcctgtgagagggtttacaggggtattcctcatgggagcctagataccttatttttatctcatccaactgcctccttttttctttttcctcactgcggtattgcaacaaaagctatttccttcttaactaggaattccctatgagacagtgacatctgtccctaaagggtggtctgggtggtacagggttcttcctccctgatcttgcgttttgttagggctcggctgagctattaaatttgccttaactctctgcgggctgccatgctgattacatttttaagagtaagataatactgatttgaccttcagaaatacagaggttggatgcggattttctaactcaaaactaactctgtttcttacatttagtgccaggaacaaaacaaaaacaaaacataaacaccattaacattggttgaactaagctaatcaattaccaaactgtagaatgctgcccttcggccttcaaggaggaattcctactgtttatgaagatcgggtttgggtttttggttttttttttctttttcttttttccgtggtggtggtgggtgggcttttgttctttttgttttttctgtggtggtggtgggtgggcttttgttctttgaaattttttttgctacatcacagtccagacatagtttaatgacaatttatggggaacaattatttataaataaaaccattttataggtagtttccttccactgcaagaagtgaggtcattagttttgcaggaaatcctgggcagaaatctcccccgtttatgcctttatgccttaagttacaaccttgggaagattctgacctgggagaattaggagccttatgcgctgccatattctccaaagaattgtgagataaatcactgctttagctccctaatgcgtgtacgtttagtgaaagcacaagaaaacaattatccatccctcctgtctccgaccagagtctccagagagctctgttaatactgcagcaaaggtgtgggattcttcccccatggcctgcagtctcagtggatgttccaatttagccagaaaggcgacctaagaattgccgggaggatggatggctggcgcgcgaattgttgcttttgctcttggctgatggttgaggaatgtagagagactgtgtggggtttgtgtgacactgcggtgccttgcagattaggtgagctttcaatctctctttaaaaggggcggcgaagaggacccgcaggctgcaaggagcaacagcgatgggtaggcacattcaaaaccagaaaaaattgttaacaaaccaaacaaacatgaagatcatactgggaaactgaggccagagacccgggaagaaaataaaaatcatttaaaggaccatcagccatattggcatacatttgtgaataacacacaatttcctgacattttggagcaagtaaagtgcgtaacataaatttttttggccatgcttaaagtagaatgagatccagctgggggaaagttatagatttcagccttggatgatcagtttaggattttgagaattgatgtttttccatatggtttctgttttcccccagctctccatttgaaccagctgcttgttttaaaactatctactaaattccatctacccactggttggtctgattttaaaatttcagacctctttgaaacaaaatttgtttcctttattaaaatatgcaatgctgcaccgtctttaattttgaaaaacgccttggtaccttgcagcaggtcgttaagaatcatctcgaaaagcctctggccttttaaaaatgatcaaatttatttgaatcaaaggcactttacgttagcttggtggataaggaaattcatgatggcatcttttatttttccattcattatcaaattattttttctttgcttcctgcatccccacacccatcacacacacacacacgcacacacatgcacatgcatacacagacacgcacacacatcacacgcacacacagccacacgcgccgcgcacacacacacgcatgccaggtaaccactctagctctgctgtgtatttagcatgcagtggtggagtggctatttctcatgagaccatccagaaccattgacttagtttagggcatctcaaagaaacagcttctgtggccggggaggggaggggcaaagatattggggtctggggacaaagtaactgacacatgtttgttcatctgtttcttttagaatataatatccctagatgatggctacagtttctcatcttcccggctatgtcctatcacaatttgcatgctggaattgctcggtcttaggaacttctaataagaatactattctgttatctgaggggggaggggggatggggcccctgctacctgaccttaaacgatgattgaaaaaacgaaaaatggactgaaatccttaattggcagaaatgtagtatgacaactatccaaaaaggcatctctataagaaatgactaattgacaatctgctgtaccaaaagttggcatttgagcaagatatgacaagtccttagtgagcaacctactgtgtactagatgtcctgctaaacccttgaaccctactaataccttggcctgcacgtctctctcactctgttctgcaagtcaatataagtattaacattcgtgataaataaaaattctctgcatgtttcagcaatccctgtatctcgcgtctgtcttctgtcttccttcctttgtctgtcttttcccaccaaagcacaaggattaaggtggagacctgaatagcttcccccaccacttagttagctgaagcggggggaggggaggagctcttaaaaactgaacgcatcccatctgctgtatacatagaagggggaggaggaggaaccaagaccctaaaagtacttccagccttagtcccaattttgtagcgaatcagaattctagctaatggcatatgttttgcctttgttgagtagtttaaagacatctaaggaattttctctgaatttcacaatcaacgttaaattcattaagcaatagtaaaagtgatgataaacccgccaacccccagtataatatctccatctacatagtaattgcttcaatggaagaattttatgttttagtattacacacccgaattagattttagatttctattttagctgttttatacttgatatactcccacacctattcacatacgtagatgaatactgaacacgttctcaaaatatccgtattttaagacgggaagttttccaattatcatactactgcttagaccaaaatatcaaactgaatgaaagaaacttgtttctggaaatactttctcttgctgtatgcagatttggatatttagtacccgaatgtatttaattttactattgtggaacctcaaaaccaaaggttaatagctttcattacctgtgaagtggagcctgcttttaatgaatgggaatagatttgccctagggggttttgggtaaattctgaattcaaaagtgaacattggggaccatcaaacacatgtccttttaatttataacatctaaataatcgatgttagactgtaataccaaggccggggattcttaatttcagaaatgagctttgattctgcacatacaaagcagacagtcgcacagagcggtcaggactcactccctttcactctaaggtggttgctttaagagtctgggggccagaatcagatttcagatttgtacacaaggcctgaagctcgctcacctccctgtcatctgtgtttctgagattctccggacctgcagcacttttacttaaatggccctgaggggattcctggcaacatctgtcccccctccccaccccagacaccccccaccactaatgagcgtggcccctctgaacttccccagctcttcacccaatgtagaagagcagtggtgcagtgacctgtgaaaggggcttcacgtaggaagggggcgagatgggatccttcagcaggtgaaggcccagaagtacacagacatttattcagaaagaataaatttgtaagtataattctttgagaaaggaaagaccaaatgatttgtggaaggcctgtcgacaggcccgcacttgaccccaccgtccgtccccgccccccacccctgctgctccactgactgccctgccctgctcgtctgctcgtctgctcttgctaattaacctcccttcgcctttcctctgccttaactgtcgtgttctagtctggagagattatatgttttaatttctactccagtctatgaattggtgaatcagccaagtgaatgcttcaaaaactgggactctcaaaagattaaaaaatatatatatacaaaccgtgaaaaagataaactctgtcccctccatctcccattggtttctgcctcggtgactccccccctcttggcctcagtttccctgtcagagaggcaggaccgtagcaccttttttccgcatgacaacgccctcacctcccagggcctaacaggtacagcaggtgtgctgtgtgtgctggttccatttttgggctatagacctgatgagatacatactccacacaagaggccttttcttgccctctaaaaacataaactcgagaaccttccctggctgtgcttctaatgaaggctagtttctgaaaaacatacagcatttggatcagtgtaatgtggtacaaaaattaacattctgttatggtccccagaagccaaagggtgtgtcctttacctgtgggaccagtgaccctgaatatagatcattccataaagaccacgcaggccatcccatgtggctgagttaaactcaaggaaaagctacaaaaccttcaacctctacttaccagagggatctgacctcccctcccccttagattataaggccttctagggggtggaatcttatttgattcctattgcacatggaccaacatgcactaacatcatgaactagaagtttcattgctgctagctgcagtgcctggagcatcgcacatacgacttttttttttttttttttttttttttttgacagagtctcactctcgccctggctggagtgcagtggtgccatctcagcttactgcaacctccgcctcccgggttcaagcaattctcctgcctcagcctccctagtagctgggattacaggtgcatgccaccatgcccagctagtttttttgtgtgtttttagtagagacggggtttcaccatgttggccagactggtctccaactcctgacctcaggcagtctgcccgcctcagcctcccaaagtgctgggattacaggtgtgagccaccgcacccgggctcctgtaatgaactattataaacaccaccacctgtgctcactggttctctcagtatgctagcaactgagttaattccaagtcaaaccatgggactgttttgttccaccccaacctcatagtgacctatcactccagcctcacccctacccagatgttgataggaccaggagaagcctttaggaagtgttagtatgtagtgtgggggcttcaaacccatgaaagattaaatgagctgcatgcaacttctggtacagtcatgattgctaaggcaatttgctaatctgccccgattgggcgtgtcctcagggcacatttgggaggttataatttgcaactatgtttattcagctacctccaatctttgcacagatccgaacccacaactccctgaagaacagaatactatgctttttagtcgggatgtctttatgaaagcagtactcctaactgacatggtgcaatatgattttcttttcttttcaatcccactgcagtgagaaggcaaccaaagtgcaggacatcaaaaacaacctgaaagaggcgattgaagtacgtgctggctccttgtgctgtctgtcttgtagcgccctcccagccagtgctgttccctgaccgctttgctaaatcattttcagaccattgtggccgccatgagcaacctggtgccccccgtggagctggccaaccccgagaaccagttcagagtggactacatcctgagtgtgatgaacgtgcctgactttgacttccctcccgtaagctacaccccgacttgtgtggccttagccccgcccacctgagcacagtgtccatataggaacatgagtgacagccctgcacatgggcaggagcatccaaaccacacttcaggcaaaactacatttcagtgatgtccatccttaggaaaaagttaatttcatgtgtaaccttaatttaataataataatcattagggctttgttcaagatggatgagcaaaattctgtcaccccttctacatcttagctcacctgtcctcacaaataaacatcactcttgaatactacaatctcactttattagattgtaaatttttatgaggaaaaaggtcctgagctatggcaggcttaattattccctcattcacatcttaggacaaaactgtatgttaaatatggcacacaaatactaattgtccatttactccactggaagtgccctaaggtaccttgggatgcctcagtgaagtgccaaatggaagacattctcattttaaacaggtgacctttttattaagagttttctaaagtccttggggcaaatgaaatcttttctcattattaaaaaaaatgaaatatatctaaattataactcaaaaatcataaaatagaacatatggaaaagactttcctctggatgcacgacactgttggctccctaaagaactacttttagggaacaaaaaactgttcaagcccaagcatataagtttaggccccttcgtggggagaatggcttataagcggggaacgggaaacgagatggaaagatgtatgcgtttgtaagacccacagggaagagacttgtctacagctaaaacaatgagttattgttgccttttgtcaggctttcgtgggaatttgtgtttgtatattttagatggacttggctgcaaacttaaattggagaaatttagtggtatatagttagtatggatagctaaactttttaaatagcattattttgaaaaaaaagcaataaacacaatatgtataatataacccactgactttcttgaaatatgattctatatttaataggaaaaggaaacagcagcctattaaaaatgtatcagaacaataactttttattagtcctactaacatctgaacttttatgttcctacctacaagtcccccatcatcattttttttggtaagattcacattttcccaggaggaaaatttagtcccagcacatcttacaaatgaagtttcttattttcacaacattgaaccatttattggcatattctaacacatttagtgtatattcttcctaaacaattctgtgaagaaactaaattactcagtagcttaccccattccccctacacacgagaaaagaaactacccaaaaccagtaattcacaataagacccagcagctaattgcgtgaacttttgaatatgtttaacgtgttgaattaaagttctttgtgagcattaattcattaattgggctcaaaattcaaaatcacaccaagtgtcggtcacatagggaactctggtctcagggtttgaatgacagtgttgttgattagttcaagctcttgcctttctctaaactttcttgtgttcactttcaggaattctatgagcatgccaaggctctgtgggaggatgaaggagtgcgtgcctgctacgaacgctccaacgagtaccagctgattgactgtgcccagtagtaagtaaccgccacccaacccatcagcacataaaacagacaaaaacaagaaaacatgaaaacctgtgatcctgctttgaaagttacttgttgatgattcctttcttagaagccaaccagttaccccactggcagaaagttctaatctgattcaattgtttatttataaagtccttaattgcattttttttcttttagtgcagcgacattattttacataaacatttaaagcctgttagagcaaaatgatgatgagtttcatagtattcctaattagtaggaagtaattaattgaattgaccctaagcatttagggaaatagggctgtgctcacattttgaataatgtaaaaatactatattttattgctgtaattttaaaacataacaaagaggaacggtgaagacatagctacgcctcctctctccttggtagttgttgattgatctatttctgctctcaggtaagcgactctagtagctgcctagtgttactagatcctagtgactctaggtagagtttgtttttgtgttgtcttgacttttgaactctatttcatatccttatttattccttctcaccgggtcttgattcaaggatggtaagtggtcaatggattttaaatcctaaactgtacacctaagcagtacaataccgtggtggggttattttcaaataaaacaaattactacctgcgaggaggacaggttaaggcctgcagtagcaatgggaaaagcatctttctccaaagtcactcataaaggtgggctcacctggttggtgtgttggcaaatgaagaagggggaacttaaaacacagactttattgcacaactctacctgatgcccaggctgcttcccttgctgcctaacacctgacttaccattgcctcagggatcgccctctgtccctgtcacccaccatggtctctcccagaggacatcgtacccgatagctagaaagttgcctttgaaatagtttatggcttccctcatcttgcacatgatatagcaagcatgtggtggtcagggttatttaaaaaatatgtaaagattattattatttttttgaaacggagtctcactctgtcacccaggctggagtgcagtggtgcgaccttggctcactgcaacctctgcctcctgggttcaagtgattctcctgcctcagcctcccgagtagctgggactacaggtgcctgccgccacaaccagctaatttttgtatttttagtagagatggggtttcaccatattggccaggctggtctcgaactcctgaccttgtgatccacctgcctcggcctcccaaagtgctgggattacaggcatgagccaccgtgcccagccaaaaatgtaaagatatcttctgtttgttgatgctgcagaaatgcacaaagcagtctcagttaatgatattctgaagtaggagtgtcctgtgacttggggcaggggagtctagtagaggtttgatgttttagccatccttattacaagtagctgaaactcggaactgattttgctataggaagtattagctaatcagaaccaaggtgccaggctgactcaccaagggctaagattgctttacttagtagcctcaagcccaaggaactgattgtgaaaaccacctgaataaacaggagggaggaagaggtaatactgttcatctataaatcatataagcctctgttagggtctgcgcaatctatcaaccccagccctgccttcccataggaaattcctttattttcaattgccacatacatagatattccacggtttaatatacaagcaaatgtgtatattttttcaaggaacagaaaaaaacagtccatcttggctggtccctatggcccccagcccccactccttcttcaacaaagtccctgattttctcaaaagttcgaaccaaaagctggaagcgctaattatagtaacgcaaaacaaatggaaatcctggaattgtttgcattttgtattttggatccaagtcagaagttaagtacaggtacaagattaagagagtttaaccaccccagttttgaatgctgggggggcagggagacccagtttcgttaattaacagtagcttagccagattgttgaattttgtcgggtttcgttttctctctcaaatcatttagaagtttttggggtttttttaagcaacacttaattactcctgaaactttgtctgaaaacgcaccatttgtatagatcatgaaaagttttaaggaaactcagagaaaaagagaacaacgcagcttaaaacttttaaaatgtcctccctcacccgtggctcaaacagccctgcatctgccgtggccggcacgtttctggttgaactgcctttatgttaaagttcagatactggtagtgtgcccatttcttaagctgtctatttttatttgttgagctggggtttggctggctccactccagatgtctctctcacaagatttggtgctgatgatctatttatagaactgtggttctgttgccatggtaacatgctggaggccagggcggctggggagctatttctggactggtgctgtaatgtaagattgattgggcaagttagtatatcctctaagccagactaactctgaactagtaaaaaggaagaggggaacagaaaacttaggcagtttctttaaataaacttttctctctttatgattttcttttctcgttagcccgctttaaaacaattccaatctctacatgcccctccctccaaaaaataactggttttaacattaattttccatattaattaccccaatctttcaaaagtaaattttcctgtgtgtctagtcaagcaacacaaacaagatgctttttttaatgaaaagcgtaatatctggagtgttctatttcatggaccaaacagaacggaagagaactttgtgtttgtttcctgttcaggatggctagggcgagaagggcccctttgtgccaacctcttttgttctctttaatcaatgagattcttaaaaagtaaaaaggaagggatacagattctcagtaactaaaacaatctcgtgtgcccttgaggggaaagtccttgatgtttttaagaatgtcactttattgttttttaactgaatgatacagaggtatacaattttcaaactgtttgccattttaatcaagcaatttgaaaattaaaatgtttttgtcaggcattaccaaatggcacagaatgtgataggccagcctggttttggggtcctttctctactggttgatatgcataaaaccttctaaaaatcaagaatattgccagagagcaacaggaataaagaagctaagtaaagaataaaaaagaaaaatagaaaaaataaaaataaacacgaagaacaaagccccaccaccgtgctgtgctgtttgtgtggccccactgcatcgaggccacaggctagctgctagacgcatctagagttccctgattcctaaaattatttatcttaaatcctgtttgccctaaccttcttaaggcatcagctttgagttacaaatgtaaccaacacacaagcaaatgtgccattgacttagtgctgcataactgtgggacggtcacttccgttgagcctgaccttgtagagagacacaaatagttggcaaattgatgtgagcgctgtgaacaccccacgtgtctttctttttctcccagcttcctggacaagatcgacgtgatcaagcaggctgactatgtgccgagcgatcaggtgtgcaaaacccctccccaccagaggactctgagccctctttccaaactactccagacctttgctttagattggcaattattactgtttcggttggctttggtgagatccattgacctcaattttgtttcaggacctgcttcgctgccgtgtcctgacttctggaatctttgagaccaagttccaggtggacaaagtcaacttccagtaagccaactgttacctttttatataacagagatcatggtttcttgacattcaccccagtccctctggaataaccagctgtcctcctccccaccagcatgtttgacgtgggtggccagcgcgatgaacgccgcaagtggatccagtgcttcaacggtaggatgctgtgggcttggctgttcgtaaagaacgctttgcttctgtgttgttagggatcagggtcgctgctcacgctcttggctttgctctctttggttaagatgtgactgccatcatcttcgtggtggccagcagcagctacaacatggtcatccgggaggacaaccagaccaaccgcctgcaggaggctctgaacctcttcaagagcatctggaacaacaggtttgtggagtgaccgcccaccccctgcgcttgcccaggaggccctggtctgcactgtttatagagaagaaccccgtgcaagcattccagacccctggccgaaagcgcgcttctcccaagcattcacacggcctcccttcttgtagatggctgcgcaccatctctgtgatcctgttcctcaacaagcaagatctgctcgctgagaaagtccttgctgggaaatcgaagattgaggactactttccagaatttgctcgctacactactcctgaggatggtgtgtatggcttccactcttgctggctgttcattgcggtggttctttttcaaacggtcaggctgaaaacccccatccccctcccaccaccaaaccataaaggatctataagagaagcaagaaaaacgcactcccactaattctcatatggaaaaatcagggttttgaagacttcaggagctacagagatgctagcaccccagctctgcttgaattttaaattacattaatatgtattccctttttatatagctactcccgagcccggagaggacccacgcgtgacccgggccaagtacttcattcgagatgagtttctggtgagtcgagcctgtctttagtttcctctcttgttcctcctctttttctcatggatgtaaatttacttaattccaaattcaggggttcagctacccagttccatggttttagttcacgcacatccagtgtggatttgagctctttgcgcccctccttttgcttttgttttcatatgacatcagaggctggctgacagccgtccctggtaggtgtccccatcagggatagggtggttcctggcgagggtgtcactgacaagtccccttgtttgtgcccgcagaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaagaagggaacccccaaatttaattaaagccttaagcacaattaattaaaagtgaaacgtaattgtacaagcagttaatcacccaccatagggcatgattaacaaagcaacctttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaacaaataaaatgaaataaaagaaacaaatgaaataaatattgtgttgtgcagcattaaaaaaaatcaaaataaaaattaaatgtgagcaaagaatgatgggactcccgtgagttatttgtggttctgagcaaattcccgtcattcatggttttgacttggtccttaggtcaaaagttgggaggccccaaggtgaagtgggtataaaatctcaccactgtatgttttctggtgaccctaatctgtaggtgtcttgaaacaatttgcagacaataggaaaagtccactcctgttcctcctaaatttcaccccatagtgaaccactatgccccagtcagtcacctctgcattttgatcattgccatcctatccaaagattctaccaacaactcacaccgttacgtcatcacacagtttgcctgctgacccaggcttcccaagaaaagtagtgtatgttttgctataagataagatagggactaaattatgtggaggagaaatagaggagcacagtgtttccaatcaatggggttattcaagaaatggtgtagccatttggggaaaattgaggctggatccctacctcattgcacacaccaaaatgaatttgacataagttgatcacatacatctaaataaaagaggtactttttaaagtggctattttataattaaaaccttgggtttttaaagggcctctctgcagcataacctaagacctaaaggccataacggggttggggatgactataaaaacgaaaatcacacgtaaaatttgaatgggggaagggcctgggtcaggtagaaatttaacaaagggtttacttctctaataagcaaagagttcttatgaattaataagcaaaaccatcagaaaaatgggcacagtatataagcatgcaacttaaatacaaataataagcctctggggatatgtgggacatcactcataaatattcaccataattgggagtggggatgggggtccacactcacgggttgaagtgtggcttatttctgaggtcctgtgggttccctagactttcacccctacgcttatcccccaaggtgtagtctcatatgtggtcacttcctgggtggcttccaggaagggtgggaggaagtgatcagcatcaacgatggtgccctctgaagctggccaaatgggacttcaagttcattctgtaatccaggtcccaaatccacttcctattctagtttccagatcaaattactctcacccaaattaatcatatagtgtagctcaccagaggtgagcgatgagccccacgggggggcagaaaagtagcaaatacctgcatctccatccaactttcacgtaacattcagtccacatgttcttgctatgcaatttttagtacaaagccctcaaaagccccccaaatataaaatccaagtaaaaatcggggcttgctatgcaaatacagctgaaagactagcccacaagttcccataatcctccaaagcaccccaaataaacacacataaaacctggacagtggctatcaagtgcaaccacaagaccagcgtgccacacaaacattcatccaggtaaaggctgtgctcagtgaaaatcaaggttgaactccagcccctagctcctcttccaagatggctccctgtatgtcccttttacatagaaattctggaaccttcttagcataatccacatgagattgtcacagctctagccacatatccatcaaaattagaaaacacaaaattcccaggccagagatgccaaggaaaatgataccacagaaccccaccttgttggtcataactgacagagacttcatggtatcttctagaagaagggtcacaaaagtcacagttatcaggtatctactagtgctagccattacccaatgggataggttcagctgctattttgacaatgagtaaaagaggcccagagagaccccaagagacgtctccagtgagcagggaagatgcgcttcaaactcaagtagccaaaggccactgcttggtccctacaagatactgttgtcctggaagatgcaggagaaaagagaaaaaggtctcctggtgttcttcccattatgtcagttatc

SEQ ID NO: 15123 - DNA, 31842 bp, Human
tctcaggatattttcattgactagatgtttggagaaagagggaagagcaggatggccttcaggttttaaaaattatctcccacagtgtaccattcacaaaggtgattgatgtaaaaaccccacatctttctcagctttcttctttgagtgtcctgttggaattgccatgggacaagaccataagtagtatttgccagactatccaacatagaaaaatgtcatgtatgaggacacactcataaaaatatctttcttcttctagaatggaaaataaaagcttaagtaaatgaaacctacagaggtgggcaaactatggcccacaagccaaatctggactgctgcctgttattctatggcctatgactaagagtgatttttacatttttaattgttgaaaaaattcaaagaagaataatttttcactgcgcattaagatgaaataaaattcaaatgtcagcgttcataaataaagttctactggaacacagccatgctcacttatctctccctggaactcaaaagtaaggaaaacaaatattttaccatcattacacatgcacatacacacacacatcacatgcgcgcacacgagcatgctccttctctgtgcccactgtgtacgggctttgcagaaattgcatttcttgcagagaaactttgaacctcacaatggaaggtaatttaccaatctcttatctatctatttatcatacttcacgttttagtaataactgaatttcacccttttcaagcttggaaattatatctcctcattctgctgaacgtgtctatggccactttggggctacaatggcagagcagagtagttgtgacagagacgctatagccctcaaaaaatattttgcttactactatttatttacaaaaataaaatatttactatccggcccttcatagggaaagtttgccgactcctggtctactatgagccaggtactgtgctaggactttcacatcttctataattctatcaaaaactttagtggtatattaggttatagagacctgaagaatgtatctagaatctagaataataacatgctttatttgtaaatattcaaatgatttgcaaagataaagagttactttctttaggatcctatcctttccctgcttaaacactgttattgattccaaatgcttatagaattaaagctaaaataggcaaaacataagactctttgcttacgcaatctagtccccacctacctttcatcacatctcatcactcttttccccatccctcacccaatgaatttctcactgtcctcccactttttgcagacagaagctgaaagtgacacattcatgagatatttagtgtccacttcattgaggtcccttgttcaccttttcctttctatacctttcttcactctccttcactttcttcatcgaattgtctaccattacaaaatagaaaagaaatgaagggagggaggaagggaaactgcaacacacacaggttttattggggtgaggcatacctcttattactctggtcagtctaatttgtcaaatcctcgagggtagggccgatacattttttttttaacgtcgtccaacatctattagaggttcagtcattgattatcctcctccctttcttcgtttcccttgggaaacctggaaaacagaaaatcttcccacagaaactcctcaggggcgcgccgagatctgggcttgcgcacttggacttggccggcgctcagcccccgcctcaagccggcggggtctcgcactaacctagcgcgggcgcctcgatctcccgcgcgcgcgcgtgcgcgagacccccctttggccccctaccctgcagcaagggtagcgtgacgtaatgcaacctcagcatgtcagcagcaatataaaggagaatgaggcggcgcgcctcccagacgcagagtagattgtgattggctcgggctgcggaacctcggaaacccgaatgtgaggaccttaagggatccacagctgccgccccccgcagccatccagagcgcggtcacagtccgactggcggcacggaggcggcggcggcggcggcggcggcagcggcggcggcagcggcggcggcagctgtagctgcagcagcaggtaaggagactcctgacgagaaactagagggacgtggatccaccgcgttcagtgtttcttgtctgaggggaggagaggctcacacccagcgtgtagcgtagggcgaagggaacaatggaagtggcgtccagtccctgagctttcctcccgcctcgggcggagttttcctcttcagccgcagccgggggctggaggaattgagggaagtaagggttttcccccttagccaacctcctctttccctaggccagagccccagggagctagagccgtcgttgagaccgtcggtggtttagggtgacggtaaaatggcggaaaacaaaacggtgaagtgaagaatgcagcgtccccctggcagtttctctcagctctccctccaccccatattcttttcactggcgccccagtcgcctcgcccccgccccctgaccgagctaatagtaacctttggaatgcgcgagggatggcggcgtgtgcgaggaagtggcaccgaatcggcattttaggggattgggagccgtcagagcctgggagttggggggagggggggggcgtgtgcgacaactgtcgcctacactaaaacaccaccattttggttcccaaccgtctcccacgtagcggggcagaggaagctggaggaggctgaggggctgggcagcacggcgtgggtagcagcggtggcgaccgctgcaccaagtgagaggagggaggaggggaaagggtattcttgtctcatcggtctcttcctttctgctgcgaaggttctcttgttaggtttaagatctagtcagatgggtaatacctcagagggcacgtgtgtgcattctgctcgaaatgattgaaacttggcatggtcgtgggaaaaggagacttatgcgggaagagggctgcgtccaaagctgcaatactgctacttgccagggctcctttgtctcccatctctgcaaatactactttcgcattctcttgttctgccgccttaccatttctcatctatccgtcaccctattgacatcactaagaagctaggtcctgaatgagctatgttagaagagacagattttctttttgtgatttctactccccatgcattaatggaaagatgtttacttgagacgtacttggtgggttatctccattcaataaggatgtgagatacacttagagaagaccaagaagcctagctatctctaatggttattaaatacttaacacactgctgttttcatacctcatttattattgattttattgaaacttcctatgtggggaaagatactccggtttatttatttggtattcacacagtgtaatacttttataatagttgcactatgtgttgtaatttttacacttcattgagtgctagtgcagacttttcagtatggatttggcaaggataaagcttgcccttgattctctttcactttctaaaataaggtgttgtttgtgatttttaagatgtgctttagagaagattttggtttaatcaagtggtagcattctaagtataataacgttgctaatgtagtgagtagttgtttttgttggaatccgttgggttgcttttaacattactacagatttgagcatatgaacccttcccagcctcactatgcaagttcaggtgtaaagaaaaatattaagttgtgtaagaaacttagtttaaaatattttaaagtatctgattttgaatgtatttttataataggtaaagagagcgttttcccaaagaaaataacatagcacagaaggaaaaataaaaagaaattgctgcagattttactttatgtgagaaaatctacaatttcttcgagacactcatataaaggtgactaacaaattacttattgttttatcttatttaacagttaaataaaattaagtttttaaaaacattttcagacatttgtagttgttctattagttatgtggtaaagaaagtaattactctaattaaaatccaaatagtacactgttttaaatgttaagaacatgtccctttcagatttattttgttaacacacaggtagtttattgtgaactctcttggccttggacctcattttgcataatagcaaagcagaaaacaatggcatttgaaaaaagatacacaactaagaatttctaaaattgtgaagtttgctcatacataaagtaattctgtctgaatcgtttgttatacagaaatgtcacctacttctgtagcatatttatgtatatacctgaaatggtgataggggttcctctgagactctcctgcctcctgaataccaatttagccatcctcctttatttaagaatatattaagttgtattacgtgtcacctttctgaaactttcattaaggttgcagctttatctgttgtgcaatatggtacaatttattaagcagtcctacgtgaaaaggagataagtgccttataaaattgacaggtttttgttgatttacttagaatcttatgtttgaagagaaaatgcacatatatgtgtctaagaaatacattgagtgacagcatctgactttatgttccatactatcaaatggtcgtaaatataggataagtcatttgaaatgaaatagattgagcccttgctttcaaaaccaccttgaagctagcataattttattaatcactaataaaaagtcagttgtacaattacaagtaaatgaaatgctgagataaataatttgctaaatgtttgtatgtgatcgatcttatttttaccatatttaggaagcagtcatgtttcatgagtcctcaaaactgagacaagagaatgtagtagagtgaggccagaagtccttactggttcaaagaactccggggaaactgggatagaacattttacattataagtagaaccctgggagccagaggtgaatacaagtttatctgcagagctccgctgcagggctgatctgggtctggaagaaatggatgagagccagtggatgaaattcactaatactagacatctgagtcctctagtaatgtataaatatcctaactattgtttgttgtcatctcgttcttcttttataacctatgttttaactggaacttttagcactgcagttttgttgttttgctttcttctaccacttccctatggctcatcagcttgactgtgcctttgtctccattatttttggtttacttccacttggcacttcttttatttatggttgtcacataaagcatctaaccatggtttttctttgttttgctttcttttgtaataagctttccacacttggttgaaaggcatattgtcaattgcatttttttctcaaaacaactaactttggactaaatatattaaactattttaaaagccatttcttttgcagatattggtgaatgaactttgctaagtatggattcaggcggtggaagtcttggattgcacacgccagactctagaatggcccataccatgattatgcaagattttggtaaagcattttctttgttgtatttttttcttttttagaagtaaggggataataaaaatcaaaaataagttgaggaaggggagaattacaatgaaaacttgttcttttactaggaaaatatatttgtagagcttattctcataaagctgtgtgtcagtggtctacttaacatcacttttacaatttaggggaaggttgtgttagggacacttgaaatatggtggtaatatgttactggaaatgaaaaactcaatttacataaataactgcataattatatcacattctgttctgatagtatatatcagctctcacgtgtaggaaatgttaaactgactttctaaaacacattttaagttgcattgttaataaaattggaaaaagaagtgcttacatcaactaaaaaaaagatgcttatatagtgatatgcagaatcatgcactaggtgattattattgtgatgctatttcctcagaaagttgttaccattagaatacatttttctttctcttttttttttttaaaaaaaaaaaagaggccgggcttcgtggctcatgcctgtaatcccagcactttgggaggcaaaggcgggcggatcacgaggtcaagagattgaaatcattctggccagcatggtgaaaccccgtctctactaaaagtacaaaagattagctgagcgtggtggagcacgcctgtagtcccagctactcaggaggctgaggcaggagaattgcttgagcccatgaggcggaggttgcaacgagctgagctgagatggtgccactgcactccagcctggtgacagaatgagactcagtctcaaaaaaaaaaaaaaaaaaaaaaaaagactccttactcttgtggccaggtttgtaagtagcctcttgacagtagtcattttgatgaggatgccaagactccattgacattcaacaaataaactgaatttggccagggatgatctgaattacagaggagatagagctatttgaagtataaaaggcagggatgagatcaaaagaattgaagataagattggagtgaaagcagaaaagacaaatggtgaactgcgataaaagaacagggaacgaggtaatatggaattgttgaagctgaaattagtgatgagggaatagaactgtgatactttgctaagttaagaaaatgctactattgttcgttgataatatggttgaatgtatcatttggtcccctgtagtaaatcccacagtaacggaagtcagtaaagccgtattctagtcatggcagtgctgttaactagctgtgtaaacttggataaattactgaattcccttttataatgattgcactagataacatttaaggtcctctccagttatagaattctttgacgtttctttctgatgaataaagttgagtagtacaatattggatgtgagttaattgatgaaatataaagaaatcgtggatgtattcttctgaaagctaagtgaattgtgttgactatggatgatttagaaatgactttgggtgaaaaaaactcatcaataaattctagaggaaggataatagggccaaagagtaagagattaaagatattcccatgaattctttagtagagagttgatagtttttagaataatggaacactggaatttcagtatggtaaataaattttggttgaaatgtcaactttaattttttaccttttaaaataagatatttttaaaatggaagtattatagtagtttctccatttaatacaaaatattacctctcctatagcatttgataaagtgccaaaactcacttcattcctgaagaggttggctattagctagtaaagtgtgattcctttcaaaagatgaaaaaaaaatctgattggtgctggtgaatatttacataatgttccttttaaccttcctttccattgtttatcctcaatgtctttagaattaattactcctttattacatctactactttttttcttttagttgttaggggaatagaatatgcatattgaaatatttaacatatatgttttttcttctttactttttattcagatacattcacataccattccattcatccatttttataaagtatacaattcaatggtttttagcatattcacaaaattgtataaccatcactagtacctagttttagaacattttcatatcctaaaaaaagacacctcatacccattagcagtcattccccattctgcctctccccaccagccctaggcagccactaatctttgtctgtggatttaattattctgaacattttatataagtggaatcatatatggtcgttgtgtctggcttctttcacttagcatgtttttaagtgtcatccatgttatagcatgtatcagtacatacttcattcgttttcactgccaatgatattccattgtatgagtacaccacatttggtttatttgtttatcagttgatagatatttgggttgttgaaatatttttaatccactagaaatattatgtgtttgacaaaataagctttgcatcttagattgaagtatgagtgcctttggaggcgtgtgacagtatgccaaggcatacctgaaaccacagaataaatagcagagcctcttggaatttttttttcatttgaattgaggagaatatatatacacacatatacctatacacaattatagctgcataaatatgtagaaagtaagattttcgttcactatcccctccctttttagaaataataaaattgaaaggtttgtgaactacttctaatttttaattagtattttcatattatcatttaaagccctctctaaaatgaatttaattgagtaaactgatttgtatcagaaaaatgtttaaaggcacttattgttgtttttgttgttatatacctgtttatgatttaactggtagtattttgagttagtggttttttcaaatgatgcattctttttaaatttcatttttatgctctcttaaatcaaggtatataaatcaatggcagttaaattacttttgcatttttggtgagactgtttttctgaatttgctattagatcaagagtaactaatatgggtaatgctcactcatttgtgcctagggataatgttgacttgaaatatgttaagtttccatttgtccttggtaaattctgaactcgtaaaaggcagtaactcactctatttttgatatgcagttcccagcacaatttcatttataggcattttcatttttgtatgatattttgtgaaatgcaaaggttgtcaaacagacctaaacctaaaaagacctttattaggggacttctggaaattttagccctgataacttagatttcttctgaaagcagcccccccatgcttattttacctccctgttaaaatttctaaattctaaaatttcattagaaattagatacattctctttaaattctgttagcgtcaaaacttagatatttgcagccccataaattattgacatttgtgaaacttagagtttaacatacacagagctaaccaaataagaacactgtggcacaagatctccaaattctgtaaggttcttggttgatacaatacagaaaatctgaaacattaatttaatgcataattcattggaccaatttattttgaagaatatttgagacttagaaatttacaactttgttcaataaccttgctggtgtctcagtataatagctgtccttgaagtatgagattgaatttaatagttgtttaagattttaatgctacaaaaagtctgtgttgttttaggatataaatagcaaaacacccttagatagtggcccaagacagacctgacacgtaacagattttatgctgtcattctggtgatgttccaagtattcatatttaaatggaataactttaataaaatgggaaatactggaaatcaggacatgtttcttactgttgcctgattatttaattttatactttttaaatgattttttcttattgtttataattttctaagctagtaagatgaattattaacgcaatttaatgctgtttacgaaatgatttaaaatttaaatgagctaccacgtgataggccattttactgtttatctcaagctgttcctctagctgtgcctcacttagttaatcttacacctctctttaaaaaacagtatctagggtaaatatactctaacctcttcccaggcaagtagaaaaaaggcagtctggagtcaaacagtgagttcagtttccagctaggaccttgtggcaaccttatataacatctgtaaaccatagttcctccttatttaaaatgaggataatcgcactcaccttatacagttgttctgaggattaaatgagatgatacttgtattagcaggttgcttgttggatagtcagtgcttaataaatatagctaatctatagctaagtgactttgtttagaaagtcagtggaatctaacagatgaactggtaagaagaacaagcaaaatttaataagagatatcttggatcttggtctaagtaatctgctgctaccctgtgagggacttaccaattcttggtctaggatccttgagagcatttggttcaggataaacaaacatatttggatttatttatttagttttttagatctgatctattttgacttgtaagttcctgctagaggctaagtgaactagcactgttccttcagtctatcctcttagaatccacccaaccaggttgatctgaaaccaagtccccactagcattattctacccttctttccttccctatggtctactttcaagaaccagactaatcttcagcagtgttctaaaataaatggaatttcccatattttaaatctttggtttgtgaaaagatttttgtgaattagtaattttattgtttagatatatagaattccagtacagttaattttacaggattaatattttaattttttccttgctaaaaaaccacatttctagtctgattaaatgctaaatttgaacccccacctcctccccatttctgaaatgcccagtggagtaacaactgaattaaaaatacttgttttatacatactcccttcgtgtaccagacttccaggattgtggctgtgtccttttggggtaatttagtggtttgggtgagagtttgagcggtgagaaggatttaaaagggttgaaagtaaagtatcccaaaaacgctgttgaaagctcagctttcccttttcaccttgttctttgatgtgttagtgtccattggtctccatcctaacttggtaactaacttccataatgaattgattaaaaataatgaacactatgtgacaaataacactctttcaggtactactttatagaaagtgatcaaaaggttttgtactggatgatttcttgtagataatttattataaccagatccacaagccctcttaatttgtttttgtaccacctcagggagcagaacttagcagaattcctcatgaagggattttacacttgtacaatatttacagggcaggtaggagttggtgtttaccatgccgctcaagaaaaacattaaagctttattcctacagatttactattatcaaaccaaatattagtctaagatgagtacagagtttttccccctaaatcaggtgttgaaagatgccttccaattttggatacagtaattattataagttaaagaagttcagacactttcatgttcatgatgtatattttataatagaatattttattaactcacttaacatattagtatccttttacgtttttgtgcctttttattttaattttttgaaacaattatagactcacaagcaatagagcaaaggagtacatacagtccatgtaccctttacttaccttcctgtgatggtggcatcttacataactgtagtataatacaaaaaccaggaaattgacattcacacattactgttaactagactacagacctaattcagttttcaccatttttaacatatattcgtgtgtgtgtatgtgaatgtatatattctatgcagttttatcccacatatagatttgtgtaaataccaccacaatgaagatgcagagctgttctatcactatatatatgctatccctgtgtgttcacagacacacacacacacacacacacacacacacacacacagacacccttggcaaccaataatctgttctccatctctatagttttattgttttgagataatataaattactccatttatacattatacagtatcataacctttggtgattgtctttttttccctcagcaaaattttctggaggaaattcaggttgttgaatatatcaacagtgtgttcatttttattgctgggtagtattccatagtagggatgtgccagagttggtggaaccaaccattcacctgctaaaggacacttgggttgtgtctaattttttgctactatgagtaatagctactatgagctgttaggaatatttctgtacagtgtttggtataaacatatattttcatttttctggggaaaaatgcccgagattgcaatggttggattgtatagtaagtgcatatttagttttgtaagaaatcgccaaactacgggtggatcacgaggtcaggagatcgagaccatcctggcgaacacggtgaaaccccatctctactaaaaatacaaaaaattaggccgggcgcggtggctcacgcctgtaatcccagcactttgggaggccgaggcgggtggatcatgaggtcaggagatcgagaccatcctggctaacaaggtgaaaccccgtctctactaaaaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaaaaaaaaaattagccgggcgcagtggcgggcgcctgtagtcccagctactcaggaggctgaggcagaagaatggcgtgaacccgggaggtggagtttgcagtgagccgagatcgcgccaccgcactccagcccgggcgatagagcgagactccgtctcaaaaaaaaaaaaaaaaaagaaaaagaaaaaaagaaatcgccaaactattttcgagagtggctgctactattttacgtttgcaccaataacgtttgagaaatccagtttctccacatcctcaccagcctatggtgctatcactgttttttgtgttaactgttttaattggaatgtagtgatatctcattatggcttttatgttttacttgaaaataaagtatattattttaaggtcttcatgtagattttactaacatcgttttcacccaactctaacccaattcctggttgttggtgattttaattgcagttaaattgtcaatgattttaaaaaatgatttatttggccaagattacttaatatttaagaaatatttatagcatttgatttattaaatacagtactctaaattaataaaataactttaccttttttggataattgtttgtattatagtggctggaatggctggtactgcacatatcgatggagaccatattgttgtttcagttcctgaagctgttttagtttctgatgttgtcacagatgatgggataactcttgatcatggccttgcagctgaagttgtccatggacctgatatcatcacagagactgatgtagtaacagaaggtgtgattgttcctgaagcggtacttgaagctgatgttgccattgaagaggatttagaggaagatgatggtgatcacatcttgacttctgaactaattacagaaaccgttagggtaccagagcaggttttcgtggctgaccttgttactggtcctaatggacacttagaacatgtggtccaagattgtgtttcaggagtcgactctcccacaatggtatcagaggaggttcttgtaactaattcagatacagaaactgtgattcaagcagctggaggtgttcctggttctacagttactataaaaaccgaagatgatgatgatgatgatgtcaagagcacttctgaagactacttaatgatatcttgtaagtgaaacataaagcccataattactcaggagattgatttatataatctggaaaagttttctgggatgagggatatattcaataaaagttataggggaatctttttgaaaaataattttttgaagcagtgtcattaagatgctgttttgagtttactgatgtttttaatttattcaatgaaaattcatacctgaaatgaagtaaaataatgcagtttattagtatcttaaaatagaggtatagatttggcaacaacaagaacattaactgatacaaaattttaatgataaatatatatatttcaacatgggaactttcttatgtagccactgcttttttttaatatgacaggcactgaaattgtcaattaagtttttcttaggaacttaagcagaatatgttaagaaatgtattgatttttaaattaaatacttgaaaagtaaatcataaactcagataatgtcctacagttctccctgtgtttatattgcttatgcctaaatatgtgtgtgtatattttatgcaaagctatttaacatgtttattttagactgctttgcaagattcttaaaacattctatccgaagcgggaagatagaaatattttgttctcattttaaatgatgggtttatgagagcagcaacaaaaataaaaaatatcttgataagttattgatggagcttaaagaagtaggtatattagttattaaatttgaagggatcatgctacaagtagttaagattagacaattttttttgacttatccagggaagatttttattctttttaaaatacaaaaatggttgactgggaagtttatcaccaggtagagtgtgtgtgtgtatgtgtgtataaagtgatcgtatgtatatgtgtattagtgaatttaaaactgaaaataaactaaatttatttaatttgtgaatttaattgtaaagtttagcataacttttttcttctataagcacttttgaaggtgaatttttacattgtttttaagaaaataatgtaagccactaaaagactgcaaatattgttacctatttttaaatagatatagattactaaagcaactccatatttacatcttaacgtggcattttttaaaagatctatagtatggttatcatgtaaaatgatgtggcaaaagttggtagtctacactaaaattcagtatgtcttcaaaagagtattcattaatttaaactgatattaaagtagtgcaaaatttagatgtcatgtattgtgaacagtcataccttgtgttatcttctatgatttaattctgcaaaagttttttaaaaaagtttctggaatattctaagttagaataattattttgataactacctcatatatcaaatacaaggactcctttgaggaatataattttattttttgttgatttgtttggtttcaacttttattttaggatttgtacgggtatgaatgatcccatctcctaggtactgagcatagtacccaacagttagttttttggtcctcgccccactccctccctcccacctctagtaatccccaatgtctgttgttgccatctttatgtccatgaggaccccatgtttagacttctcttataagtgagaacatgcagtatttggttttctgttcttgcattaatttgcttagaataatgacccacagcagcatccatattactacaaaggacgtgatttcttcttttcttacggctgtgtagtattctgtggtgtatatgtaccacatttcctttatccagtccactgttgatgggcacctaggttgattccctgtctttgctattgtaaataatgctgtgatgaacacacaactgtgtgtgtcttcatggtagaatgattgttttccattggatgtatacccagagtgggactgctgagttgaatggtagttctgttttaaattctctgataaatttccaaactgctttccacagtggctgaactaatttacatcccaccaacagtgtttaagtgtccccttttctccacagcctcaccaacatctgttgtttttttgacattttagtaatggccattctggccataataaaaaaatagtagatgttggcatggatgcagtgaaaagggaacacttttacactgttggtgggaatgtaaactagtacaaccactatggaaaacagtgtggagatcccttaaggaactaaaactagatctactgtttgatccagcaatcccactactaggtatctacccagaggaaaataagtcattatacaaaaaagatactttcacatgcatgttcatagcagcacaatttgcaattgcaaaaaaatatggaaccagccggaatgcccatcaatcaacgagtggataaagaaaatgtggtacactatggaatactactcagccataaaaaggaatgaaataatggcattgcagcaacctagatggaattggagactgttattctaagtgaagtaactcaggaacagaaaaccaaatatatgttttctctcatatatgggagctaagctatgaggatgcaaagcataagaatgatacattagactttggggactcgggagaaagggttgtgggtggtgaaggatacaagagtaaacattgggtacagtgtacgctgctcaggttatgggtgcactaaaatctcataaatcaccgctaaagaacttattcatgtaaccaaacactacctattccccaaaaagctattgaaataaaaacattttaaaaaatagcttgtcagtatgaacaagcaaaataataataataataataataatgataatggtcattctcactggtgtgaggtgatgtctctgtggttttgatttgcatttctctgatgattagtgatgtggaacatttttttcctatgtttgttgaccacttgtatgttttcttttgagaagtgtctgttcatgccttttccccgtttttattggagttacttgttttctgcttgctgatttaagttctttgtagattctggatattatacctttgtccgatgcatagtttgtgaatatttttctcccattctgtaggttgtctgtttactccgttgatagtttcttttgctgtgcagaagctctttagtttaattagttctgacttgtcaatttttgcttttgttgcaattggttttggggacttagtcataaattctttcccgaggccaatgtccagaatagtgtttactaggttttcttctaggattcttatgtctagaggttttatctttaaactttggtccatcttggctaaattttgtatggtgaaacataggggtccagtttcattcttctggatatggcttcccagctatcccagcaccatttattgaatagggagtcctttcccattgcttacttctgttgattttgccaaagattagatggttgtagttatgtggctttgtttatgggttctcttttctgttcctttggtctatgtgtttgtttttgtactagtaacatgctgtttatgttactgtagccttgtagtgtagtttcaagttggataattgatgtctctggctttgttctttttgcttagggttattttggctatttctttcttggttccttatgaattttagtgtagttttttccaattctgtgaaaatgacgttagtagtttgataggaatagcattgaatctgtagattgctttgggcagtatgtccattttaatgatattgattcttccaatccttgagcatggaatgtttttccatttgtttgtgtcatctgtgatttcatttattagtgttttatagtactcctcgtagaggtttttcacctccttggttaaatatattcctgggtatttttttgaggctgttgtacatgtaattgcattcttgatttggctctcagcttggatgttgttggtgtgtagaaatgctactgatttttgtacattgattttgtatcctgaagccttaataaaattgtttatcagttctaatagcctttggcagagtccttagggttttctaagtatagaatcatatcatcagcaaagagagatagtttgacttattttactgtttggatgtcttttatttctttctcttgcctgattgctctggttaggatttccagtactatgctgaataggagtgatgagagtaggcatccttgtcttattccagttctcaagaagaatgcttccagtttttgctcattcagttcgatattggctttgggtttgtcataaatggctgttattattttgagatatgttcctttgatgcctagtttcttgagggtttttatcatgaagggctaatacattctgattttatcaaaagcttttcccatatctactgcaatgatcacatggtttttgcttgtaattctgtttatgtggtgaatcacatttattgatatgcatatgttgaaccaccctttcatccttggaatgaaacctagttgatcatggtgttttaactttttgatgtgctgttgaatttagtttactagtattttcttgaggattcttgcttaaggaacataattttgtataaagcaaaatatcttgttaacatcatgatgggagatctcattcaaacctccctaatttcaggggtaaaaaaagttaacacctttataattttaaaaactataatgacttttttgagatataatttacacatccttttatttacccatctgaagtgtgcaaataagtggtttttcatatattcacagggttgtacaaccatcaccacaatcaattttagaactttttcatcaccacaaaaagaaaccctataccctttagctgttagccccccccccatccactctgaggcaaccatgcctgtatagatttgcctatcctggatatttcatataaatggagttatacaatatgtggcattttatgtctggctttttttacttcacataatgttttcaagggtcattcatgtcatagcatatatcagtacatttgacccttgaacaatgcaggggttaagggtgctgaaccccgccccccctgctgacatacacacagttgaaaagccatatgtaactttcagcttaccaaaaacataactactaacagcctactgttgaccagaagtcttaccaataacagtcaattaacatgttttgtatgttatatgtatcatattctgtattcttacaataaagtaaactggaggaaagaaaatgttaaaatcataaggaaaataaaatatatttactattcattaagtggaagtgggtcatcataaaggtcctcatccttattgtcctcacattgagtaggctgaagaaggagaggaagaagggttggtcatgctgtctcagaggtagcagagcagaagaaaattcatggataagtggacctgcacaattcaaacctatgttattcaagggtcaactgtacttcattcagtattactaataacattccattatatgggtattatcacattttgtttatccattcatccatcagttaatggacatttaggttgtttccactttttggctattatgaataatgctccatgaacatttatgtacaagtttttatgtgagtgtatatttttagttttcttgggtatatacctgggagtggcataactctgaaatctaaaggtgactatcttgttgttcactttttcactctattgtgaaatacagattctttgtatattgcctaatcccatcactgtggtatatcagtatactgtatagtttttataccatactcaccatataattttggtagatgtaagtaacatgcaacaggtaaaataaaaagcctacctaacttttaaaaaggaatgttatattgtacatttgactaaaatgaaattttaattaaattgtgtgagtgggccataaaataatattgaatgttaccaaactttacagtgttggcaaacaatgcacttcactttcttatattatatttagtgccagaagaattctgtggtggttattttattacttattgctggattgagaaacaacactattggacttgaatattgcataccttacaacaagcaaaacatttaagcttgaatttaaggtattttgagtattatctgcatttagaagggcctttggagatttatttctaaagtcagttgattgcctattaagtctttgttaatttcgtactttccataacgaaggatatagaataaatcttggtcaagttgatggtttacctcttaaaactgcgtgccaatatctttaataattttatcattttctgtgaacttaaaatacagaataagttcagttagtacatttcaaaattgctcattctgaggaatctaagtaaaaattaatggatgcattaaatttaaaagtatgaaccttaagaaaaggtagaaatggaatcagagagaatagtattagtaatttcatacttattgctaaaattatggtacaaaactattaagaagtggtgaaaaaaatgtgactttcatttcatgaactttaattttgtgaattatagttttaactcagcttatcccagaaggaactgtgatcgctttaaactattcatgtataataaagtagaatttataaaatgagagtatttttattattttattaatttaccataagttatttcagcctaaaagtttgtattttggacactttttgaagtttttttatattctgtttttaattaatgagaatatagtttttttctaaaaacttactcatgattttttctatgtcatttttattcaacattattttataagagaagctattaagccagtaatatcaaatacttaatctttttttattttaatttgtaccattgtcaaaaatgttgccaaaagtttagtaatataattaggagctctgatggaatgaaaatatgtagactttattttgatcatttggatgctatctttcatagacagtaagctattaaaatttggaagtaggatagaatcatttgtatttaatcacaaagttaaagtagctctgcaatgtaaaaataatttttaatatgtgttgttttccactattttgaaaggcctaaggaatatttttcaagttgtatgtatcaagtttgaaactaaagtaaggaaaatctagactttgacccatttagatcttgctaaaattgtttttaggagtgctgaattaatagctttttaatgtcactttattctgtttttaatggttctagaattgttagatgtatgtaggggcttcaaaatttgatgtttcatatttagtactgttacatatatataataaggaggagtagattttcaatttagattacatttgtgtttttataggaacagcattaaaagaataaattataggcatataatatttaggaggcatatattgtttgaatattatttatggtcagaggacagagtttattaatctattcattgcatagttcatgcatagtattcatgtgaacttaaatgttatcctaaaagactatacagtggagaatcaaaaattttaagtgtatttaaaatgtaagcaataggtccaaatactgttgccttatctttatatatgattttcttttaataaggaaaaagagggggaaatacccatttatttcccttacatataattttgaaataaagcatacattgcaaaatctagatatatacaaaattcatggcttgaagttgtcttccattgaccctgcagaaattagagtatttactaagattttatttccatgatgtatgaaaacctgtttttatagtcacttaggtgttctctgtgtttctttttttaatcctagatcttgtatgctaatttgttttagaaacaaccactatttaatttgggaactgtagtttatgtgaactcattttatgagtaatatatgttttatgttcttaatttttctgttattaaatttagtgttaggatttaccttaaaatattgaaagtgatagaatttgaagccgttttaattaaagctatatggttaagtattttgtatctattaattgaaatctgtaaatagatttttatataattgcgattatgtaatataactgatcttgtgtactgtttttccatgaaccttgatgcttttttaaattttaaaaataattttattgttgcagatttatgttgcacaggtacaggtttattacatggatgtaatattgtgtagtggtggggtttgggcttctagtgtacctatcacctgaatagtgaacattgtatccaatagataaattttcaaacctcataatctcctctccccccacctttttgaagtccctaatgtctattattcatgaatcataacacttttaatggcttcataataggttattaagtgaatacagtgggtaggtggttaacattatttcacgttacacttcagcttaacacccactaaatagtggtaatttttcttgttttgttgttttttgtcaatggtattttttgactgaaataattttgtttatattttatagtggatgatgttggagaaaaattagagcatatggggaatacaccattaaaaattggcagtgatggttcacaagaagatgctaaagaagatgggtttggttctgaagttataaaagtgtatatatttaaagcggaggctgaagatgatgttgaaataggtacaaacactaattttaatttattgctccaataggagttataatttattatattttctggggactagtctaaaaatgttctcaaagcatgggtttttttaatacgttttctttgggaatagtctacttttaaaaattgtatatgaatataaagcaggaatgcagaatatgtcattctttgattctttcaagcatgagtagaatactgcagcagaaaatatcaaaacaaatgattggagaggatttggtttagattaagaaactataatgagtgtttacaagcatggattctagaggcaggctgcttgggttttaaataggtcctgtcacttagctgagtgacctttgataaattacttaacccccttctgtctgtttcctcatccataaaattctcataataataaaagctacctatagggctgttgtgagggttaaaggggtaaatatgtataaaagacttatatactgcttggcatataagcttgatgtaaggattaacaattgtcatttctcagtgatagctgaaaatttaaagtataatttatatgaaaatgttcttggcactttgaaatttattttggaatttattttttttctaagaaatatttctatatattcttcttattaatttaggtggttattccatgatacttctctattttaatgcgtgttttaatttttaaggtggaacagaaattgtcacagagagtgagtacaccagtggacattcagtagctggagtgcttgaccagagccgaatgcagcgggagaagatggtttacatggcagttaaagattcttctcaagaagaagatgatatcagtaagaaaataagggcactgtagtgacttatcagtagccatcatgcattatttttaaaaaatctcagagatacaagcactgtataggaacaaagttcaataaaataagcctgatcctttgaccctttgctgtaaataatttaaaagtgaagggtccttttgaccattcatttgtacatgtattgttcaaatcaccaaacattaaataatatatcttagtatactatactagaaatacagagatgaacaacatacagctcctgacatcagtgaagctcaaaaatatgtaattactgagtacctactttctgtgcgttactgaatatgttgcaagatactatctcatttaattcttacaactcatatctgaggtaggtggtatttttcctgtcttatggaaggaaaaaaaaagattcagggaaaataatttatccaagatcattccaatattaagtgtgaagggcaggattttaatggttatctaactccactgccaatgttctttccacatggcagtgggcactgttggcttctctctggatttagcaattgaagggctgatggtttgttctcctgtcactaaagggttatcttatgtaagtattcttccaagccaagctgccaggagtttgatttcctatgctgttgatggtctccaagcagttgctgcttaaggttttgtggggctaagtaccacaggacgatcaaacctcctcaggtttcctttcctgccataccgcaggtttccttatgaagacattttgctctctgcctactttctcctcacctcagtataggaatgcagccctttcctaaggctattcctgtcttcttactatgctgagaaaaacacaatattgccttgccctagaaggctaagagcctccatttcactgcattaacttgacaatattgggctttacctgtgctgcactctgatacctactccaagtttccttccctagaagttgtagggtgctgaattccacccccaaacagctgaaaatatcaaaacaaatgagtggagaagattctgatggataggaaaagagtttaatcaaataatttctatttgatctctaaattctttatttttttatttattggtaaggaaaggggcacagtaggaaatggaagattgaggtttaagttaacttatgccagaattctatgggaatgtgggaaacttagaccagtgtctctttttggttaatagagagaagacaaacttgggagaagagggatacttttttcccatgtttttccccacatttcttctgtagtcatccaggatcccagtatgtgaatcaaaggaaaagcaaaaattcaagacaattttctatttaacaagttaaatgtaaacagattattttatataaagtatattgtggctctctaggtttaaatattttttttttcttaccgcaatattgttttgttcaatgaagctcatttaatgctttctctcctcagtagaatctcttaaaatctggcctattgaagagtgtccacatattcttgatcactagcattatatacatatataatttttatttttattttaaatttttttcaattacaagtatttttggtgatttttattacatgtatagtactgcatttcatttataatacagtatacgagatagtatggaccactttctagtattatttctatgagaaatattttctgagtcccaaaagactgtcaggcaaataaatgtataatgcctgatagaatgtaagatcattcagtatatttcaagcgcacatgtttttataaaatttttaaaagccatttccatagaacttggttctaagaggagaataagagttttggtaaatgattgtctcctagtggcactagcctccaaaagtgcctaatataaattgaaattaaatttataaatttttaaattaaccaaactgaaatttgaaagttgaaagatttacattgtttggaatttttacccacttattaaatatttggggttataaacaagcaattatttctaaaatttaggttgcgctgaaatagcagatgaagtttacatggaagtcattgtaggggaagaggaaggaacttctctccctgagattcagcttgaggactctgatgttaataaaacagttgtccctgttgtctgggctgcggcatatggtaggatactggcattttttcacctgataagtacataatatgtatttactcagcctttaggccattaaataagctttgtgaatgccaccatgaattggctaatataataaaatgttttacactgtggactgattcatctctagttactttagatgatttttctaccacataccttgtactatttaaaatgaaccttgcttaatgcattatgtttttcagtatgatctattttaaatcctacctgtataagtgagtgccataaaaaattttatttttctaaaataggaatatcctttgaaaatcgatccttcctcttttggaaaaacttatttcatttattaactctacagatgataaagttttggggttttgaaaaagaaacagaaacccaggtatgctcttttagaaagcatataatgaaaggtaaatttatcaacttatttttccctttcagtcttattttatttcattcctatgtaacgtacaagatggtccaggtatactctttactttgaaaaattttgatgttcaaatgcattaatttatctaaacttggttcttccaaaggttcattcattcagttatttattgagcatcttcaaagttaggggtacactgcagaaatatctacccagttttcatttaaaaagtaaaattgttctagatgttaacaattccaaggatgctgaacagcagcccttattttcagtatgtgacattatctaacctataggagtggaagaacacaacaattttttttaacccaaggaatggtgggcaaagtaagattttgtagattaagatgtgatccactagtagtcattataattagcatatcagtttgtaattggtctttttttttttttttttttttttaggagatgaaagaagagtttcccgaaggtatgaagattgtcaagcatcaggtaagagagcattgtatatgagatgtgagttaaagttctggctttattttattttactgcttggtaagtaacaagtttgtgtctacagacacatttgttggactcttacttgcttagtcatacctaatctagttagttaggagtttcttctttgaggaattaatttatgtgtggacataatgtgtgttaatctgtaaatgcagttccatttagatttccctcaaactttaagcatcaggcagtttatcaaatggaccataacaggttgctatggaaaaaatgaaataagaaattatttggacagaaaagtaaaaattattcatgatatcaaccccttgttaatgttctttttggggcagaactgttttcttaatttctatggcaaccagtgcatttatatataactgttatataaaacccatgtgtcagcttaattttttttagttttaatacactctatatggtgttgttctctagttgatcttcttgttaagttttcttaagcaaggagatattttcttatgataatgtgtcattgttctgtttctacccttgggaagtatttgactctctaaacttaggtgttgatttcgagaaattgatgagaagtatagatcacagcatgtaagttaacctgacagttttgtaggtctacattttttagctaaattgcataaaaccacaatggatttttgataactaggattttattaagtactttttaatgtatgcactgatcacactgaaattgcaataaattgcctaccatatgttaacccgtaaaatcaatcttaatatgtagtactctttatatcaagtacactattctgaagcatatctgcaagagatctgtttcgttttttatgcattacacttagtcaccataactataatggttcagtaatatgtctacatttctttttcaattaatttcatcagccttcattggtaaaaaaaaattggtctgatgccaagattttgtttcaaattcagtttcttttctttcttttttttctttttctttctttctttcttttttctttttttttttcaagagacagggtcttcttgctctgttaccgagactggtgtgcagtagcacaatcatagctcactgcaaccttgaactcctgggctcaagcaatcctcccatctcaggctcctgagtagctgggactacaggtgcatgccaccatgcctgaccaatttgttttttgtagagacaggatcttattatgttgcctagggtggactgaaactcctgacctcaagcagtcctgcctcagcctcccaaagtgctgggattacaggtgtgggccatcatgcccaccccaaatccactttcttatattacattcatcttatcagtttattcctgataaaatagagatattttaaatttaattgatgatcaaattgagatattttaaagttaatttcacatgatatcctattcaaagtatttacaaatacatgtctttacttgtgagtgagagagaacaagagtgagagagagaaagagaatcataagatggatatactttgtgaaatttactaccagagtggtaacttggtgtcatgtcatctgtagtaactcattcaacagaaccaaaaaagtataaatgtatgtgatttaatgatgtttcaatttttttttccaggaaatactttggactcagcattagaaagcagaagtagtacagcagcacagtaccttcaaatttgtgacggcattaatacaaataaagtacttaaacaaaaagccaaaaagaggagaaggggagaaaccaggcagtggcaaacaggtaaatactttgctttatgaatattataattatttgagatgtggaagtattttttgtcaccaaagaaaaatatcgatggtttacttggcagttctactctccatgtacctgtttgtgtatgctatagataattgtttttttttttttttactttgtgtgactggtacttaataaaactatgcttgtttgctctttattccaaagatacttttacagagaattttcaggttggtttaacaataaagggtacctgtttttggtattcaaagtatatatgatattgcattttggcatgtgagtggttcatagtagagtgctgctcattactttttagtgagctactttgccataaattgcttttattatgtattttttatattacaggatttcattcaactagtattgttttcacatagtgaatgccaactagttttggcacctttgttataaaatcctttaaaacagtctgaccaaatgtcacaactttctcttttctttatctagctgttataataggtcctgatggacagcccctcacagtgtacccttgccatatttgcacaaaaaagtttaaatccaggggattcttaaaaagacacatgaagaatcatcctgatcatttaatgagaaaaaaatatcagtgtacagattgtgactttacaactaacaagaaagtgagtttccataaccacttagaaagccataagctcataaacaaagtcgacaaaacccatgaatttacagaatacacacgaagatacagagaggctagtccactgagttccaataaacttattttaagagacaaggagccgaagatgcacaagtgcaaatactgtgactatgaaactgcagaacaaggactgttaaacaggcatttgttggccgttcacagcaagaattttcctcatgtttgtgttgagtgtgggaagggttttcgacatccttctgaactcaagaaacatatgagaacccatactggtgagaagccatatcagtgtcagtattgtattttcaggtgtgcagatcaatcaaatctgaaaactcacattaagtctaaacatggtaacaatttgccatataaatgtgagcattgtccccaagcatttggtgatgagagggagcttcaacgccatctggatttgtttcaaggacataagacacaccagtgtcctcattgtgaccataagagcaccaattcaagtgaccttaagcggcacatcatatctgtccatactaaggattttcctcacaaatgtgaggtctgtgataaaggttttcatcgtccttctgagctcaaaaagcatagtgatatccataagggtaggaagattcatcagtgcaggcactgtgactttaaaacatccgatccatttattcttagtggccatatcctttcagttcatactaaagatcagccattgaaatgtaaaaggtgcaagagaggattcagacaacaaaatgagctaaaaaaacatatgaagacccatactggaaggaagatttaccaatgtgagtattgtgaatacagcactacagatgcatctggctttaaacgacatgtgatatcaatacatacaaaagactatccacacaggtgtgaattctgcaagaagggattccgaagaccatcagaaaaaaatcagcatattatgaggcaccacaaagaggctcttatgtaataagatcaatataaagaaagaagctatttaggagatatgatatgctacttgggagaaaactctcactaactgtctcaccgggtttcaaagcttgatactaaaccatgactttacattctttgtattaaagatcttaaaatatttgaattcacaggggatcccatagccctttgaaaattacttaaagaatttaagaagcactatagaatggttacagaaaaacttcttaagtatctgtgtaatagtattatatgcatacttaaactacagaggggaaaagcaaagacaaatactttatttggctgattatgttagatacaaatgtttctgagaagagaatacataattgagtttagtgatgctttgctatagcaagcaaacccacttttatgcaattttagaaatggggcagggaaacaaaatgtggtcattcatcagtcacttagtcattgagccttttatattgtacctggaaattaaattccagcaatgacaaaagttttgtgtattcattaaaagaaaactaactggaaaacaggttagattaattcagtactattaaaaaagaattcagagctgttaatattttatcacaggataggatacttaaaatatagcattctgtgctgagatctaaggtgaagtctataaagattaaagttcccttttttctgatgttcaagttgattgttgttcagtatggcatatatgacaaaagtatatttgagtcaaatgtggctttctaaaatggatgcaacattagcgttgcaaacaaaatcagcactatatttcttaatgatctaaagattaatttgagagaacacagttttcttaaatattataatgtctagagtttttttaggacagtcttagcaagtatgattgttctagtcttacttgctctaatgtttaaaggtgcaattttatgccattattgaaattgatttttaaaatctatataccatatgattaacatgcattttcaatatgaggcagtgtttatgcagtatttaacagagcaatctgctgccaatagagtttggaggtggatatttagtttacagtgtataaacttaaaatatgcatccctttaacaacgctttgtgttagcatgctgcaaatcaaaatggcacttaatattaaaagctggtttagggaaattttatgaaaatcctgttcataaatgtaatgcatatgatatgtacttttaagttttagttgcttcatgtttacattcagctgttcaacataattaaaatgtaattttacttcatgctatattgtggctttgtgtttcaaataatgttcacctttctgtttttgcaccagataagaatcagttccttgagaataaattttttatctttcttaacttcagaatattaaatttggaatatctactaaaattgtgtgttatgtggctgtaaatgatgtacacgctgtaaaataagatcgctactgttatgtgggattattatttctaaatgttactcattgaaatgagcatacaataaaaagcatttattgcacttaatggttttataagtttatttaaagtttccatattttttattaaaagacttcacttcagagttacttaggcagattggtcctttctttaatgtcttgttgaattttgttcatgaacaacaacatgaactaggaatttaaacagttacgatgactatgtaatgcatatttcttaagaatgtatgttatttgctaaaatcataatgaaatactataaataaaagtgtccattttaagatcttagatttcatattagagagaaaactaaaagttcttaacttgcttaaatgacacaatcctgagcagtgaatacatctaattatgttcccaatatacattcaaaaggaaaagtattgttgtgtgtatttggcaaagatttctgcaaatgagcataaaaataactttctatgttcaaaccagtgagcatttcatataattctatatatatggcactgttagttaagactctttgtcagttgaattattaattattaattaatcactagcagaaaaggaaaatatcagcctcacatgttagaccagtgcttcttaaatctaaagtc

SEQ ID NO: 15124 - DNA, 4957 bp, Human
caaaatgctctctcatagaactttttttttaactatatattcacataacttcacgctatacaacattggtattcataaaatctacatttatttccaaaactaaacaaaaacaagtctaaaaattatttgagaaaatacatcatcatagttcccatgagcacttcatttaccaggataaactgtagggtaaaaatgatgagtctaggccaggcacagtggctcacacctgtaatcccagaactttgggaggccaaggcacacggatcgcctgaggtcgggagttcaagaccagcctgaccaacatggagaaacccggaatctactaaaaatacaaaattagccaggcatggttgcacctgcctgtaatcccagctatttggcaggctcaggcaggagaatcacttgaacctgggagatggaggttgcggtgagccaaaatagcactccagcctgagcaacaagaacgaaattccatctcaaaaaaaaaacaaaagaaatgataagtctaggtcagggatcatatccaagatcgtcctatcataggtgatgttccagttgcctgtgaacatggctacataatcatacagattgtccaaaagttaaggctacatctccggaatgatggtttgtcctttaaggaaggataagagaagacatgcattcccaggaaggtgtgaatacccaagaactattctatggaaccccatgtagtaaagcgcttctcagtaactctaaattagagaagctatttcaaactaaaaattcatctctagagatgtggaaagtttaatcttcagtctcctgctagaagggttgaggatctagatactcatgcaatttgtatggaggacagtggagagaatgaaatacagaattttactatctcctctctcatgcatacaactacccttgagaacattttttaaatttttgaaatctttatgaaagtataattggtataaaaagaaccgcatatatttaatgtataaaatttcaaacacccatgatatcttcaccacaaacaaggtaatggacatatctaatacctctcaaagtttccttgagaacattttaagtgaaaatgaaaaatttaaggtaatcaatagtctttttttattacaggtcctctaccttattatatataacattgctaaataaccattaaaagtcatttagtcagtaagacaatgtgttgtattaagagacactatgccatgtaattgttcatctgaacagccaaaataatgacctaaagtttctttggaatcaaataacctacatttagtgttaactttttaaagttcctgaaaatatataactctcactatggaaccaaactttggattctttactaattatcaatattaacattcagcaaaataaaaattcttcaagaactttccaattttaccagttttatacttgctaccaaattcttgatgttcaggttgccagaatggaacactcaatctaatttgaacttcagtacttcctgaaagcactgatcttaagtaatcagggacatacactaaaaaattattgatttttttacctgtaattcaagtttaactgagtgtcctgaatttttagtcgctaaatctagcaaccctattgaggttactagcatacatcacaaattaatgaatccaaaatgcgtacaccttagcctcagaaagacaatgcaggaccatgaaagggaattggcccaatttgcatcttagtaaacagtagctcagcctaaattaaccgtatgtggaaaattacaacctgctgagtaggtaaatgggcatacagtggccaggccaaggatcgccaaacacattgtttgtcaagactaattaggatttaatgaagatagctccagtcttcatttatcattccagtctccatcacaaaacagactacaacaaagaggtaaagaaaactacatcaaaatctaagaagcaggtgtggatgtcaaactccatcaggtcaactagaaactaattgcatatttaaacatggcagataaagtgcagactactttattgttcttagcagttggagagttttcagtggggatcttagggaatgcattcattggattggtaaactgcatggactgggtcaagaagaggaaaattgcctccattgatttaatcctcacaagtctggccatatccagaatttgtctattgtgcgtaatactattagattgttttatattggtgctatatccagatgtctatgccactggtaaagaaatgagaatcattgacttcttctggacactaaccaatcatttaagtatctggtttgcaacctgcctcagcatttactatttcttcaagataggtaatttctttcacccacttttcctctggatgaagtggagaattgacagggtgatttcctggattctactggggtgcgtggttctctctgtgtttattagccttccagccactgagaatttgaacgctgatttcaggttttgtgtgaaggcaaagaggaaaacaaacttaacttggagttgcagagtaaataaaactcaacatgcttctaccaagttatttctcaacctggcaacgctgctccccttttgtgtgtgcctaatgtcctttttcctcttgatcctctccctgcggagacatatcaggcgaatgcagctcagtgccacagggtgcagagaccccagcacagaagcccatgtgagagccctgaaagctgtcatttccttccttctcctctttattgcctactatttgtcctttctcattgccacctccagctactttatgccagagacggaattagctgtgatttttggtgagtccatagctctaatctacccctcaagtcattcatttatcctaatactggggaacaataaattaagacatgcatctctaaaggtgatttggaaagtaatgtctattctaaaaggaagaaaattccaacaacataaacaaatctgaagagaaactatgcttttctaggacaaacaaagataagatgtttctaaattaacttcagttcttgcattaatgttttatgtgattaattactcctaaaacttaattagtgtatctgtaattgtaatgtagggaatcttatgtacagctggctggatctctttatctctgtctctgtttctgactctgtctgtgtatccctgtttctctcttctgtaactcttcctttctttagagttgctgttttttaaaacatgtttcagagcaaatagaaattaatatcctaatatcaactatcaagagtagagggcattttcatagttctaaaccgtgtttccagatgcaaagttgtgtgactaattcaaaacaactgtaacagcatcttgctgttatttgcatctttatgaaaagcaactagttccttctcatagtccgcgttagatggttcctcttggatcatccaacaaagctctacttttgggaaagactcaataaagtgacagttcttaataaatgctgtggaattctatgaataatcttataatcacagaaaaggtatatattatggctaaatatattgtcacagtaagttcaaagattatttgagaattgcagatcaatgaatgaaggacaatctataagtaaaagtgagaaaaattatgtagaaaatgtctataaaataagaagcctaaattgaactattaattatttattgaagaaaatttctccacaaaagacgtatgtccacggactgcaccaggcaatgattatcaagatgctgtgacaagacattcaatcaaaagctaatacatggttatgctaaaatgtcaaaactctcaaaggatatattgcctcaatgtagatcatctctacatcccagagaaatattgtttggattgtatataagacatctttttttaaagggttcaatgattctatttcagtaatttgttgaacaacagaacatctgtaagaatatagaatacattaacaaacactatcaagcaacctgatctgatatttatgaaagattccataaaaggaagagacaacacattctcttttcaagcatatattgaatattctccagacaatgccatatgtcaggccacaaaaggaaatatgtatctgggacataccatcaaaagcacatcattcgtattgtggcaaagatattttagggtgatcaaccctgtactaaccagcctagagtagccaggaactttgtgtacaaaaaagaaaatatttgtaaataaagagagaaaaaaagttttcatggttaaacatgattatttgtattacagtaaaaacttgtagaaatgttttattagaacagtaacccagaggttcgttgaatccatttagaacaattcttaataacttaattgaactcaaaatagctcacatggtagttaggtcttttcatcttcctcttgaaagcctccttcaaagaaagaagagaaaaagaatgaagtttgaaatgacatcataaactcagtagaagggtcattgacaagtcagaaacaggggaaaaaaatcattaagcataaaagttttctttgaacaacaaaattgttggttgactcacttactcaattctgccacttctttggtggcataattcattagctctctcatgtactctgggcatgtattatatccttcctcctacacagagtctctccccaggccattagaatggacttcaaatttttcatgtaaactgtgtgtgactaatggtggctttaaatttcacttactctgtgacaaattagtgtttaagcagttatcaggacttgaaaactaaagaatgaagcatttgtgttttaattcagagtggcaaaagaaagtgcaatgatacattcactgattgactacaataatgtaggcaaattttatgtatctttatgcttcaaattagttatatgtcaagggagttattgctcttgcaaaaatgggagatttgtgttattcaatcattagccattggttgtagaaagatt

SEQ ID NO: 15125 - DNA, 7532 bp, Human
ccaagaattttcttctgctggaggaagctgccttgcccaaagttacacttctccatggcagcagcccacatcaaattacggggcaatgcagaggcacagattcccggtccacttgcctaagttcctgacaactctagccctagccttcccctgcgggatgggatgaagtcaccattattgcagtagctctctctcagctcacacttacaactgcctgcaggggtcccttctgaccagctgatagagtgggggaaggctgagcttgatacactaataaattggcatggcatttgggtacaagcccaaaatagaatgctgctgcagaatagctcactcaggagtcaccctaaagacagcagtgagggaaatcctcccaaaaggcaaccttgaggtagtgcacctggctgctcactcggtgcagaaagaaaagtagcccaaggtcaagcatatatggaattattgagcagtaatgtgtggcttggctggctggtccagggcctggaaggagaaagactggaagattagggacaagaaggtctggggtagaggaatgtgcagggagatatgggattgggcacaaagggcgaagatagttgtatcccatgtgaaggcccagtgtagggcatccaccattgaagaggcactaaacaaccaagtagaaaaaatgatttggtcatttgattccagtcagcgtctgccatcagccaccctactgctggcagtgagctcactaagagagcgttcatagtggtatggatgaaggctatgcattaacttctacttattaaggctaatccagctatttccactgtagaatgtccaatctgccagcaatagggaccaactctgagcccttttggtcccatgccttgagaagaccaatcagccacttagtggtaacatttgaggcagagcaggaacaccaaacagcaggcaggactctggacagccaccagcagaaggagggatttaggcccttaggaagatctgaaagggggaagaaagccacaactctctgtttttgctcaggtcagagccaattattgaggacctgcaatgtgccaaccctctgctctagggctcagggatagacatgaacaagaaataatacccagcccccagaagcctacaaaattccaggcaagtatcagttttattcaagacaagcccccaaacaccaacaatgatgatcacagaatttttttttttttttttttgcgacagggtcttgctctgttgcccaggctggagtgcagtggtgcaatcatggctcactgcaacctcgacctcctgagcttaagcgatcctctcacctcagcctcccaaatagctgggactacaggtatgcgccaccatgccgggctaatttttgtatttgttgtagagatggggtctcaccatgttacctaggctggtctctaactcctgagctcaagcaatccacctgcctcagcctcccaaagtcctgggattataggtgtgcaccacctcgcctggctgatcacagaattttgaatttgaactaagctttatgggttttaacacactttcacagattacttcacttgattccctcttctttaagattccttactatttaaattctggcttttagaactaaaacacacacacacacacacacaaaaacaccaccagtccctgagcagaattcattacttagtttaatgacttttgagaagtcaattaagcagagtaaactataaaataaaagcacagagacagaatttcgcccatccttttgctcaactaaaagtgtactctattcattttgatggcaacaacagctttagtgaattagaacaacccgaacctaccagaaagaatgagagtaaaccattcagccaaccccagtgacctgggcacggagagcagcgagcttgcaaatccccttactcaccaaaatgggcccttttgtgtgatttcctgtggaggcagcagtcagggctgctatacatacagtgacgttcctgcagtcccacacagcaaccagaaaacatctgctcacttccttcaaaatgggaaaggtaagtcctgggtaccggatgctcagccttggccctaatgcagtggcctcagtgggggccaatcactccatgctcccacatcttccatttttcagatcaccttctacgaggacagggccttccagggccgcagctacgaatgcaccactgactgccccaacctacaaccctatttcagccgctgcaactccatcagggtggagagcggctgctggatgatctatgagcgccccaactaccagggccaccagtacttcctgcggcgtggggagtaccctgactaccagcaatggatgggcctcagcgactccatccgctcctgctgcctcatccccccggtgagtgtggctctgtctttgccttccatctttttggaaataaaagctatttcatgatattctttttttttttttttttttttttgaggcggagtctcgctctgtcccccagggtggagtgcagtggcatgatctcggctcactgcaacttccgcctcccgggttcaagcaattcccctgcctcagcctcctgagtagttgggattacaggcatgcaccaccatgcccggccaatttttgtattcatagtagagacgaggttgcaccatgttgcccaggctgatctcgaactcctggcctcaagtgatccgcccgcctcggcctcccaaagtgctgggattacaggtgtgaactacggcatccggcctatttaatcacattattcttaaatcccagctactcgggcggctggggcaggagaattgcttgcttgaagccgggagatggaggttgcagtgagccgagatcgtgccactgcactccagcctggtgacagagtgagactccatctcaaaacgacaataacaacaacaacaacaacaacaacaaacttttgcttgctttgtcttacttttctatttgattattcctcctgagaagataggatcctgtcttctgatttctattctaatttaatggtcagtacctattagctcacttagaggtataaattagagaaaaggccaaatctgaaactaaagtttgagattccatattttctgggcagtgactgcagaattcttagaattgtggtgtgtgggaggcatgggatacagtgtcataaaaacagaagttaatgaaggtgatacttgctgctgagggaaataaataagttgagagcaggaggctagaaaggaagcttaaaagtcagataggttgaaatttgaactgaaggctgggtgcggtggctcacgcctgtaatcccagcactttgggaggccgaggtcaggaggtcaggagttcaagaccaccctggccaatatggtgaaaccccctctctactaaaaatacaaaaattagctgggcttggtggcacgcgcctgtagtctcagctacttgggaggctgaggcaggagaatcgcttgaacccgggaagggtaggttgcaatgagctgagatcatgccactgcactccagtctgggtgacagagcaagattccgtctcaaaaaaaaaaaaaaaagaaaagaaatttgaactgaaaattagccagatgtggtggtgcatgcctgtagttccagctactcaggaggctgaggtgggagggtcacttgagcccagaaggttgagggggctgtgacccatgatcatgccattgcactccagcctaggtgacagagggagaccctgtctcaagaaacaaatacatatatgtgtgtgtgtgtgtgtgcgtgtgcatataatagtgaaccccaaatatctgagacaggtctcagtcaatttagaaagtttattttgccaaggctgggcacagtggctcatgcctgtaatcccagcacttttgggaggccaaagcaggcagatcacctgaggtccggagtttgagaccagcctgaccaacatggagaaacctctactaaaaatacaaaattagctgggcgtggtggcgcgtgcctgtaatcccagctacttgggaggctgaggcaggagaattgcttgaacttgggtggcagaggttgtggtgagccgagatcacgccattgcactccagcctgggcaacaagagtgaaactccatctcaaaaaaaaaaaaaaacccagaaagaaggtttattttgccaaggttgaggatgcacccatgacacagcctcagaaagtcctgagacatgtgcccaaagtggtcaggggtacagtttgcttttatacattttagggagacatgagacatcaatcaatatgtataagttgtaaattggttcagtctggtaagacaggaagtaggggcttcctggttagacatggataagaaacagagctgggcacgtggctcacccctgtgatcccagcactttgggaggctgaggtgggtggatcgcctcaactcctgacagagtttaagaccagcctggccaacatagtcaaagcccgtctctactaaaaatacaaaatattagctaatcgtggtggtgggcgcctgtaatcccgctacccgggaggaatcacttgaacccagaaggtggaggttgcagtgagctgagattgcgccattaaaaaaacagtagataagagacaaaaggttctttgagcccttgatcagctttccactgaatacacaatttagtctggctcgatgactctgcatctttacataaacaataggggagaggaagcaatcagagatgcatttgtctcaggtgagcctcagagggatgactttgaatagaatgggagacaggtttgccctaagcagttcctggcttgacttttccctttagcttagtgattttgaggtcccaagatttattttcctttcactgtatatacataatatgacatttaactttccaatgactctcagttttctcctttgagaaaggctttctcaaataacaggcactaaagtgatgtgatattttattgtaagcaaatcttaattcccaaagccctagctctgcccatgaatcattagactcagcggtgggtgactggggagtgtgacagccccttaactttgcaacagggttgttctagaagcaaacttggcctgggagaacttctgggcaggtgtggccagggaggtgtagggactggagctttaatttccatctgtttttgtttgtttactcttgcgttttctgtctgccactccagcactctggcgcttacagaatgaagatctacgacagagatgaattgaggggacaaatgtcagagctcacagacgactgtctctctgttcaggaccgcttccacctcactgaaattcactccctcaatgtgctggagggcagctggatcctctatgagatgcccaactacagggggaggcagtatctgctgaggccgggggagtacaggaggtttcttgattggggggctccaaatgccaaagttggctctcttagacgagtcatggatttgtactgaagtatttacgttttccacttttctcctttaaaatctaataaaatatttagcttgtgtttctggcactagtagagccctgtctttctttcaatctattaagcatttataagtgataatggcactcagccaaacataataacatgttttcatgatgggaagcaatcttttataaggggaataatgcagagatattatttccagcactcttgtaatgactaaaacatgtaggctcaaataaaagctcagttcacttggactcaggccaattgtagttagtctcaccaggctagatttgcagctacggtggtgaattggtactttttgaaacacctccaagttatccctccaggttatccctattgtcttccctaatagtccaggccttagctgatgaggaaagttgttctcagcctctagactcctacctcagctccataaacaaacaaataaatgaactggtccactcttacctattgcactcctgtcctcctaacagtcaccatccctttcctctcacttccactgccaatatctcattccactatgagatttccagtccaaatagaattcactgtgttttcgctatatgtgctttgtggaataatttcaggacatttacaaaaaccacatgcgcacgggaagctcagcctcatgtcatttcagtagagagtaaaatattatgattacacataataatactaagtggccgggcgtggtggctcacacctgtaatcccagccctgtaaacctgcgtctccagggctcaagcgatcctcccacctcagcctcccaaatagctgggattacaggcgcacaccaccatgctcagctaattttttttatttctagtagagacagggtcttgccatgttgcccaggctggtctcaaactcctgagctcaagcgatcctcttgtctgggcctcccaaagtgccagaattacaggtgtgagccaccacacccagtcataaactcggtcatttgttttgattttgggtttttttttttttttttttttgagatggagtctcactctgtcacccaggcgggagttcagtggtgcaatctcagctcactgcaacctctgcctcccagttcaagcagttctcctgcttcagcctcccaagtagccagaactacaggcgtgtgccaccacgcccggctaatgtttgtatttttagtagagacagagtttcaccatgttggccaggctggtctcaaactcctgacctcaggtgatccacccacctcggcctcccaaagtgctgggattacaggagtgagccaccacacctggcctacactgggtcatttttgagagtgaaagtatatactattaataattacactgggacaagagacatgaaccaggactgttctaggcaaacttggatgcaagtttaccctactgtgtgtgtgtgtgtgtgtgctaaatattactacaaaagtgtcaaaaaggtttaaaatgttaaaaagtttatgttacaaagttacagtatgctaatgttagtttattattgaagaaagcaagcattttaaaaaaatgtgtagcctaagtttagcctactgtatgtatatgtatattagcctactgtatgtgtgtatatatagagaacacaaatacatataaagatttatttcctgaaaaacagtcagaatctaggattatttagtgttaactcttcctaaatcttgggtctttaacctttaaactcgcaacaatagtgatggcttcctggagctattaatcagagtcctctgtttgtcaacaataatatgtcaaacataattcagaaaaccaaaagcttcttaacgtgctgaattttacactattttcctagaagacataaaatcacatattttggctgggtgcagtggctcacgcctgtaatcccaacattttggaaggccaagacaggcggatcacttgaggccaggagtttgagaccagcctgaccaacatgccgaaaccccgtctctactaaatttaaatacaaaaattagctgcacgtggtgacacatgcctgtaatcccagctactacagaagctgaagcacgagaatcg

SEQ ID NO: 15126 - DNA, 18196 bp, Human
gacaatttttccacagactgggggtggggtggggatggtttcagggtggttcgagtgcagtacatttatcattagactctttttttttttttttttgagatagagtctcgctctgtcacccacactggagtgcagtggagccatcttggctcactacaacctctgctgcccaggttcaagtcattctcctgcctcagcctctcaagtagctgggattataggcatatgcgccaccacgcccagctaatttttgtatttttagtagagacggggtttcaccatattggccaggatggtctcgaactcctgacctcaagtgatcctcccccgcctcaacctcccaaagtgctggggttacaggcgtgaaccactgcacccggcccatttatcattagattctcataaggaatgagcaacctagatccctcgcatgcacagttcacaatagggttcacgctcctatgggagtctaatgctgccgctgcactcagcttctctggcttgccgctgctcaccttctgctgtgcagcccagttcctaacaggccacaaacggggagttggggacccctgatctagtaaacatctaggcagggttttggataatggagttagagttcctggggagaggtcaggctggccatgaaacatgggatgcctttgcatataggtggtgttgaaagccacaggacagtacggggtctcagggggtgagcataaagagaggcgacatcagatggccaaggccagaggcagaggaggatgggaaggaggggccagtggggcagggggaagctgtgaagccagggaaaaagggtgtttcgcggaaaaggatcaacctggaccagtgctgcccctaggcagggcaggatgaaacttaaccaccacggattccatggccccatggcctccaggccacaggggaccttgagaagagagatctcaggggacgggtgcggacaagagcccgcctggcatggcttcaagagataactgaaggaaagcaagtggagacgcgataaacagacaactccctggaggaattttactctcgagaggagaattaaagggtagtagctggagagggatgtggggtcaagagaaggtctttaacgacgagaactctcacggcggtttgtgcagaacagggtgggtgtgatgactgtggatggagaggggagaactgcagcgactctgtcctaggaggaggtgatgggccgggaccaccaagcgagtggagggtggacgccccttccctcaccccgacacccgcatgtgctcagtgtccgtgccgccggccctagtgcctgggctgaacgcggggccgggactctgaggacgcctcccaggcggcgcagtccgctctggccaaggtggagcgggacgcggcgcttccgacggtgcgcgggtcggctcggggttgcagggacatccggcgtccgctcctgccctgttttcctgccttcggcagagcgttgcgcaactctagctttaaacgcccctgtccccctcaacttgtctcccccagcccctctgatttacagattctgcagtccccgagggttgcgcctacgataccgacactcgcggcagccctgcgaggcgagtatgatcgtcccatttttcggagtagcaaactaaggttcagagactactatgtcccaggtcggtctggtttgaaggtccgctttcctctccctccgccagcgggcggtgcgagggactgggcgaggcagcgcttccctaaggaggcgacccgcagccccggccccctcccgactccgccccgttgcagggcccgggtcggcgaggcctctcagctctaagcccgacgggacttggtgattgggcaggacggaagagctgggtggggctttccaccagcggagaaagtctagtgggcgtggtcgcgacgagggcgtggcctggtgccccgcccccgtccgcgcgctcaaagtggagggtggctgtgggggcggggtcagaacactggcggccgatcccaacgaggctccctggagcccgacgcagagcagcgccctggccgggccaagcaggtatcgacgaccgcgcggggcgtcttgggctgcaccaggcgggcgcccggggcctgctgaggaccacaaagggcactgggggtcgtggtccaggctgtgcttcctcccgctggccctggcccctgcctccgcccccgcccccgccttcctgccgctaagccggctgcggcggggccgattggcgcctgcgccgcttcctgcggccggggccagtctaatgcatggggcccgggcgggggactaaggggaaactgagtcacgtcggtgtgggagcagttctgtgtgggaggcaccaccccccactgggctcggggaaggatccccctccaagctatgcttgagggtcccagcccccatctgtctccacaggggccgcaccccactcccgccttccccttcttcagcacccaggggtcccgccctggctcccagcagcctcgactggtcccggaatggctaggaggatccgctgcagccgcctccctcccctcccctcccctcccctcccctcccctcccctcccctcccctcccctccccctcgcgtcccaagcccccgtgtgctccctccgctggctctccgcacagtgtcagcttacacgccttatatagtccgagcaggctccagccgcggcctgcctgccgggacctgggggcgggggagaggagagccggcccctgactcacccggccgcccgaggctccaggctggcttggggggaggccgcgccagtttagtccctcggcccacccctggttgcaaagaacctcaagcctggattcaggcacccctcaccgttccagtcccaaggggaggggggctgctcctgtctttccaaagtgaggtccgccagccagcagcccaggccagcctgacaaaatacctgcctcctatggcttgggcgtgctcaggggctgcccgtgcctgcctggcccctgtccaaggctggtatcctgagctggcccggcctgcctgcctgcccgcccaccatgctggccactcaccttctcttctctcctctcaggagccggcatcatggattccttcaaagtagtgctggaggggccagcaccttggggcttccggctgcaagggggcaaggacttcaatgtgcccctctccatttcccgggtgagcctaggtttggggagggggctcccccagcggtctttcggtgcttaggtctccagagggtgatggggggagtcctaacaggagctggtcaggggccagcaggccaggagatgtctaggtccggagatgtagtggtacctgcctgccacaaggactcccaatgaggtggatactgggagggagcacccaggcttctccagccctgcactgtacccgatgctgttctcccaagctcctgtggccacctctgagggctggagggaggctcattgtgcaggatgggagcctaacatttcaggaggtatctaaacttgaggtggcaatgcttggagccaggccccaggcaggacactgtgactataggatttcacttcagcctcactgccgcccagggaatagcaatcctcatcccgtttttccagatgagagaagaactcatggagaggtggcggggctcgctcatcgagtccatggtgaagcagggattggaattgaggcacagcatggcgtacattttttgtgggtagaaggggtctctccccagcctatgtaaggacccacatccactgttcccattcaggatgtggtggcctttgaccccaagcagaagtgtaggacagggctccattctaggggcttaacttcagcttccaagagcctgccctggtgtgggtggagctggaggctggctcctccctgtagcagggggattgccttataagcccaagaatgcagccccacgctgggatggccaacagtggctgcggtctgcagagctgaaaagggctggcctaggcctggccccctgaaccccactggtgggcctctcagctggtcaccaggctgcagctccagctgtatggtccagttgtgagacacaacaaattgcctgcccagagtgggtgaggccagcctgtcggctggcatctctgactggcctgggggtcaggagggggtggggacttcctgcccctatatccgcctgccccgagagacccacccaggcgccgggtgggcaggcagctgttgtcaggaagcccaaggcaagcccagcctggaggggcccagagggtcgtggcctgaggaggggctcaagctggagtctgtctgtaggagctgggcgtgggggttagggtgggcaggccagcagtgctcttctcaggggtcctttgatggcattctcctggaacctgccccgccagcagggtagtgaggcagtggttgccctatgacacacgtcccactacatagccctcacacagccctgaaacctacctgacgtcctgctccctgggaaagtgctggcccagtgtgtctggggagcctgaacctcagtttcttccctgatggagatgactttcagatatggcctgttgggggcactccgggctccagctccctggtcagcatccctggcatgtgggcggggccactagctgatcccagccctggagttggacctgggcccacatgggtgggtgaggtgggcttttctgagttaggccagccccctccccctcccctgaccccagaatggagggaggtgggaggggcaagggctggctgtgggcccaggcctgggagatgaggtaacgtctgggactggggggctgggctgctcaggctgactcacccccacctcatgcagggtccagccccctggctttttccctccttggttcctctggccttaccctgcccctggcttgagcccctccctgcctctctccagccacccgcccagcgctgtcttctgctctcctgctgccctccccacgctctgaacacccctcatcctctgtgcttcctgccctcctcactctgggaagggaagccgtccccgccccccaccccctctccaggagccagctagctgcaccccaagacccccacctcgggctcagcccacagctcccaggagccagccctgtgggcagggagtggctgggccaggtttcccttctactgactcaccatgaccttgagtaagtcacttcccctctggggtgtcacttccccatacacagtataaggggttgatttagttggattgaactaaaggtgagggagtggctcagggtgtctccaggtgggctgacccctcagttgggcccccatgctcagcagaggtggcccacagtggtggagccttagggtcagagacacttcctggctctgcctcttactagctgggtgacttgaggcaagttgtttaacctctctgtgtacatttgcaagtgcaaaatgggtaaaatcccagattactccacaaggttgttggaagattcagtgtcaatatgtagcatagttggtgctcaataaactgaagcaagtcttcttatctagcgagtgaggaaggggccgccgagctctcttagccttctgacctcctacgcaagcaagaggtcatgttgagcccagctcgcctttcttttcccagtgctgtcaagctctgtgcctggctgccctgccctctgacatctctctgaaacctcttgcctcccctctccctgcctcagctcagtctgtgcactgacccacctgaggagcctcctggggccactggcagcctggacccccccagatcccccccacccagtgaaattgtcttccagcactgcctcacaaaagcctacttgatgcagtgccaggcctcttgccagatggctgggtggtcccttaggcttggacccagtcaagctgccctgcctgtgttgctggggctgggctagaggcctggaaggggtttatcagggtcaccctctcagggcctgggagatacccaatcccagacattaaaactgccagtagcccctctaccttcaaagccaagtcctggtcccttcccctggcattcaaagccatcgtaagtgaactctcacccgctaggcagcacacgccattctcctttaccgaggcccaccgcttcctcaaagtcattcctgatggtctcagctcatgctggtggcagccatttctcccagcctactgtctctactcattgccacaggaaccagggactcccagctcaagagcctgaaggattggggtcaggggaaattggcagtcgagggcttgggagtgacagccatgtatggcctacgaagtcccagctgtcaacttaggtcccattcaggcagtgttcacagggaaccgggagataacagggcctgttcctggctctcaaagggtcccagcagacccctatagatggcccccgacagggtgctggggggtgagaggtccataagagcccccggtggtttcggggaggaagctgccccctgcatgggccagagggcatatctggtaggtggagtggcctgggcaggaggccagcaggagcctcaaaaggcaatggtcctcctgaaacacttgggctttagcctgagcgtggctgtttgtggacatcatagcaatttctggactgtgggggagggtggtggcggtgaatagataagcatcgtgactggggaagctcaggtgagcaccacctgagggagagggtctggcagtgaataaataagcagtgtgactgggaaattgtgaagctcaggtgagcgccaccacctcctgggttgctttagtgtccagcagctgcctagaactatgttgaatgaagagctctctgggttctggaagtgggacagctttgggtggggcagtgttaccaccgtcagcctggcttgggtctgcagggtccagggcctcggtcactttgcttctctctccacagctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcaggtatgcgggtggacatggatgggtgcgcccgcgctggcagtggggatccctgcgggcccggcccgctgtcacgctttccttctcctccagggcccagccggttcagagcaaaccgcagaaggtacgaggctggccgggacatccgggcggtgggcggtgtgggcttggacggccaggcctgctcgccctcctggcacattctcggtaccccaatccctggccgggagtggagggcagaaaccggagctaaggcgggtctagggccctggagttgagccaggggctgctgcacggtcctggcaccacgcatgtccgcctgtctgtccgcctgtctgtccgcctgctgcctcccgccgccggcgctgcgtgctcgcccgcactcggtcagccctcggtcctgcgtggactgagatcgccactcccaaatgggccccttgaaacctgagtcgtcctctccccgtagcctccaaatagatgtagggggtggggtgggggtggggggctggagctgccgctgtcctctgctgcaggcgccccacttccacccaggcccccaccttaccctgcccgcccgccctgcccggctgtgtctctgcccaggcctccgcccccgccgcggaccctccgcggtacacctttgcacccagcgtctccctcaacaagacggcccggccctttggggcgcccccgcccgctgacagcgccccgcagcagaatgggtacgtcggcccctgcccgcccgcgcccacgccatcaggcccactgtggccccacgcccgctgcccgctgctgctcagtctgtgctgcgccccagcccggcggaaccgtgcggcagcgccccctggcggccggggtggggctgcaggcacagggcccctcccgaggctgtggcgccttgcagggcaccgccctggggaggggtctctgaatgacgccgcgccccctgctggcggctgggggttgggttgtggtgtcgggccagctgagccccagacactcagtgccgccttgtccccggctgttctgacccctccccgtctttcttcctctcctgtgtctgtccctttgtccctttatctgtctgtctgtcttatttccttcacaggtgcagacccctgacaagtcagtgagcccccctctgcctgtgcctttcttcttccttttggcactctgggtggcggcccctccccaccctggctgccctcctctccacttcgccctcctgtcctctcacctacccgcccagcagggctcctggcctcacccttacccactccctcccatcactgtaacccaaacccacatgcaccaaatcctgggaggggctgcccccaccgcccacccccagtgtggggttctgagccacaccctccccacagacagccgctccgaccgctggtcccagatgccagcaagcagcggctgatggagaacacagaggactggcggccgcggccggggacaggccagtcgcgttccttccgcatccttgcccacctcacaggcaccgagttcagtaagtgccagcccagggcagggggtactttcctcgcccccagcccaggcgtgatccctgaccctgtgtcttttttggtcaatgcctgcctctgccctctcagtgcaagacccggatgaggagcacctgaagaaatcaaggtacagggacgggcaccagcccctctcccacctcctgcctcttccattccagctactgccctgtgtctactcctgaggctcccagctggggctctcaattctcccttccttccttccttccttccttccttccttccttccttccttcccttcctccttccttccttctttcatttcttccctccctccttccttccctcctccctccctgcctcccttccatctctccttccttccacttcttcctccctctctctctgcccctcagggaaaagtatgtcctggagctgcagagcccacgctacacccgcctccgggactggcaccaccagcgctctgcccacgtgctcaacgtgcagtcgtagcccggccctctccagccggctgccctctctgcctccctctttctgttcctcctgcccagggcacccccttagtgcctccagcttctgcctacctcaccccccctttcgtgcccctggcctgagcctcctgctggcctggccctggccgcccacctgggttcatctgacactgccttccctctttgccctgtggtactgctgtctgccaggtctgtgctgccttgggcatggaataaacattctcagccctgcttgctctgcctgtcttctatctttgtggacctggtttgcatttggggtgtgggggtgtttcgtggttcggactgtttgggccctgccgtcctcgttttcagtgggagggggtacctggcaaaggggccctgccctgccatcacagatggcttcctggcatgaggggagccccaggagctgcctcagaagcgggagccctgcctcgtctcccagctagagaccgcacaccagctaactggacattgctaggagaagctgcccttcccatccctaccccagtgggacctggaatccaactcggcagtttccacgcccccagtcatctcccgtggggccagcaggacccaggttggggggtggggccatgtcaggaagctcagccatgcagggccttgaatggcagatcttgcagccaggtgcccaggacagaagccccagccccagcctcatctacaccccaggagccctggcctggtgagagggagtgggctcgggcctgggcaagggtgggcagcctccaggggcatgggggtggtgggcttctctcagctgcctggggctccacccccgtcctttggggtccctgggcacccctttagagtcactttccccggcaggccctaccgcccccagccctaccagccgcccgccctgggctgtggaccctgcgtttgccgagcgctatgccccggacaaaacgagcacagtgctgacccggcacagccagccagccacgcccacgccgctgcagagccgcacctccattgtgcaggcagctgccggaggggtgccaggagggggcagcaacaacggcaagactcccgtgtgtcaccagtgccacaaggtcatccggtgggtggcctgttcctgtccgaccctggctttcccatcctgcagcccagccccacctgtctgcccacctgtcttgcctcagctgcgactggggggaataaggattcagttctcagctggagtaggagtagggacctgggctgggtcctcccattcttaatcccacgctacctaccccagcccacccacaacaactgctagcagcatctgccgtggcgaaatagccgaagggccaaccataggctgaagctgcacccctacctttgctgctctctgggcaaagaggggcctgccccctcccagcgcgtctgcccctccctcctgctctctgtctccctctgctctcagagcatacaggcctggagccactccctctgtgcactgccccgtggggccaagcagcatcaaacaccccccagcatcagcgtgccggattctagagccttcctaattcgcaggcctggcctgctctcatctctgtcagctcttttttttttttttttgaaacagagtctcactgtgttgcccacgttggcgtgcagtggcgcgatctcggctcactgcaacctctgcctcctgggttcaagagattctcctgcctcagcctcctgagtagctgggattacaggcacccgccaccatgcctggctaattttgtatttttagtagagacggggttttaccatgttggccaggctggtctcaaactcctcacctcaggtgatctcaggcctgccttggcctcccaaagtgctgggactacaggtgtgagccactgtgcccagccgactctatcagctcttgccaggtagaacaggcaggccagcaggacagggcagctccagggtttgcccaggggcggctcagcttttatgaggctccagtcgtcagcccttcctcccggggtcctccctgctctaaagctgcctctcctgtcaccagcagttcagtgtggcggactggctctgtaagcttcacggctgccacggtcacttcccaagcctgtcttctatcctatgtggaaaatggggagaatgaactgtccctcccaaggcctcctggtgggtggtcagtcaacctgaagggggccaagacccccacctctctgcgtgtgctccctctgaccgctctcgcctccctgcaggggccgctacctggtggcgctgggccacgcgtaccacccggaggagtttgtgtgtagccagtgtgggaaggtcctggaagagggtggcttctttgaggagaagggcgccatcttctgcccaccatgctatgacgtgcgctatgcacccagctgtgccaagtgcaagaagaagattacaggcgtgagtagggctggctggcggggaggtggtcccaagcctgtcagtgggaacgagggctgctgggaaacccacagtccaggtctctccccgagtgagccctccgggtccttaccagcgtaataaatgggctgctgtactggcctcaccctgcattagtcaggatgctcttaacaaatgaccatgttcctgctcagaaaccgcccaaggctgcaaagagcaggaggaccaagccaggagaagccctgggccctcctgactcccactttgggctctccctgccctggtgaaatgacagaacggccaacttgacacgctgaagctgctctgtctcatgcgtcctcctcatttctggatccagagccagggctgccaggagtagccagagagctctgtgtggtgatgttcatattagtgaggtttaccttgaccacgagcagtgggaaactcaaaataatggtggcttatttctcatctaaaaacatcccggggtgggtggtctgggactgatctggtggacccaggctccgccttgttgcttgactgttggcagcacctgcttacttaccactcatggtgcaagatgacacttcagcctccgccaaaatgctcaccttccagccagcaggaagtcggaaggagaagaaaggggacagagccccatggcgtccatccttagaggatgctgccacctgaacctctgctttcatcctgttggtcagaacccagtcacatgaccacacccagtggcaacggaggctgggaaatatagtctttattttgggcacccatgtgtccagcaaaactgggggttccatcagtcggcaagaacgggagagtggccgatgcagtggctgatgcttgtatcccagcactttgggaggtcgaggtgggcagatcacctgaggtcaggagttcaagaccagcctggccaatatggtgaaaccctgtctctactaaaaataaaaaaattagctgggtgtgctggcgcacctgtagtcccagctacttgggaggctgaggcaggagaatcgcttgatcttgagaggtggaggttgcagtgagccaagattgtgccactgccttccagcctgggagacagcaaaaaaaaaaaaaaaaaaaaaaaaaaaaaagggccaggcacggtggctcacacctgtaatcccagcactttgggaggccgagatgggcggatcacgaggtcaggagattgagaccatcctggctaacacggtgaaaccccatctctactaaaaatacaaaaaaattggccgggcatggtggagtagtcccagctactcgggaggctgaggcaggagaatggcgtgaacctgggaggcagagcttgcagtgagccgagatcgcgccactgcactccagcctgggcgacagagcgagactcttgtctcaaaaagaaaaaaagaaagagaaatctgcctcccagccttgggctcctgccccaccagcccacacccctggtagagccccctctcccaccagctcaaagcccaagttccttcactgtgaccttgtctgctcctctaaaacaggcaacaccagacagtgagaagagccagccagacatgggcagaaaacctatttctgtgatctactggctgtgtgagcaggggctagttgctctctctgggcctcactgaagagaagggtggcactatgctagggccggcacggttgcaaggtagatgtaagatggggtacaggtgttgtggagggcagaaatgcaccatccgaaggctacatgtcccccacacttatgtcttgcttggcccacactgtttcattttaaaatcagtagcaaacaatttaaaaaatcagaagatttgcctgcatgatgcagtggctcatgcctgtaatcccagcactttgggaggccaaggtgggaggattgcttgagcccaggagttcaagaccagcatgggcaccatagcaagacccctgtttctacaaaaaaaaaaaaattagaaaattagccaagtgtggtggcatgcacctgtggtcccagctacttgggaggcagagggaaagtgagatctcctgctttttatttctttatgtataatgatagggtcttgctctgttgcccaggctggagtgcagtggcatgatcactgctcactgcagccttgatctcctgggctcagaggatcctcccacctcagcctcccaaatagctaggactagaggtgcccaccagcatgctcagcagatttttaaatctttttgtagagatgaggttttgctatgttgcccaggctggtctcgaactcctggcctcgagcgatcctcccaccttggcctcccaaagcactgggattacagacgtgagccactgcgcccagcagatttctctttaacacctagatttcagcctgagccaggcaggcattcctgaatgaaccagtagtactgctcccagaagaagaggtcctcctccgtgtgacacagtccccacttggcccttgcagggattggatctgggatccctggatttaaactcagggccatcctcataacagcctcacaaggctgggattagcttcccagttcacaagggaagaaaccaagacttgagaaggtcaaggtctggccagacccacacatcttggaccctcataccgcctcgaggccccatgctgccctctgcctgctccagatgtgaatactgctggccctggctggccccggctggccccgagggtcctagggatgaacagcccagcccagggagagctcagccccttgtgcctctgccccttcccacctcctgtggaggccagtcgactcacccacaaagggccaggcactgtggggatagatcagctaacaaaacagttgatgcttcctgcccttctgggccttacattttggctggaagaagaggggagaggcagactgtaagcaataagcgcaataagtaggttgcctggaagtaatgttagatcacgttacggaaaacaggaaagagcagagcaacaagtgctggggtgcgtggtgcagggaaggcagctggctgctgctggtgtggtcagagtgggccctcatggagaagactgcattcgagcagaaacttgaagggggtgaggggtgagcctagagatatctggggcagagcagtccaggcagaggggacagccggtgtcaagcccaggacaggagtgtgcctggtgtgccagtttcaggcaagaggccagtgtgcagaggcaaggtgagaacgcaagggagagcagtggcggagacgggtgggaacgaggtcagacctgctggcctccagcctctgcatggggcttggctcttgctgggagcaatgggaagcagtacacagtttcatgcagggggagaaggcctgtcttgggttgcaggggcacgctgtggcagctgggatcagagagaggagcttgtaggccagttgttatgtggtcccacgggccagatggccatggcttacctcacttcagggaggctgtgagaagcactcagaatctggatgtgccttgggggtgggccccactggatttcctggtggacctggtgtggggtgtgagaggagggtgtgtttggctgcagcagacaggagaatggagttgccatccgcgtgatggggatggctgtgggaggagaggtttggggtgagggaatcaggaactgagtgctggacatggcaagtctgaaggcgcagtggtcgtccactcagagaccttggagttggagatggaggtgtgggagtcctgaacagttagatgtagtgtttaccgcgagaaggaacagggcttgcggccagccctcctgtgttcccgtgacccagggcagggcaggaggggcctgagcctgccgagtgactgggacctccttccaggagatcatgcacgccctgaagatgacctggcacgtgcactgctttacctgtgctgcctgcaagacgcccatccggaacagggccttctacatggaggagggcgtgccctattgcgagcgaggtacccactggccagtgagggtgaggagggatggtgcatggggcaggcatgaatccaggtcctctttctctctgcccccattctcagactatgagaagatgtttggcacgaaatgccatggctgtgacttcaagatcgacgctggggaccgcttcctggaggccctgggcttcagctggcatgacacctgcttcgtctgtgcggtgagagccccgcccctcgaactgagccccaagcccaccggccctctgttcattccccaggagatgcaggagaagttgggaaggggcctctcctgctgcccccaaccccatgtgactgggcctttgctgtccttagatatgtcagatcaacctggaaggaaagaccttctactccaagaaggacaggcctctctgcaagagccatgccttctctcatgtgtgagccccttctgcccacagctgccgcggtggcccctagcctgaggggcctggagtcgtggccctgcatttctgggtagggctggcaatggttgccttaaccctggctcctggcccgagcctggggctccctgggccctgccccacccaccttatcctcccaccccactccctccaccaccacagcacaccggtgctggccacaccagccccctttcacctccagtgccacaataaacctgtacccagctgtgtcttgtgtgcccttcccctgtgcatccggaggggcagaatttgaggcacgtggcagggtggagagtaagatggttttcttgggctggccatctgggtggtcctcgtgatgcagacatggcgggctcatggttagtggaggaggtacaggcgagaccccatgtgccaggcccggtgcccacagacatgaggggagccactggtctggcctggcttggaggttagagaagggtagttaggaagggtagttagcatggtggctcatgcctgtgatcccagcactttggaaggccaaggtgggcagatcgcttgaggtcaggagttcgagacctcatggccaacacggtgaaacagcgtctctagtaaaaatacaaaaattagccgagtgtggtggggcatgcctgtaatcccagccactcaggaggctgaggcgggaaaatcacttgaacctgggaagtggaggttgcagtgagctgagatcacaccactgcgcgcgagcctgggtggcagatggcagagcgagaccctgcttcaaaaaaaaaaaaaaaaaaaaaaaaaagaagggtagttgtagttgggggtggatctgcagagatatggtgtggaaaacagcaatggccacagcaaagtcctggaggggccagctgccgtccaaacagaagaaggcagggctggagagggtagcccttaggtcctgggaagccacgagtgccaggcagtagagctggggctgtctcttgaggttagggcagggcaaggcacagcagagtttgaaataggtttgtgttgtattgcagaaaagaggccccagaacactgagggagtgcaggagggaggctgggaggaggagttgcagcagggcctaggggcgggggccaggcaagggaggggcagagagtaatatggcagagatgggacccagtggcaggtccgggggatgagggatggagagaaggacaggagcgttgccaggcatctggcctataccagacatgctcacgctgtctcccgcgaacctcctagcaaccttgcgccgttgtctgcaatcacttatttcattttttcttttttaactttaattttttttgtttttaagagacaggatctccctaggttgcccgggctggtttcaaactcctgggctcaagcaattcttcctccttagccccaaagtgctggcattacaggtgtgagccaccatgcctggcccacttattttctagatgaggcacagaaagattgggagacttgaccaaggtcacgctgtcattgagccatgagccagactagaatccaggcctgaagctgggtgcgctgtcccaggactggctggcactgagtaccatttgccagcgagcatctctctgggaagctgacttctgcccggtacctggaggactgtagaccttggtggtggcgccgtcactctggggcttcctgcctcccactgatgcccgcaccaccctagagggactgtcatctctcctgtcccaagcctggactggaaagactgaagagaagccttaagtaggccaggacagctcagtgtgccatggctgcccgtccttcagtggtccctggcatgaggacctgcaacacatctgttagtcttctcaacaggcccttggcccggtcccctttaagagacgagaagggctgggcacggggactcacacctctaatcccagcactttggaaggctgaggctggagaagggctccagcttaggagttcaggaccagcctgggcaacatggtgagaccctgttttgttttgttttttgtttttttgagatggagtcttgctctgtcgcccaggctggagtgcagtggtgcaatctcagctcactgtaacctccagctcccaggttcaagcgattcccctgcctcagcctcccaagtagctgggactacaggcttgcgccaccacgcccagctaatttttttgtatgttagtagagacaaggtttcaccatgttagccaggatggtctcgatctcctg

SEQ ID NO: 15127 - DNA, 142783 bp, Human
  misc_feature (1)...(142783): n = A,T,C or G
acttaaccataaaagtgatcagagaaaaaaatgtaatccgtagcagcaggaattaatgtgcttctttctaccagaggtcacgttaaggaaaagttgcacataagagaaatgaaaggtgacactgtaattaacccacaaacaatgattcttctgagaaagaggggagggtttcggtgttccagtgttcatggaaggaagattttttatctcttcccaaccagtttatgaatgacataggatacttagaaggattcacatttcacccacttcccctgagaacatgtttatccttgcaatgaaaatcattgcccaagccccagctacgagtcgcccttttgcacccttttccacgaataatcttcccaaaatgtctgcttgtagaagcaagatttggaatttcacggaaaactacagagagacacagagcaatgcacaccccctggtaagccagagagagacaaagagaagagagaggaaaaccgaaagaagatacatctaacggaccaacaaaataaaacaaatccccagcaaagcaaagtgaaaacaatgatttaaaaaacacataaagacgtgtttgtaattacccgtccaggttacatgttcgccgcttccaggcagagaaacggctggttgaagttttgtgcccgtctgactgtgatgggagggttgtatttgaagctctgggcacgtagagatggaatgagaaggaggctgagctggaagaaacaccaaggggggagggaaggggggagagagagagagagagagagagagaaagagagagagagagagagagagagagagagagagagagagcgcgagctatctctagctacgccttcctctaagctccgggagcccaggagagcgctcattttaggatttgggagaggggtaaaaagaggaaaggcggcccccgctctgcgctggccttgctgccccggggagggaggactctggccagcgcccccctcctggcgggcggccctgggagccagccggggagcgcgcggagcgggcggcgcagggagctgtccggttcagcaccacccgtaatgcagtaggtgggagcgcctccgcgggcgcccagccggtagcgagtggggggcaggcgcgcggcccaccctgcagcaagacgccggctccctcgtttccaggagctttgcagatagggggagggaaatccgcctcgattctccaggagaaaccccctctctcccccacttcgccaacactacccccgccaccaacaacaataaccgccgccgctgctcgtcctgctgccgccgccgccgccgcgcctgcccgccctgccgccgccgccgccgccgccgccgctgcccgggcaaaaccatggaaagcgagacccccgcacctgtgcagctgagctcaagggcttacagaatactgggaagtctggtctgaaacgaaagcgccgagaccccccaaggaagagaactggcgaagcaaaggattttcatggcgcaggccgcagagccgagaacgaagaccgaaggttgcatctcggctctcacagtctctaactgtctaggtcccgaccatgagaaatggtgttgagaattcggctgttccctggttcactgtggaagccatctccaaattaactatcacatatggaaactggagaccagaattttagaaaaagagattaaggcatctcacttgggggggtggggggtgtctttttattttttttttccttttctttttaaaaaaaaaacactgcaactggaacagtttctgatctcaaaaggcaagcctcttcccgtgtgatctttataatttacactcttttccgtgagctttcttacctccctttttttataactctccatattctctattcatacatatatccattatattagtagtggaataatttttatttttatttattttttttggctttagtacttgcaccctcacacacactctcccgagaaccagaagtcggttgggtgtttatataatgaagaattatggggctgtttgatcgaggtgttcaaatgcttttaaccaccgttggtgctttcgctgccttcagcctgatgaccatagctgtgggaaccgactattggctctactccagaggggtttgcaagaccaaaagtgtcagtgagaatgaaaccagcaaaaagaacgaggaagttatgacccattccggattatggagaacctgctgcctagaaggtacttgacttcccatctcctcccccctctccaccccacccctcccctttcactcccccctccccaccctcctccaaataagtcccctttacattccaccattttcttagttcactccttccaccaccaatcaaggttggttgggttagtttcagaggaaagaaaatcaataagcaaaacccatactctactccctcgcctccgccaccccctcatcccctcaaacatcctcattggaataatctatgacatggtgaaaacgacaagagattgtctctaaaagtcaaaggtgttctgcctgctttggagtcattaggatttaccatccgatttagcattgccatctatgagagggtaaaataattgcttctgtgtatgctgtttctcttttcgcaatgaagaattcaaaaatgctcttcccttttccctcctcttctccttactccccaaaagtcctagacacaccaccatctgcaaatctccttatttaaaaaagaatatgttgtttctaagaatccttatttggtaaatcctaattattccaggatctcaagctgagttcaagagcatttcgtaatgtctatgagccacacatatcactcgaggtggctggctgcgtgtgtgtatttgtgtattttaacgtttacaaagtctaaaaatacatacgtctctcacaggaaacaagcctaagttctaataaacagcaattcacttgcgggttaggcttccacagagtgacatgtctgtcagccagaagctagtagagtcagcattgcagccggcttgagaatcagacattgtgcaggcaggcagggagggagggaggggagggcatggggaggttgaggggggagtgggggtgtcagctctttgccttgatcttgcggagtgttgaggcatgtgtgtctgtgctgtgggcacaggagccgccacggtgtaaaggctgggggatcacgctatggatgaaggcatgtacttctgggacacattaataagcacagaaaaaaaaactcctgtgggtcatccaacctgcatttggcaacagactttagtatgagggactgcatttgaatggctatatatgtctgtgtgtgcaagctacagccacccatagatagacgtgcacagagagatacatatgcttccatgtgggggaaaaaaagaggcttatgtgttttgcttctgttatgaaccaatactgggggccgtttgaggcagcgtcgggaagcaaggactgcaggattgtttgttaagctcgacatgggatggtgatgcagggagttgagactaggagatgggggagaagagagggaaatggatgggtgagagagaaactgatgtggccccagggtctaacccaaactgagcaaaagccacactttcggaaatgattacatctgggaaagagcacaaatcccatgcccccctcccaacattcttggtgcaaacggttgagtgatggctgaacatgttttgaatagctaagtgacttcattgagcgatggtctatttgacgcatactgcatttggtgccctttctcaatccaaaccgctgtctttaacatattctgcagaggagctctatgctgaatactatatgctcttccccagccagaaaatcaatatcaagaaattaatagggactgttttaaacacatgcacacacacgccccctccttaaaaaaatgaaaagcctttcatacagctagtcattaacagtggaaagacttccatttaattaaacatttatgacagacttttattccgaaagagaagaaaagcaaagtgaatgaggaccgctttagggaaatgatcatagtggcaatttgctttccttggattttagttagatggatggagggagataggtagccaagagactagaggagagacaagacattgttttaccataaatacacccagaaatgggtgggttggcataaatatacttttctaaatctgtgttttatttccaaattcttaatattgtgatcttttaaatattgtgtaattcccagaaggcaaacagactagaggtagctttgtatcactcgtgcattaaaaaggcttaagtattttgattaaaattccatctgtttgatgtccacacccccaaatgtgctgcccaccccctttaactttctctccaagctgcacactccctctctccctgagttgtctgtaaagggttagaattgcaacacttcccaaggattgtgcgatgcgcacaggcactgtgggttgggccattctccccagcggggcctcactacccccgggcagtactgtggggccctgccaggctctcctcagggatgatactccctttccacttgtagccatggccagggcaggaagggctggagctccgggcccgcttttgaccgggcctttaatttccaaagcctctgtcaattggagctttgcaggcctgggaccaccttaggaagttgggccttggcgacttaggaagtagtttggagattgtaagcctcttattttcaaagactgcactgatctccaaaggctgtaagttcagttgtttctggaagttggcgtagacagtccttgggggctgtcagtgtgcttgcttttatgagcactcagaatggggtcgctctctatggagatcaagttgtcagtgcttgaggttcccccaacttgtgtttcttttgtgtgaaaaattggactttcaaaaaagatccccccaccccccaccccttaaccacttgatctgtgttttctgcccaatctggagaaattgcgaacagatttcacatcttctttctaagatgccgctaatgactccagatgaaaaacaaccctgtcttcctctgatctcttttgctgtctggttttcattagggctttttgtctcctgaggtgattattttcattcacctcttgatgaaaataagaatagaaaaaaaaaatgtccttgcctctaaggctgcttttgaaattaactagtctgctgaagaatgagaagatacatgaccacctgttagagacaggcacagggggagagggagaagggccagggaaaaaaccaccacccttattttcttcctctgcagactgaaaagtctgtgtgtgtgtgtgtgtgtgtgtgtgtgtgtgtgtgtgtgaacttgaaatccccagcaggctggtgtccttagggggattcgaggagcgtgggtgggagatgacagtgtgtatgtggatacaggtaggtggagagagacagaagttcatgaacttttcaagaaagctgaattaagagtctctgcatggaaagatgaattggccctctcagagaagagttcaatgaaatctacaacaagatgcgaaaacagcttgttcaagcaaggtgtctctaggctgcctggtagcttgctgctcaggatattagcctctgttgtcacctaaaggaaacatcgtctccagggacagcaagaaattcactcttggtgcttattctctcctatgccttcctcccctctgtcttggctccatggctcccccaaaggatttccagaccttcagaggtgaagccaacagtgggcataatgtggcctgtagaggaagcagactccgtgttttctctccccctctgtccgttttgccttactgtgaggcagaacagaaatcttactctctgtccaggctgtcaaattccctctgctgaatatctgagctcctcatccatcagtggcttctcctttcttgcccccaccaggctgcttgctcacaggggctctgccagccactctacatccttgttctctttgagcaagaagtgtctctctcaatggtcccaaatcttttccaagtcatgatggcctgcgaggtgatacagtgctccacgctcggctcagccatggctctcttattctgcaggaaaaaaaaaggattcatcttttattttaggaaagtcaatagcctttcccagacacgcttgccttctagcatgggtgggctgaatctggaaggtactaacaggccttcacactgtgcaagtattgctccataattcccaagataatttgactttctttaggtactttgcacacaggaagcgcataagaaatatttatcaatggattgatgcagaaattcttaaaattactgagatgaatgcaaacatcatgaggatatgtgacaaccaagtgatcgagagagagagaaagagggaggagagtggggagagagggcgaagaagagagggagagaaaggagagagggagagaagggggtgcggaagtcagaatgatttgtttgttcttcctggaacttctttttttataagaataataatgagtcatgaatccactattataagataagtgaattcaaaaggagtcagtcattgaggctgcacagctcctaattggctacagtgaaggcaaattattcaaggaaaggtaaagaaaaatgatccatgcacacagcctctataggaaagaaaaaaaatatccaattgattttcttcccttttctgcttctaaagtataccaaagttcactgtgatcttaatattccccagaacagacacctctgagcagagagcaggccttagaatggcccacccctgtttagctccagcagaaccttctactctttcacaaacctcccatccaattcaaagaaccctgacaactttccctcaggcttgggttctaaccagcagcttttccatacagccaggccttgcattcctagccattctcaccgtgttagccaaacccggctcctctacctggagtcctggtcagttcacaccacactccctgcccttgcttcctctttccaggtgagctgaatgaggcacacaggaatgaacaacacaccaaagtcacatggcaggcagtggcagagccagaacttgaatccaggccccttatgactcatcgggctacattgtccccctatcatgtgccctctgcaagcctccagagtgctctgggcagtagacccgagccacggtggcctcccacttatatccactaataagcactgttacatctggtctgtgtcttgttgagcatccctcactgagcactcaacctgagcatctcaagaagcctgagttccaacccagtgactcccctgcatacccctccctcctagctgccatcttgagctgctttgcacctttcagggtgacgacgactgtgccctggtccacgccccctgtgagctgagtagctgagtctaaggaaatgcagcagtcaatttctaatgctgaacttcaggccaaactcaccatgtgcctctattttgtcctttcattttggagctgtccccagtgtaaatgatccatgggtttatgttttcaagcattttcagaaaatagcaaatttacatcctacgtaactcacagaagttttcagatgaagtttttgtggtctcgttgaaagaattgatgccacacagacctgggttcacttcctgcactgcagccttgtgtgatctggggcaagttactcaacccctctaaccctcagcttccttatctggaaaaaaaggaggcataatctcctcctcgaagggcagttgctggcttagggattaaatgaatggatgtctgtcctcccttttctcagatcaccttatttgaaattgcaatcaacaacctccacctgcactcctcatccatccccctttgctgttttatttttacagagtacttaccaccttgtagcacgctctgtcctccactcattatatgtggtgtctgtctctcaccactagactgtcagctccatgagggcagggattttcatctgttctgctcactgctgtgcccacagcaatcatgacagtgcaagaagtcaatctaccttgttaatgaatgaacccatgactactgcctgctacagtgtgggtgttcagaaagggtggtcccttcacactgccgaaggattattcttcctgcatggtgagctgtggtggccaaagcattaatttttttaacattctaaaaaataaataatgaactcaatacagaggaaggagtgagagaaaagagggagggatggaaggagggagagagagatggagagaaagagagagaggaagagagactgaacgcataaaggacaatagtaaaaaagataatggaaacaaaaagtgcttggagagaaaacaaatgcctgagaagaaagcgccgggggtgcaagtcctctaaatagatcctggccacacattcctccctccacaccatctaaagtgtctgtcacagatcctgggggagagcttcccttgagtgttcgctttcaggttgaggggaggagaagatataaatccagactgataatgcaagaaatatttcatcaaaatgcaatgtctccttttaacctcaaatataagtattttggtcaaaaacccatattcaaacgcaataggcattgtacgtttccaggttagttcgcagccatagatgggacaattccttcactcatttattttattggtgaaatctttcatgagcccctgtaaagcgccaagcactaggccatgaggtgagaacatcataggaagcagcgtccttcagggtcactgcccttgttgaaccccgattcacattatttgaatcccaattcacataatctcacatgtatataaattacagctctgataagtgctattcacaggagatgcatgagacgtgagctcataatactgggattctagctaaccagggaaggcttccctgaggaggtgagatgggagtgaagacctgaaggatgaataggagttaatccaggtgaagagaggaagaaaggacattccaggtcggagggcagcatgtccagagataggcaaggaaggaatgagacaagtaccaagagaaggccagggtggataggaaactgagaggggtgggggtgggggagtggcagggtggtgatgctggatggggtgggaggggcaagtggaagtggtcaggacccaaagggctttgttagtcttgttaaagggtagtgttctgttatgttttttggcttcttgcttataagctgtgtgaccttgggttagtcaattctgtctctgtgacttatactcacctacagaatggggataaaaatacctgcctttatagttgttgtaaggattagagcagctgtttcctttttttccttcctttctttctttctttttttaagagacagagtctcactctttcacccaggctaaagtgcagtggcatgatcatagctcactgcagcgttgaactcgagggctcgagtgatcctcccgccccagtctttgaagtagctgagaagacaggcgcaaaccaccacaccgggctcatttttaagtttcttgtagagatgaggtgtcactatgtttgccaggctggtctcgaactcctgacctccagtgatcctctgacctgagcctcccaaagtgctgggagtacaggagtgagcctctgtgcctggctcttttcctgctttgccatgctgcttttgcttccacgccgatctgaatacagtggtttcttaggcttctcagctacccatgacagttcagagaagggtagaaatagactcaaataactttcaatcaacaaaatttaaaaatgtgttgacagtgggtgcccaccctttgtgaaacctaggcaggcagtggtgaacaagttcctaagcctgcttccaagaccctccaggggagtcctagcaggggaccctaaagaataagaatcttgcaaaatggctctgtttcatcctaaacatttgagacagccccataccctagtgccacctctccttattaccctcccacaaattcagagagattcttggcatattttacaatcagttagaattatcgaggatttcagctgcaatttgaatgaggctcagttataacaccagattttttgaaaataggaataagagatgttaactgtgctccccaatgccaggaaatgcatgtcactagctgtgggattgctggtgagctgcgatggcctagccagcccccagtcctttctcctgggtacataaaaggctttattctcccagttccatattctctcagttctaagacaccgctaattgtaaaatgacctgtctaccaaaaacagccttcaggggagagggggacaaatttaatgttccacattaattataaaatacactctaatttcaaaaatcttgcaacttaaaatacgtgccttagaatcaaaagaagacggtcagctatcttgctgcagggagaaacgtaggcagggtgctaagaaagcccagaggatttctccagcatgcagctggtgcctgccccgtgactcaggaagcagcatagagcagaatgtggccttaccagcaacttgcttgaggaggaaaagggtgatggttgctcttttccaacaactgttcccgagtatttgccaggtactgtgtgggactctaggatagagttgaaagactcaatctgtgccctcaaggaattcagtctagtagaggagataccccagtgaacagacaatgataactgcacagcatgaaatgtacgcacaggggattctgggagcacagggattggggaggaagggatgccagggaggactgagttctcaaggatgcagagtatgggtgagcaagctaaggaaagaaagagcacttcagacagcaggaacagcatgtgcagaaacagatgcccatatgttgggcattggcaatgccaatggtcccatggaaggtagaaagcagaaaggggtgaggctggaaggcagcacagatgtgaccccaaaggcacagaaatgcctcacagagacatttgtgtttcagcatgaaagaaaagggaagcccagaaaggtaggaagccaggtaggatcatcacaactggcttttccactgtctaggtcactggttgttgagggcttaatggatgggatgaggagtgggtcagggctgatgagacttgctgagcaggtgagaaggtggttgcagtgaccaggtgacttgcactaagttagtcatagtaaacagagagtaaaggggagaagggagattgtaagtgatgtacaatagagggacgtccagtctccccttctcttctcacttcccagcataacaagcatgactgaacacatactatgtgctagtccctcccattacaaatatgtggctacagaaagtctctattcaaatatcaccttctcaaggaggcttcctgaccaccctgtctacagtagccccccaagtcctgtccccttttttcttttttttagacagagtctcgctctgttccccaggctggagtgcagtggtgcaatcttggctcactgcagcctccgtctgctgggttaaagcaattcttatgcctcagcctcccgagtagctgggattacaggcgcacaccaccatgcttatctaatttttgtatttttagtagagacggggttttgccatgttggccaggctggtcttggactcctgacctcaggtgatccacccacctcggccttccaaagtgctgggattataggcatgagccactgcgcctggcttcttttttaactttgtatttttatttttttagcacatgcatgtttctgacctgagttcccctgtaagactggaagccccatgagggcagggaccatgtctgccttgtccatcaccatctccccaaagtcttgtctaatttctggcactaagaaagtgcttgggagctaggtgtcaaatgaacaaataaagagatggggcctggcctctgggagttgcccacctagtgaaggagatgggcttttaaacaaaaactccaggcatccattgaccagtcttttctcctaagcttggctgaaaccacatgctgaaaaacgcttggtaacaagcaggtgtttcccctgcaacctgggaggtcctctgtggtgcctcctgggccccagctttgccataaaagctgataagtcactgcctgctgggaagcagtcatcttttctctccattgcaatccttgttagttactgccgggcccagaggcactgacttagcaaccctgggtttgcctttgcggagtgccgtcccacttccttactgacactatattcattcactctctcctgaacttctttgaccttgggtagccttccttcggctaacaagcatgccagggatcaggtacaagatcccaggtgcatggttgctggagcctcgttgtaggaagaatccacccgttgtcttgccaccccctccatcatgcaacttcaatgccccagtgccagcctctctgaccttgcaccaggcaaaactcactggagaccagccactgctgacccctagaccaattcttatcccagttttgccccatggctctcctgtctcattttctctgcttaaaggatgtatgcacttttttctatcatattttcccccaacctggatctctctatctctgataagggatacatgttatcctttctccttcctgaattttcgctagtgttgatagctcttgtctccattttcctccaccatgtttgcagagtaggtaatcctgaaaaacaacggttctgccatcacttcaatactaatagtaacaataataataataggtagtcattcgttgagtgtttcctttgtgctaagcactgttttagatgctctccagaggctcttatttaatcttcacaattctgaagatatgtgctgtgatacccattaactccatcttaagaggctcagagatgttaagtaacttgccccaggtcacacagcaaatggcagagctgggattccaacccaagcctgtccaaccccaaaacctgtgtacagccttctatgacactaattatatcttccattttctcttggctcccaagtctataaataaacttctttcagatgttgagggcaatgctgaacagaaatgctgtttgtactcccttgcatgatgaagtcttcagcattttgagcttatccatggcagggtgggggaatagtgaagggactgccagatttcctcactgctttgaaaacagaagttccctcaaaatgcaaggacatcagtctccttgcagtttgtgaaggtgcggaagtgaatacagatactccctctcccctgccttctgcccaaaggcccctttcccagccacatcctactttgtctccaggacttagtgaagttgtcacctctctctgctgcctcccaccctgctccctcccacctggggtctgcttcctccagatcccagcatctaatatcttttatgttgcttgtttccattcctgtgtcttcctctagatcatgagttccctcatctatttcttcaacaaaatttaccaagttactaccattgccaggtgctgtcctaggaagaggtgtgaacaagcatgaagtgtttaggggaccacttgaggtttatactattgcgggagaacaaggtatgggagaggagataggggaaggtgttagtaatgagggatgagattgggcagaggccccatcacaaagcaatgattatacggtgagattgctcaatgtttgttgaatgaatgagtgagtgaatatagaaaaaagacatagcacaaagcttgacatctgggattaggatgcctatttaatctcagatttttcccatcatcgtcatcatcatcatcatcatcaggatgcattctttcccagtgaggcctggagttcatgtcagctcacatctgacagcctgggttcaaatcccacccctgtcacttatgagctatgttcccttggacaagaaatatagcctaagtctatttttcacgtgtaaaattgggataatcattttgtctccctcctgaattgcttgtgaaattttggtgggatgctccacgtagagtgcttaccgaggtgccggcacacagtgagcacttgacaaatgtcgggtgctgtcattaccagtggtgtgtttattatttatgacgctagcagttgcaaagggtgattggcaagcgagttgtgcttggccctcaaatgttctacaaattgaaaactttcccataaaaatccacatttttggttcccttggggggaaaaaaaaagatttttgtaaccctgggccctatccctgcttggcagccatcagcaagagctgggcagcagatgtctcttccgtgcggcaggtgcctcgcacttccccctgagtccccactgctcccgagtgtcttacgtggcttacatggctgctccgctccaccgtgcgtggccgtttcccggcctctgtaggcgtcgaagtttgcaaatcctcctctacgcctatggcaaattagaggtagagtctttgtcttttgacagctgaagacagaactaaaatgacaccagcgcagacagggcgtagcagctcacagagacagagggaagaaagccgtgcatctgtaaataaatgcataaatatcccacattcctgagcagggcctgttgataagattcaggtggaaggctagcctcatctactcccttttaaagaacgtccccagggtgagttgttgcttttaaagagagagacgctcacccattttaggtcaccctggcagcttcctttcagaggctgacattttctgaccttgaccccagttcgggaagcatgccctgttgtggtggccagccacgtggcatgctttattcaataactgaatgccaggtgccaaggcgacaggccacgctgttggtgctggctgcagagagatgggagggagacctgctgcaggaccgagagatttactacttctcatttctaccttggaaagcttcatggagaagagagaaatttccattttctgggtaggaaaaattgtccagtaattgcccagaaagaatattaacttaaagacctgtcgtttgaatctcaaagaatggtcagacctgaattaacttgataatttttgaatgtttaatgtaagccagactctgtgctagttcacagatcacagaaacaaatcagctgccgaggggagtctgcccttcctcttcccagtctctcttgccgattttattttctttgttggattttacgttctctgaatttgtttgtctactgtatgtattatttctaattggaatgtgagttccatgagaccagggtccttgtctgtgttatttacctgccatagcccagggactgagagcagtgcctggcacacagtaggtgcttagtaaatgttttttgggtgtcagaagacacgcccctgctctgaaggagaccaaagcctagaatagacaggcaggtatcaaaaccgttaccagtgagctcagggacttgatgaaggcacaagtaaaggcgagaaaagagagcaactttatttgaggaggtcaggaaagaggtcctaaaggccctctgcagtgggttctgcaggacgaataagagttcgccaacagtagaacaaaggagataggcccaaaacagatgaagaaaatgaaatcacccaagactgtccccaaaaggatgaggtcaaggagagagcggagcacttggtctagagcagcaccctcaaaactttaatgtgtacacagatcacctggggatattgctgagatggatactgatttggggctccaggtgggggctgagactccatttctggtgctcaggtgaggctgatgccacaggtctgcagaccacagtttgagaagcaaggcttcagagcatggccagcaggttctggcagatgaggatctaaatcccacccctgccactggcgggctgggcctgtttctttgcctctaccatgaggataaccaccttcttcccaggcaccaaataaattcagagtgcatagatctgggaaagccactagttcagtcccagcacctctatcagtccatttcatttcagctactttttttttttttttttttttgagacagggtctcactctgtcgcccaggctgtaatgcagtggtgcaatcatggctcactgcagcctcaaactgttgggttcaagcaatcctcccacctcagcatcatgagtagctgggactacaagtgtgcactaccacactgagctaattttttttttaagagatgggaccttgctgtgttgtcaagcctggtctcaaatttctgggctcaatcgatcctctcacctcgatctcccaaagtgctgggattacagggcgtgagccactgcacccagcccatttcagctaacattatcatttaaggttaaatgaggtgaccagagatataagaagaaagagtgattttccccgagagctactgtttgagagtctcctgtgtgctgggccctgggctgaggaccatgtgtctgtcaccttccctggctgcactgcactctgtaacatgggtgttaggattctcattttacccattatataccagtgggagtgtatgtttcctattgctgctgtaataaattacacgaacttagtgcttaaaacaacaaaaacctattatctgatggttctggatgttggaagtctaacctgggtctcactgggctagaaccaaggtgtgggcagggctgcattccttccggaggctcttggaagaatctacttgctggccatttctagctcctacaggctgcctccttccctggcctgtagccacttcctctatctttaaagccagagttgttgaacagagtccttctcgtgattctcctgcttcccccctcacacctaagggccctggggattaccacgtgcccacccagataatccaggataatctccctctcttacagtccgctgattagcagccttaattccatctgcaaccttaatcccctttcccatgcaatgtggcgcactcacgggttacaggaattgggatgtggacatctttgggaggctgttattctgccgaccacagggaatgtctacccaaagaattcccctaatgccacaagctcagaacagcacacctggaaaaggctttagagcttgtaccaggaaggattcaatttgacaataagccacagaaaaataaaactaacagtggtttaaataagacaaagagtttgttcacaacctagtgtcacaaccttggaatagtacacctggaagagatttttagagattatatcaagaaagattagatttgatgataagtaacagaaaaattaaatgagcagtgtcttaaacaaaacaaaaagtttattctctttcaagtaaacaaatctggggctgtaaactacaaggctggcctggaggctccacaaaccggttaacaatgcagacccctgctcgctccccactccatcatccccacagtgggtccttcaacctcacagtcaagtagggctgccagagctccagccactgccttcacatcccatggatcaaggtggaggatggcacaaaaaaacaagggcaaagggcacctgtcacctggctcctgagaaggcttcctagaaggtatcacacaacatttttgccttagtttcattgggcagaagtttgctacgtgaccacacattagctatagggaaatctggaaaagataacctttattctaggtggccacatgcctggaggaaaactcgagtttctgttgctatgggaaaatgagagagggaagttgactagcggcgactccacagggctcatctagtccaaatcttcaccttgactttgaagaacatgaggcccaaaaaggaagggacttggtcatgccacggagtcagcaagtggcagtgcagggactagaacccctgtgcccgggtcccaggcagcaagtagtgtggggtctccagcacctgacacggtgcctggcacgtagtagcagctcactcatgcttgtgggacggaaggcactgtgccattccaccaccacaatattccctccgggtcacagcctctgctgctgcctctttgagggtggatagaatccccagctctgggaggcaggcccattgcatgcctgagtctgtttatccgccttcctccctcttacatgccagctgatacccttgggggagctccgggctcccctatctctcccacaaagtcatcaaatccaagggcccttccgcatgaaagagctgcaggatttgaccgaagagaagcctgaaacagcaccaagaaacggaggtttttccttcttctggacttgctctgtgacagggtcatctccttagagatgagcctttatatctgaggagggttgtggcagcgagctgttgctgttgtcttggtatgccctggtgtccgttttgacatggtgaagggattagacaggggcccatccaagccaggagtggtggccactctcccctttctcctgccagcctcaaagccaaagagcctccaccctcagacatttgcagcctctgccagttcagatgtcggcaaagatccagacacttccttgtgcttctctgttttcaagtatctgtctcctcaaccaggtggcaaagcccttgagacatggatggtgtcacatttacctctgtgaccggctgtccggcacagtgcctggcacacctcaagctcttggtgaataaatggggataggccaatcagtcagaattaaatagctaaggcaggggctggcacatagtaggatctcagcaaaaatagtagtaataatgaacaaaataagaaaaggagaaaggatggaaagatggacggaggaagggaggaacaaattagttagtgccttggcttcccgtggaatcagccgctcctagggtaggcggctctccccgccttggtcccggaacagcggaatccttcccctgaggactgagttcacaggagaacataagaaccaggccggaaagatctgtttcaaaaggcctgtcctcggcttgagaacactgtgcctctggggcttcccgatgggcctcggcagccgaggtgcctgacaccagggttaccaggacatggccagaggcagaacgtgtggtgtgggtgaggtgggggcagagcgatgggggtaaaggaagccagctgccaccccaggtctaagtcagcggctttgcagagcaccagaggacaggagccagaggtgggtccatggtaaggatgacggggggcagaagctcagcatagcgaggtggcacagggtggggaaagagcgtgagaaggcgggcagaggcccccgggagagatggaagctgcctgggcgcgggcgggcccctctcagagcagatggaatgctggagcccagagggtccacgacagttggtcagagcgaagaggaacagcagcaggatgcagagagaggcctgcccgcccccaggctgggagagacaccccctgccgcccccagaaacgctgcccagggagagctctctgagacacagagaacacagagaaaccaggcggggcatggatatttgtggactgagcgatgagaggaagctgcaaagcttgtggctggagcccaggctaaaattacaggccagagtctcagacggcaggaccacacaccaccgcagctcaggaccaatagattttccctagaacccaaccacttcctgccctactttcttcccggattgattgggcagcgcgatccagcagaaagagcccagtttgggcatcagacagacctgggtttgaatcctgatgcactctgccacctcgggcagggtgcttcatctctctgaaccactgtttcctgtccaccacatgcacacacaaaaacggaaataaatatgcttctcaagcagtgtgttataaaaattaaaataaaatctgtataaaggagttgcatactgagtgaaggctcaaaacacagtgctgttgttttaaatcaggactgttattaatcaaacacatatctttttttactttgttttttttttttttttgagacaaggtctcgctctgttgcccagactggagggcagtggcacaatcttggctcactgcagccttgacctactgggctcaagtgatcctcctacctgagcctcctgaggagctgagactacaggggtgcaccatcacaccggctcatttttttgaatttttgtagagatggggtttcgccatgctgcccaggctggtctcaaactcctgagctcaagggatccacccacctcggcctcccaaagttctgggattacaggtgtgagccactgcacccagcctcaaacatgtatctttaaatcgatcccctgtttaaatcgagcctcatcctaagcaatagtacccaagaaatcactggttcaattcactagttatatttttaacatgccttcaaaatacttagcttaaagctatttaaatgttcatccctataccacctaaattcatctcaggtaccacaatggcccaccattcactttgcaaaagcgttgttcctactgataaaccatccacggggtttgaaagacatggagagacgggtggctcttcagccccattactcatcagcttttttctttaggtgataaaagagacactgacatagaaagtgaaaagaaggtcagaggccaattcacagaagtcgcctggactgtaagggcctttctgaggcgtcgggagcactcggttcttagttacaatttgacccattcctccatctagaaaggatggtggtgtggacgacagccaggggtcgcggggggtggagagagagagagatgctgcctcccttgttgacacactgatttgtactgaaggattttccctttggtttcctccagggtgttcaggagatgccccctcccaagacaccatcagaacaagaggaattagctctccctgtcaaccagcagggaaggaatttctttctccaccctagagccttccaagcatagaaggatttacctctggtaggaagaggtgttttcttggaagaagctgtaagatttctccataatgatcatacctgagtgggggaggaaaggcagttttgtcataacaggaatgactgtctcccataacaataatgacaaaaaggatttggggtatttaggaagggctgggataatatgactcacaagcctaagagagatagtgtaggattttaggaacccaggtgctgggtcagagagaatgcaggcatttccttcctgactcttagtcctgactcaatctcttagatccaagggcttcatccaccatcatctataaagcaaaggctaatcctgaagtattggactttgacccgagggtgtttatttcagagatccagcactgtcttgttagaccctaaactgctgagaagagacatagctacttcttatacagttgaatgaattaacacataattatggatataaactaatttcagagtattaatgtgggggcctggaaataaatcacagaatatcttgtctatacagcaatgagatgccaggaaagaaagacaggatgctgcaaaggaagcgctgagagcaaatgcacttaccctttggagggcccggagcgatcatgagctagttggctgtaagagccccctttgggatggcaggcatgggggaagtaagcgttctcgcaatgaagctgatgggattttaatagccagacagatggcctgagagaaaaaaaaaggaagattttttttaaatgaaggaaaacacttccatagcttcccttcaattaaaagaaagtgagagccgtccatgccgggaagatttgtcaccattattaatattgtcagtctggatttcctttaaataactgtatgattgagcatcagtaataaaccagggcagcatcttcaaacaaattagagggtgtgactctctactgactttctattcaattttgattgtgttggcttcatttggtctcacaatttaataatgatcccaaataattgtgttgttattattcttgtttatgcagtcaaacgtttatcacttattggattctttagtgtccatcctcctaagaacttcaggttctatacaagtcaccattgagtagccagcatatctaaatttgaatcaagaaacctgggaagaagtcgggagtggggtggggggaggggaatacaagataaaaaggaaatgtttgaaaagaaggagaggatggagaggaaaggaagggaagaaaaacactacctattgagcaccctcctgtataccaaaggttttattttatccccacaaccaccatgcaaaatctgttttaggcttctcttcctcattctgcagaggaggaaacggaggtgctgagagattaagcgatttgccagagtcccacagctaacaggggcagaggtgggagtcgggtttgggactccgtctcttcactggcttcactcctgcaagggccttcaagccctgcgtcttctcccccaagtctcagccaagctgtgggaaccctcccaagcttagaaatgagctgtctcgtagcattcctgcagtgtgtaaaggagcagaaattcacataggaattctgcctcttggtctgctgttacacttccctagttcaattctcagagtctcctgacggctgagcaccatgaagatgggctgatggtagagggagagttggtccctgagagcatgcagacttggcatcctttggccataccagaaatggacccaatagagagtggggggagtaattatctacaggaaacatacacatgccatgcctccagctaccatgggctggatcctctgggatctactgtatagtccttattttttcattcagttcccacaaccaccctgtatggcagggtggtggtacagatgagagaactgaagccaaaagaagtcaagtgatttctttttcaggttggtcattggtggtgcagggatttaaaccctagtccagccaatggattccaaacacaaatggtcaactttacttcagcaccagtgtgatgagttttgacaagagacaaaaggaaagggtgggagaagttagaaatgtaacccaaaaatatatttggaataaaagtggctgccccccaaaaaatggatttaattctgttcctgcccaaaggctgatgctcaaatttaattcagtaagcatttacaggatgtcaacaatgtgcagatcattatgctaaagagccaggtgctgacaaagattcaaattccctgtcttcttcctttttaaaaactttcgactctgaataaaaagatgtgccccttttcccacaaagagaaaaaatcatgtagttgctcttccttatgctatcaccaggtaggaaaagtccagtctctgcgagggcttggaagcattctctatattctaaggtgctgcatcagttacttttaggccctaagcactaaaccaacagaaagaaggtggagggatgaagacaaactaaaagggaagagccatggaaatacaaccaacaagcaaaagaaaatgatccatcgattaataggcagagagatgaacagatagatgatagatagatctttagcttctaacttactcgtgaaaaagatacaaattcttagaataataaaaaaagaataatttttctgtttttcattctcattctttttaatggataaatgtataaataaagaagttgacaggaaaagaaaagaatctgagacataaaggccagaatcagagtttttcagatgtgctgctggtggtggtgatgatggtgatggtggtggtggtgatagtgatggtgatggtggtggtagtaattgtaaccatgatgcaggtggcagtaatcatgaaggtggtggtgattgatggtgacaataacggttgtgataaagatggtggtgatgaaagtggtggtagtggtggtggtgatggtgatggtagtggtgatggtgatggtggtagtggtgatggtggtggtgatagtggtgatgatggtggtggtgatggtgatggtggtggtggtggtggtgatggtggtaatggtggtagtggtggtgatggtgatggtggtgatggtggtgatggtagtggtggcaatggtggtgccgatggtggtggtggtggttttggtagtggggcagtagtannnnnnnnnnnnnnnnnnnntttcattctcattctttttaatggataaatgtataaataaagaagttgacaggaaaagaaaagaatctgagacataaaggccagaatcagagtttttcagatgtgctgctggtggtggtgatgatggtgatggtggtggtggtgatagtgatggtgatggtggtggtagtaattgtaaccatgatgcaggtggcagtaatcatgaaggtggtggtgattgatggtgacaataacggttgtgataaagatggtggtgatgaaagtggtggtagtggtggtggtgatggtgatggtagtggtgatggtgatggtggtagtggtgatggtggtggtggtggcagtgatcatgaagatggtggtgatggtggtgataatgatggtggtgttagtggtggtgatggtggtagtaattatagccatgatgcaggtggtggtgatcatgaaggtggtgctgatggtggtggtagtaattgtaaccatgatgcaggtggcagtgatcatgaaggtggtgatgattgatggtggtaataatgactgtgataaagatggtggtgatgaaagtggtgatggtgatggtggtgatggtggtggtggtgatgatggtgatgatggtggtagtgatggtggcagtgatggtggtggtaatggtgatgatggtgatgatggtggtagtgatgatggtgatggcggtggtaattatagccatgatgcaggtggcagtgatcatgaaggtggtggtgatggtggtgatggtggtggtgttgatgatggtgatggtggtggtgatgatggtggtggtagtggtggtgacagtgatggtggtggtagtgatggtggtggtaatggtggtgacggtgatggtggtggtagtgatggtggtgatggtggtggtaattatagccatgatgcaggtggcagtgatcctgaaggtggcggtgatggtggtgataatgatggtggtggtagtgatgctgatggtggtggtagtaattatagccatggtgcaggtggtggtgatcatgaaggtggtggtgatggtgatgataatgattgtgatgcaggtggtgatgatgaaggtggtggcagcagagatggtgcttgtgatgataacagggattgttatcatccgaataactaccatttggaacaactcttcacggtgtccaaaacctttaacgtgtattacttcattttagaagaaaaattctgaatttttcaaaacaacaactatttctaaccaagttccaccgtgagtgtcaccaaaactcagccaagttaagagaacagggagagctggagtgggctctttctccatcacacgtaagtgggcagtgacctagggaggaacagttacaaaaacgagagcaaggctacaaaagctctctccagtcttccctcaaccaatcgcctccaagtctattcacccaaatcagtccccaacgttgatagaacttaataccctttcacctgaaaactgtttagtagatttcatatgcataactgattgtaatctggttcctagtggataaataaaaatcatttgtgatcattgaaacgtatttattttttaattaggtagcagccatgaatgaagagccctcagagagccatctcctataacctctccaggagccctactgacatagaaagggcagcattcagtggccggtacatttgctcctgcccatgttttcttataaaggactttaacccctgactgacagccctaccacacttcaccggaactcatcacatgtccttttttaaagaaaagaaagaaagaaagaaggaaagaaagaaagaaagaaagaaagaaagaaaggaaggaaggaaggaaggaaggaaggaaggaaggaaggaaggaaggaaggaaggaaggaagggagaaaatccaaaatgctggcagataagctgccaacaaaatgatttctttaaagaataaactaataactgagtatcagttaaggcacagccagctgtgacgtttcctctggccatgccaggggctgcagtaactacctactcagtgctgtgctgcgagcattgattgggagcattggctgtgtcagagggcttgacattccagcaatgacacaaaccacgtgtccttgggaagacggtgtgcgatgagatggatgagccaagtagggtttgagaagtgggaaaattaggtcaaatccctgtgaatgtacccagggaaagaagaggctgctgccgaagggaagctgtgtccttggtgtttttagagaagggggtggtgtcctaggtgcaagaagagaaggtaaccatggtggctcctggccatcgtggggaaatggagggggaacaggtgtgagtgactggcatgggggtggaaatgaggtcatatccgtagtgtgggagctgtagggggaatgttatcgcatgtgctgggggaaggatggaggcaaattgggtcacgtctttgtggaaatgatgagagaattgggtcagaactgtgggggagaaggcttgagaattgggtcgagtctttggttagaagggggaactgggtcaaatgtgaatgtgtgtagagagagggtagtagaaggtaatagagagagtgggctgatccctaaggtcagagaggaaggggaatggggaagctgctttgattcaccctggggttaaaaattgagctactaggttctggccatttcctcctaattccattgacttgctgtctccccttgtaacattagactgaaaataggctttcctcctcctaccccaaattgtgtgacataaatttcagccaggacggggtgtcattcattcttcagcactttgcaaaccaacacaaattggcgtttgggaagataaccattccatcattttacgtggcctcattttacctagaatgccaggctggtgagcagctgccctcccttggggtttcagcataccaccagattcaataccaattctctctcctttgcgaccattggcatctctgcaacacttgaagcctcaaaatacattttgtaaataaaagctgagtaataagttcattttagcagcttccaagctggctttgttgaaatctttgcaatcatggggcagtcaaaccacaacaatactcaaaattatacttaaaaagaatgtacttttattaatcagctgaactcctattggctacttggttgaatagaactatcttcaaagagcaaaactggaatgtgcaattcacaaccttgtctgctgtgacactctatggagaaatatattaaaccatggaacttcatttggttgaacggcaccacaggctcaacacatgccagtgtatatttctctggtaatttcagcttctaatttatgcccacgtgggttaaggagggtttctgttgaagcatacactcgtgacctgctatctcctttggggacctaggcatggagttataatgaatctgatccgataaggccacaatgggttaaatctgcattctcccaaaaattcctttttatcggcatgaatcactgtgattaatgagataagcttgtaataggcttctgtagcatatggacctctctgacccaccccagaggaagacacacccatccaggcagtgcagtggtggggaaaccgcatcctttcccgtggacccgagaaagcttaaggcttcttagagaagaatagagatggacacacaccaatgcttcctattccttaggtgatatttggtggtattttggaatgatggggataaatatactttcagatcaaataatttggccctggtttttcttgactctcagaatctttgaatgcagaaggatcttgcagattctgaaagccttcttcaggaaatgaagagagagggggacaaaaagggagtcgttccctctgcaattcaaatcaaaccttcattttcttcagcagagttattttaagtcattcattattatttttcttctgaagcaggggctgtttgatactgtaagattgttagaaccagagaagagtagaggtgacaccgaagtattattcttgctgcaatttcagatgaatttgctgctgacaaaagatttttaaaacacacacacacacacacacacacacacacacacacaatattagaagaagcagaaagagaggcaagctccatcaggcagctcagggaaattaggtccctaccatttttccagggcattcgctgaggctgatccagcagatgttcccaggcagtggggtagagggaacagcaccggatatggaggcagagaatctgggctagaggctgtctgcctcttctgcttctgagcgttgtgaccttggtcaaggcccttaacctctctaaacctctgtaaaacagacgaagaggaaaatgctgacattttcacagtgagccacagccagcaaagctgtagcaagttgagcctcgtagcagcctcacgaggaaggtagtgtggacttgaggttccaagccctgggcttcgcagggcagctctgagaattgaacgagttaaaacaggagccagctggtgaccttaggccagttgtttagcctctctgagcctcctatttctcatttgcaaaatgagtgatattgcacttaagtgagatcctgtaccgggctatgtgccagctgcatcctgggtacgccatcgatggtagtcatttgcattagttccaggtggcaagttccactctcctaaagagagggccatggttccaatcagagaataatcttctgccaccgctaagattcaggtttagagggacttctaagtcaatggtacttaaagaaaggtcaaagtgcaaagtacacgtgtgtggtcacagctacagagagagcaagatcaaatgtgtctgtgaaaacccatattggggcagcaaatacccccaagagatatttgggaggctggccctcctaagagatagcgctgtggggagcctgctccacgaggggtggggcgagaccacacaggaggctttgatgtcacacgagccaggtgtgaccggtataaacatcacttctcaccagccctgtggccacaaatctactttccctctacaaattcaggatggcagccatgctaacctcatagggtcatcatgaggcttcaataccttagcacagacagggctgtcatggtggagcctgtcaaacagtgggtgctataatcactttcctattgttgttgatagttgctgtcactagtggtagtacttgagtagtaaaatcagcctttcttttcttccttctctctctttctcaatacctccctacagaaagtgagaagggatgaaagtgggatactacgataacaggttaacaggctggaggcaggagagaggcacggagatggggagctgtgagctgggccctccagtgccctgacactgccaggacagaccatgccgtcccctggtggggtgacattggaaatttaacatagcccagcaggctctgtggctgttgaatgggacatagttcccaggatcgttacccatatgagacttgccatcttggaagtgctcccagttctttgagaaaagtcgacataaaaggagaactatgtgtattgcaggatggaatccactcccacttggctttggaaactgaccagagcttgactattgggtcaggaaaggagaacaggggagagcactcatattttttttaattggtcacccacctcataaattaccttatttaagccaggcatggtggctcatgcctgtaatcccatcactttggggaccgaggcgggaagatcgcttgtgtccaagaattcaagaccagcctgggcaacagagtgagactgcatctctacaaaaaaaagaaaaagaaaaaaaatagctgggtatggtggtacatgcctgtagtcccaactactctgaaagttgaggcaggaggatcacctgagcctgagaggttgaggttgcagtgagccgtgatcacaacactgcattcggcctgggcaaccctgtcccaaaaagtaataaattatctcgtttaatcttctcactaaccctatgaataatgaggcaggatttattgaacacttactatgtgccaggcactgttctaatgatttacttgtgttatctcatgttaatcttcacaacaatcctttgaggcaggaactataatcaaacttactttacagatgagaaaacagaggcccagggagattcagtaacttactcaaggacacggccaattagcagaggcctgggattcaagtctggctcaggtgcccactgtgcaccctacctccctcttcccagtggcatagcacagtgggtaagaatagggtcctgggactcaaactgcctgtgttcaatccagctctttcaatgctctgcattaggcctcagtttcctcatctgtaaaatggggattaaaagagtccttatcaacaggtgtgggccaagtgcggtggctcacgcctgtaatcccaatactttggaaggctaaggcaggtggatcgcttaagctcaggagttcgagaccagcctggccaacatggtgaaactctctctgtactgaaaatacaaaaattagctgagcatggtggtgcacgtctgtaatcccagctacccaggaggctgaggcaggagaatcgctcaagcccaagaggtagaggttgcagtgagccgagatagtgccactacactccagcctgggtgacagagggagactccgtctcaaaaaaaaagcaagcaaaaaacaggtgtagtttaagaatgaaataagaaaggaatgagtttatctccagtccatgctgaggaagtgggaggtgggagaggtgaagttgctttcccatggtcacccctgtcccttctcaggggtggtggagccaagagtgcaggctggctctgagcccaccacatggcaccgtcagctgggaccagcatcatcctgcagccttcagcagggtgggggcccaactaggcaacctcttcaatggccagggctgacttggccaagcatgggcaccaccaggcctgtgtcttacttgatcatgcgggagggacggctgcccgcggcacaccagcgattgcgtgctatcgagagagagtcacaggggaccccgttaccaaatcaccccggccgccctcaattaaaggcacgtccccactcctgacgcacattgctgcctctcctgcctgcctgagtgttttcacttcctggaagtgacaagtagagctgactcgtgataactcatgcttcataaactgtaaagtgcttcataaactgtaaagtactttgtaaactgtaaagtgctctgtccacgtgagggcctcatatcaaggcaggaacctctgaagagagaggccgaagcccctctctcctacctgcggtcctctgctctggctctcagcagcagcgagtgtggtgaaggggcagcctcccatcgctcgttccctgccagcatacactgcccagacctcctccttgtcctctctcctgccacctctcctgcctgcggtgcccctgatggtgctttgcactgaagtagcccctccatggaggcaccattttcacaacatttaagaattcataaaagaaatcaatgtgtatgttctgcgaggtgttttcttcataggcaaggtaccatccacaaaggtttactgatagttccgatgttattagagttcagagaattcgatttccaatcttctccatcttttcctaatccttgctgcctactcagcttgatcaattgccttcttctcttttgctggacccatttcccgccttgctgtctttgctttctgggagattcattccttcagtccttcaacacattttgtttttttatatttggagacagggtctcactctgtcacccaggctggagtgcagtggcacaatcctggctcactgcagcctccacttcctgggttcaagtgatcctcccatctcagcctcctgagtagctgggactacaggcatgcaccaccatgcccagctaatttttgtgttttttgtagagacagggttttgccttgttgcccaggctgatctcgaactcctggactcaagcaatccacttgccttggcctcccaacatgctgaggttacaggcgtgagccactgtgcccagcctccttcaacacataactacgcaagtcccatgatgggcccagccctgtgcctggagatagaaacagctgcaaggcagatgccatccttagcccaagaagcttccagttctcatttgcttctcaaactttgggatgcacaaatcagctggcatgtgactaaagtacggaatgggattcagtgggcctgggtggggtgtttatgtggggagttgaatcatgtccagtggtggttggtgatgccttgggaagaatgggctttgcagggatcctggagaaggagaacggacctcgtgaactgagaactggaggagaacggaaagtgctcccaggttcaaggtcactccgagaagctgggggaatccgacttcttaagatccagctcattagagtagctgttctcagcaaaagcctcattgaagtcatcctgtgtgagaatcctcagtgcctgtggtttcccggtttcctcttgctcttggccttccctaccacccctattcacagtggctcacgcctgtaatcccaacactgggaggccaaggcaggaggacggcttgagttcaagaggttaagaccaggctgggcaacaaagtgagaccaagtctctataaaaatttttaaaaattagccaggtggtatggtgtgcacctgtagctccagctacttgaagggctgaggtgggaagatcgcttgagcccaggaggttgaggctgcagtgagccaaggtcacacctctgcactccagcctgggtaacagagaaaccctgtctcaaaaaaagaaaaaaagaaaaaaaaaaatgtagccccaccagggccccttcctggcttcccaatctgtgtagctatagcaaccccagcacaccaaggtccatgttcacctcttgccgtgggtctgaggagatatctttaccctgtctgagaatgtgatgtgtttcttcttccctttctttattgccttttgctgaaagttacccgtcttacctgttcctatcctcagtcctaatctctaacctcttatccccaagaatacacctcttctctcttctcttctaaaagcctggccatttttcttcctagcaaaatgtccccctgtgacagaaagagatctgagtccccaaattttgggttgcctgaaaaggaggtgaaagctctgccacagagatcgaggaggcagaggccccgtgcagactcttgtagcaagcagcttccagccaggcctgtaacttagaacacagatgcctctgggtgtcctgggaaacgtggtcaaccctctcccttcagtcaacaggaaggtcgggaatgcacagatggtcagagtatccaaaaaaattgtttgttggcgattcagtgctttgcaaaagaatgagatcctaacgcccagatttgccttaagacactgggtaactgtttcgagcctctctcggcttgtgcggtggagcatttcagcttgcagtcacccgtcagtcacagccctcatcaagcacataccaatttgaagcaataggcctcacgaaaggggatgaattatttaagccaatcagctgtcaatgagtggaacaattctgggagtcaaatccaaggggagtacagagtgatatttttcagcctgcttcaagattgtcagattaatttttacttatttattcctgaccttaaagagaatgtattactacaaggttaaagcatttctttctaagtatataattttagaacttcggaaataaagagattggctgggtgcagtggctcacgcctgtaatcccagcactttgggaggctgaggcaggcagatcatgagatcaggagttcaagaccagcctggccaacatggtgaaaacccgtctctactaaaaatacaaaaattagctgggtgtggtggtgcatgcctgtaatcccagctactcaggaggctgaggctcaagaatcgcttgaacccaggaggcagaggttgcagtgagccaagatcatgccactgcactccagcctggtgagagagcaagactccgtctcaaaaaaaaaaaaaaaagaatatagactttggacctggcctgcaattctgactgccttgctctttggacagatgactttaattctctgagcctcagtttccccttcagagaactaggtatgatgaggctaatttaaaaaattagcagagtgcagtgatgttcccctgtagtctcagctacttgagggactgaggtgggaggatcgcttgagcccgggaggttgagattgcagtcagccaaggtcatgcctctgcactccagcctgggcaacagagggatccagtctcaaaaaacaaaacaaaacaaaaaaacaaaaacaaaacacacaaaaaaacaaaaaacaggtagccctaccagagccacttcctggcttctagaacactgccctggaggtgcagtgttatatacattttaagtaaagcctaccacaaaagctcaatttttttggctatcatgataatcaatacttttataacagcccagagagactgtcagtttataaagatacaaattctaaaatagacccttccaaacaagccaatcagcccaaagatgctaagctatcatctatatttatattttatatttcattttgtttgtaattaacagcataacttgttaggtcccaaaagctgggatgatggagaattgggtttcaaaaatgaactggccctaatctactggtttttcctgaattctcttttcatatttgccctttagccagctgcccatctgcatctagcccagcatccaacgctgctcacagtatctggcacacagtaaaaagtttactaaatgtctgctgtcgatgttttgaatgaatgaagtttgtaaggggaatcttatagttagttagatcagggctgaggcacagagagaattggatcctggcattcaaatcattcataatctaaatatggaaagaagctgggcatgctggctcacacctgtaatcccagcatttaggaggccaaggcgggtggatcatcttgaggtcaggagtttgagaccagcctggccaacatggcaaaaccccatctctactaaaaacacaaaaattcactgggcgtggtgttgggcacctgtaatcccagctactccggaggctgagacaggagaattgcttgaacccgggaggcggaggttgcagtgagctgagatctcaccattgcactcaagcctgggcaacagagtgagaccctgtctcaaaaagaaagagagagacagagagagaatgaaattttaatgaagagaaaagaaaaacgattaactatggaaagagagtgctgacatgagcacacacactcatgcgcgtacatgcacaaacacacaatcactgagaagccaaacattcaagcgggtggtttggactccaagtgcatcaggagttcagagaagatgttctttttttttttttttttttttttttggagatagagtttcactcttgtctcctaagctgagttcaatggcacaatcttggctcactgcaacctctgcctcctgggttcaagcaattctcctgcctcagcctcccaagtagctgggattacaggcacccaccaccatgactggctaattttttttttcgtatttttagtagagatggggtgtcaccgtgttggccaggctggtctcaaactcctgacctcaggtaatccacccacctcagcctcccaaagtgctgggattacaggagtgagccaccacgcccagcctcagagaggactttctggcagagtctagacacaagacatgccttcaaggatgtctgggagatacagaactgacgcaggcaggcattctagggtgggtggtgtgatggttaaatatatgtgtcaactcaactgggctaaaggaaacccagatcgctggtagaacattatttctgggtgtgtctgggagggcacttccggaagacattagcatttgaatcagcaggctaagaaaagaaggcctgccctcaccaatgtgggcaggcttcatccaatccactgatggcccagatagaacagaaacgttgaagaagggcaaattcaccctctccatttgagctgggacatccatcttctcctgccctctgacatgggtgctcctggttcttgctctttggactcagagcaagacttacacccggctgggcccggtggtgtaagctcccacctcgtaatcccagcactttgggaggccaaggcaggtggatcgcttgagctcaggagttcgagaccagcctgggcaacatggtaaagccctgcctctaccaaaaataaaataaaataaaattagccaggaggggtggtgtgcacctgtagtcccagctactctggaggctgaggcaagaggattgcttgagccccaggggttgaagctgcaatgagtggtgattgtgccactgtaccccagcctgggcaacagagcaagatcctatctcaaaaaaaaaaaaaattcactcccctcgttctcaggcgtttggtctcagaccaaatcgcaccaccagctttcttgttctcaagcgtgcagatggcatactgtgggacttctcggcctccctaatagcatgagccaattcctgtaataagtctccgcttatatctctctatatatattctattggctcagtttctctggagaacccaggctaatagagatggggaggtacatgggagaaggcagggaacctggatcgcctgaagctctggcttgtcctgggaggcacgggccgtgcatgatcatggtgaggactgacagccaggagtcagaaacaaggataaggagggagagaggagccgagagcccggcagaggcatcaggatgcggagctgcaggccccggaaagcagtgagcctccattccctcccctttgaaatggacctaatagtatcacctgcctcagagactgtggcggtatctgaagagttcatgcaggtaaaatgcttagaacagcgcccagcatgaggcaagagcagggtgtgcttgctgtttgatggtggtggtgaacattatccttgaagattttgagccaagaagtaacagcgtggatgaactgttttaggaagccgagtctggcaaagcgaaaaaccaaggtaattaccagatatttaggccagaagagaactgattagcatagctctgtcaggcacacttaacgacacccagtgacctaatttctcgaaggagaaacacgaacccttgctttatgcctctctgttcagaggcgacatgaaggcgaaatgtagctttccctccccaggctctttgtctcaaagggtttttcaccagggaaataaaccaaacggcctttcaaagttccccgtgggttccgtatctcccatcacctaggcatatgcttactttgtaataataacaggtcataagtccccatccagcctgtgcttcctccttttctgagagccaaatccattcagcagctactcactgaggttcggtgcaaagtattgggctggcctggagtggggggtggtcagaaagtgcaaggcatggccctcactgtccagtgggctgaacagctgtataaacagctcagagcataaaatcaagaggggttagggccaaaacccagagaggggctcagtgcagcgcaaaagaagaagtggtgagttccagggtggacaacggtgaggaaagttctctccaaggtgggagctgagtcttaaaagtggatcccagctggacgcagctgctcatgcctgtaatcccagcactttggaaggccgaggtcagaagtttgaggccagcctggccaacatggtgaaaccccgtcttagccacgggtcatggcaggtgcctataatctcagctactcaggaggctgaggcaggagaattgcttgaaccctggaggtggaggttgcagtgagccaagattgggccactgcactctagcctatgtgacagagcaagactccatctcaaaaaaaaaaaaaaaatggtgatcccatgttgcgtgtgagtcaagtggggtggcggggaagcagttcttgcagagaaagaaagaagagcaaggcctggaatgtgaaagagcaacgtgctggcaggggaagtgggccatccggtctagtgggggacaggatggagagaggtggccgtgatagagaaactagaagagccacagagaccttgaatgccaggctaggaagttaggaagtatggttccctctgaaggcagtgaagagcctccactcataggtttgttggttttatttttttttctattttttttattgtggtaaaatacacataacatagcctttactatctcagcaatctataagtgtagagtcctgtggcattagataccttcatgtgcaaccatcaccaccacccgtttgcagaactcttttcatcttgtaaaactacaactttgtcccaagcaaacaatgactcctcattcccccctgcccctcaacccctggcaaccatgcttctgcattctgtctctatgattgtcactattctggggacctcatgtaagttgaatcatacagtatttatttatttatttatttattttgagactgggtttcactctgtcacccaggctggagtgcagtggcatgatcacagctcactgcagcctcaatcacctgggcttaaacaatcctcccacctcagccttctaagtggctgggaccaaagctgcatgccactatttacccagctaattttttccattatttgtagagacaaggtcttactatgttttccaggctggtctcaaactcctaggctaaagcgagcctcccacatcagcctccaaaagtgctagtgttacaggtttgagccactgcacctgacagtatttatctttttgtctggcttatttcattagcataatgtcctcaagtttcatccatggtgtagcacgtaacagccttccttttgaaggctgaataatattccaccatatgtatatacccagttttgcttatccattcatccgtcgacagacacgggttgctattgggttttagctattgtgaataatgctaccatgaacatagctatacaaatatctccttgagacccaggtttccattcttttgggtagatacccagaagtggaatggctgcatcatgtggtaattctatttttaacagtggctataccattttacattctcaccaacagtgcacaagggttctaatttctccacattctcaccaacacttgttattttcttgttttttgttgttgttgttttttgtttgtttgctttgatagttaccatcccatgggagtgaagtggtatctcgctgtggttttgacttgcttttccttaatgattaatgatattaagcatcttttcatgtgcttgcttattggtcattttaactagcaccttccttggaaaaatgtctgttcaagttgtttgcccatttttgagtcgagttgttggtttttgcactcatgggttttaaaaaggggagtagtctgagcagatttaaaataatgaaagcagctcacgctaactgagcatttactatgtgccaggcactgtgtacttgcttcatgcacattggccatcaatcctcgtgacaaccctatgagtctggcactacttcaatccgcacttggagatgaggaaagggacgtctagaagggttaagtaaactgcccagggtcacacaacataggaaggaacagagcaggcttcgaacccaggcagcttgactccagggcccacacactcgtcatcaggctctactttgctagaaaagtcattctggctgcatgtgaaaggcagacactgggaagagaagctggaggcttggagaggagcaaggaggtgtgggaaataaatcctacaggctgcccaagtcttctgtggcctgccttcaccagccctctttcctgttaacaagcctctccctgtcagcctctctcctccatcctgaggtccttctagcaggccctcccactctcgccagcttcctctgggcaccagcctggcccttcatggggtcctaccctcccaatccaccaggcaccccctcgtcagagctgagttgtaaactcaaaaatcaatgttttctgggtctattctctttacatcagcctaaaacacatgcttttctccctggaaattcctctcttaattttgcttccttgttctgtaaacattaggagatgatgcttatatgaaaactctgttttattacattgcagtctagcaagcataatcgaattagacgatgccttatttgagcacacttcagctagatgcttcctccccaactgcaccaccgctctcagctcgggtttgttagtcggctttgagcagtgagtagaaagacagtcggcctcaaatctagcttcagattccaggtccacaacccagtgtgaggtcttggacaggttgatctccctggcatttagatccctagcccggaaaggggtgtaggtggtgtccatcctctttgcattataatgcatccttagtgtgattaaccctgtgctgggcctggcacccagggacgctctcgagtggaatgagcgtaagctttagagaaacaaggaccttgctcatcctgttcactgctggagccccagtggctagaacagtgcgtctcatcgagtaggcgatcaataagcatttttgaatgaatgaataggcagagagatgaatggaagaatgtcaaaatatgcctctccatttctcattctgtgcgtgtgtgtatgggtgtgtgtgtgtgtctgaccctcttggctcttaaatccttactataaacgtttcagttatgttcctctcccctatatgtaccttgcaattcctgactcactaagtcagtggaattaggcttgcataatataggttttgccagccaccctcatgtaatgtccagccataggggaggaagggtgggaagatgcatttagccatgtggtccagaggggagcagcaaggtataaaaacaaaggtgctcattattggttgtgctccttaatgaactcaggtatgttccctcctagccatgatttgtgctcgtccctgcaaccgacagcctggttccttccgagcctcttcagggcatcggtgcccttggttagaaacaggcccatgtgatcgaggcctgtgtcctgaatttccctgtcttccagccccccacagatgggagctgggttagggctgccttgttcttgcccaggacacagcgggtccccatgacgcggtcctgctagactctgaacagtaccaggcagtcatctgaggcgcccagggatgctgaggactctgcgagcgctgcaaactctttggatgtctgcttcccacagcttgtgggagaggccccctcgcgacgcattaataaagattaaaggtccctctagttcctgtgatcttcaccatgtcaaagggaaagagtcgtttttctatccttctctctctgtcatttattaatattgcagggttttgctctaaaaagaaaaaaactcaggatgcctggagaagatgggtatgctgagcgcttgaactttaatattgctttgtcattttattgcttgcttgtgtgtgcagcagtcatcagaaatccaatttccctgagtatagagggtaggggtggccctttcctcgaagtaccccttggcgaaaaccaaagaccttttgactcggagatccccaagtagtcttggttcacaaaaagcagaactccctaagtgatcacgctcaaaggggaaaaacagctactggtcaaatccgtgttttctgagcacgtcctccatgccaggcaccggaccaggcacccacccgtagaccgacttgggcaagggtctcctctcaaagggcttgggctcctaatgagaacttatcttaaaccatggaggaggatgggatcctgagatacttcactgagttctgtctctctctctctcttttttttttaactcttattattctagaaacatatcgtgagtgttcaagtttcattcaacaactattatttgattccctgtgtggtgcagggccccagtgatacagagataactacgccaaggtccagtaaaagagatgagtaaaaagaagtgcataaccaggtgtcccatggagagctaaaaaggactcatctgagttcaaatcccggctcctcaaccgtgacacagaaaaaaataacatctacgttgatgagttgtagggcaaactgaacgaaagagtgtttgtaaggggcatgcacggtgcccaggagacagaaaatgtggagtcagtttactccgcgattattatgtaggtgaacacactcaggtataggtaagcccaggctaaaggagaacctaccgatagtgcttaggagggaagtcttcctggaggaggaggcacctgagttgagccttaaagaacacacacagctgagtcaggcacagagaaggagacagaccttacaggcagagggaatgcaaaggcagaggcctgagttagcctggcgagtttggggacaggtgtgtaattcatgtcatgatttcaatgtgtgggtgggtggcagataagagaagagaaggaagcaggggtcaggtcagaaaatgggatgaaggagtgaatgaactggcagatcactgatcgctctgcacctcagttttcccatctgtcaagtgaggatgtgatcgctgtaaccgcttcacaagatggcttagaatagcaatgagtcagccaggtacagtggctcacacctgtaatcccagcactttgggaggacgaggcaggaggatcatctgaggtcaggagttcgagaccagcctggccaacatggcaaaaccccatctctactaaaaatacaaaaaaaattggccaggtttggtggtgtgtgcctataatcccagctactagggaggctgaggcaggagaattgcttgacctgggaggtggagcttgcagtgagctgagatcatgccactgcactccagcctgggtgacagagggagactccgtctgaaaaaaaaaaaaaaaaaaaaaaaaaaaaaaagaatagcaatgagtccataggaagcagaacctgttatcaacacaccagccacaaagctgccttcaagagaatattgctagccccattttccaggtgaagaaactgaggctcagaaaagtgttaagaggcttggccaaggttccatgggagtgaggatggagacattgttcaaatccaggcagcctgcttcccaggcccatgaggccaccttgcctccaatcctagagctttcgtcctgtgacaggttctggacaaggtccccccacagctaggggactgtcagtctcggttaccctttcatttgttgacatgcaatggagccaattacaaaaactactctgccttccacctcagatgctgtggcccttcaccaaggaggcctccgacaaaacagatttgggatgacaggatcgcttaatatgctcgatgctcttaggaacagagcagggttctgttttcaatggcacaccctaggccccacacggttcaagtccacactgaacctcctgacatcccattcccataagcatgagagaagttggatgatttgtcccatgtcactcagcccagaaatggccatgatgggagggcaagtccacacttctcccacttcaccgtgtaatctccgactaaggaagaaataaatatgattccatctaacatgcgatctcaggaggctgcatgtaaatgttgctccccaggtgcttggaggagctacagagagtcacaccccatcgggtactgcctccgacgtacatggcagcctcagctccccattccacttccggactcctctagagactgataggagactgaatccaagcctgctctcaaacggtgtgcctgggagggtccgagcacggagttgattgatttcacggtaatagggcttagcaccaaggaacctgcctgcactcagaaagcatgtgccggcactgacacaggtcattggcatcacagccagaagtcactgaatgcccacagtacaccaagccctgtgctgggtactgccactgtatctcatttaatcctgtaacaatcgtctccatttttcacatgaggaaactgaggcacagaggagagtaagtcatttatcccaagtcacatagctagtaaagaagccatgatttaaaaaactttagcagagtaggttgtgagtgaggactgggatgagggaaggctctgggctgttatggggcaaccttgcttccacgtttatctaacaacccacacctcccagccctgggtgctttcaactggggcactttgtgggtgacaactgggtgaaacagccaagcgcacacgctgccccgccccgcccgcctcacctgggcaaggtggggggccaggctggtggaaggaaggccaccacactgaaagtagcagcgtctttgtgttgaggggagctcagcgcagtgtgctcaattcctcttgaatcacattggcaagaattccaggagcagcgtggagttgccttgtgattttccaagacagagagtgagaatgggctggaataaaaccagcaatcgaaagcagcatcggaaggaaaacaatgctgaaatgtgacatatgcctgtgcgcgcctggcactggagggctgaagccgggtgagcagcccgcagaagccatggtcacgggcccggctccaccagcaactgccccccggcaagggtagggggatttcctgtttgatttggaagggaatttggcaaatatttgctgagcagcccctacatggtgccaagtcctgtcatgagcactggggacgggagatgactcaggcatccctgccctgcaagagctcacggcctagtgagggacaatgacacataaacacagaaccacatacaagaaggtgggacaggtctgtgccagggaatgagagctgacctgggaggccccggcttgtgcgggtaccaggagcagagtcgtggggggattgtccccatctgctccccagaggaggctgggcagtcagtgcaagctggaagccaccagccactgggctactgtcctccctgcagctctggtggcagggagccaaggcgaatgagtcaggctcttctaggggactgcttactcaggcagccagaggcaagaggagctgtgagggcctcctctcgggggtggcaggctgggggaggggccgcgcagatattcaaggtgttccatctggctgctaaattccagcagttggcacaggctggcatttgaacacaggtctttctgatctcccaagcaaagcctatctcagtacatcagcatttcacctgtgtgcctgtgtccccgcaccatcccacccctgccattccctccctcccccggccccagaatcaccccaggtcctgcttctttggccccactccttcctggggccaggtaatctgctgcccctcagcccgggtcacaggagagaacctgggttttgaagccaggaagactccacggcatacccttcctggattcatgaacttgggcaaggtaatttgcctctctgagcctcagtttcctcacatgaaataagtaacgtgaaacagcacagtgttcactgtggagcagcctttgacctggttaacacactccttcctctcctttcccgtccctgagaagtagcatcagggtcgccatgggggacagccctctccccactccctgactccacgtggccctgtcccagcctcttttctgacttggtagggtcggagcttgtgctgtgggaagacaagttgctgcccaggccctcacccacaagaggacagagcccccaccctcccgctttcccttaataatgccatagaaatctctcagcaggcctgtgcctacacctagcgggaagcagttggtattttcagcccacaccgtcttagacttctaagggcagtcagtttcctacccactgtgtaatgtggtatttcctcctctgactccaatgcttctcttgccaagccacatgctggagtgaaagggcatacatacacttcggagagccaccgtctggcgctccctcggctcctataacctgcacaccccttccttccctcccagcgtcattgctgtccccaccccaataccaggctccatcttatcttcagtctctgcagggagccagtcctgaccacccaacctaaggagtcccttccccgcacactcttgccctgtccccacaccccgcctattccccctggagcactattgccctctgtgattacattatggtttgttactttgttcactgtcatcatgcccacagattgaaagctccctgagggcaggaacattcctgctttggtccctgcagtgtacccagcacctgggcaagggctggatacagatgtgttgaataaaggacggaaggaatttaaaaagagatggatgaggaagacaggcttaaatcccaccccaacacttagaagccctgagatagtaaattatctagcttctgagctgtattatccttatctagaaaatgggagaagtaataaccactggagggttatttttaaggctttctcatgtgtgaaaagcccagcatgcagtgcgtgcttctctctgctcctcttccctctcccaggccccatggcctccctgatgcctgtcactacctgcccttattggcgagaggaggactttcccttaatcataaggtagaatctgccttgatcttggattcttgtcttgatctaaagttcacagttccgggcaatcttccttcaaataaagactagggtattttccctctatacctgcccccactcaagttcatgggccattattttttcactcctgtggctttgtgaggtctttgttcagatttgtttcccagattggtttcttaacaatgcccacagacaacgtcagcagccctgatgcaaaccagtacctgctgtaatacttggtaatgatgcacttattatgacaaccttagaggaacatactggacaaacccccagaagtgaaaagtctctaggctcatcccccaagacacaaagcctgtgcccacttcacagtctcagtgagcctctctacagcctcagacactctggagagcttgggagtgaacggagattttctttgccccagcaccataaccacactaggattttactacctgcctggctcccgggggctccagagctctctgtgcctactcaatattctggaactacaagcctccactccctgagccatagcaaaggaaacacacagacctcacgacacttttgctcattacgccactgtccatttgcgggccaatcttattgtatccagaaaaaaaaaaagttctaggatttataaaaatgaaaactctgtaggtttttaaaaattataggcacagagtgtagatccagtgtccagccctatccagcataggaatcaaaaatttcttaagatgaactcctcaatccagagaagatttatccaataaaagcaattccggcccccgtgtcctccagccgggctcctggagcaacgtgcacacctcttcttctcccaggcagagccctcccgagtccaggccaggcccctctatctgacatgggagtagcatgagctttccagggctgggactgttttcctttgaggccggattccatatacccttaagtctgaccacaaattataatctcctctggtttctatccattgtggaactgaagacttgtctcactccttggatgcctgagttctctttgttcagttatccttccatgcccagagccactggatctctccggaagaaggcaaaaagtcaatgttaattatcaaccattaagatgcagacatctcatccatatacacaattatcccagcacaatcctagcaaacatcagagactgaggcaggtgccacatggaagcaacccaaccactacctgagagagctgtctgcatttattccacaaatcactgtcgagcacttctgtgtgccagatgctcttccgggcactgggatccaatcatggacagagcaaacaaaagtcctgaccctcatgaagggccctcattctactggagataggcagacaaccaatcgataaataaagcaaaatataggtcagctggagctgagtgctgcagagaagaattaaacaggaagggggccagagagcgttggccaggaacgccgccattttaaatggggaagtctaggacgcctcactggtaaaaacccaaaggaagtgaaggaaagagccatgctcatgtctggggcaaagtctcaaggcgaaagtaacaggaacgtgctgggtgcatttgatgaggtgcaaggaggccaaggcccctggagcaggtgaggtcagggacgcagcaggggccagagcagcttttgctctgagcgtcgtgggagctgttggaggactttgagcggaggaaagtcattttctggctggtgggtagagaacacaatgtaggggctggggtgaaagcagggagaccagttaggagcccattacagccatccaggtgtaagatgtggcttgaattaggggtagtgaaggcggtgatgagaagtggttggattcgggctgtgtgttgaaggtgaagccaacaagatttgcttattgattggatatggttcattagaaaaagacaggagtcaaaaatgagcctgcgtttgtaggccagcttagaatcctctactaacttaccaatttacagtctttcccttccccaaatcattcattagaaccataactgcaagggcccaataccacttcctggaaacattcatttcctaacttaaatcagtttctagaaatcataaggtgagtctatttattagattgttccatcctatactatctgaatgtcttcagtagcccttggttatgaacctaaagatatttgaaaatcttaagtgggccaggtgcggtgactcatgcctgtaattccagcactctgggaggccaagaagggcagatcacctgaggtcaggagttcaagaccagcctggtcaacatggtgaaaccctgtctctactaaaaatacaaaaattaactgggcgtggtggcacacacctgtaatcccagctactcaggaggctgaggcaggagaattgcttgaacccgggtggtggagattgcggtgagccgagatcacaccactgcactccagcctgggcaacaagagcgaaactctgtctcaaaaaaaaaaaaagaaagaaagaagaaagaaggaaggaaggaaggaaggaaagaaagagaaagaaagaaagaaaggaagaaaggaagagaaagaaagaaaagaaagaaagagaaagagaaagaaagaaaggaaggaaggaagaaaggaagagaaagaaagaaaagaaagaaagtcttaagtgaactgcacccattgatagcctcatttattcattcagcaaacatttactaaatacctaatgtgtgccagccaccacagtcttagctatgggctgaatctataaagggcgataaaacacagttggtccctattctgcataaccttgaggccatggaagggacacaaacatgtaaactaacaaattggcatacagagtggtaagtactaaaatagaactatgaagaaactagggtgggcacatcaacaagctagctaattgctagaggagtaaaggcttcacacaaggaggtgacgcttgatcgaggctttaattgtttaaccaagacctcaggtagaaaagttgatattctccttatagaaactattttgccataagcccagtaggctacatttgtctaaccctaacaaattacagacctccaagtggctcagttctgcaaagagtcacatatgaagaagtcaaagaataattataaaggaattccaatccaaactctacttataagagcattgaaaaggacacaatttctagcccacagagacatttctcacttctagagcctcctccagcaaacgccaaaattccccagtccggccccagcattctgttttcccccctcccaaatcacagctccgcttagtcaagatggacttgggtttcctccatcatcttttcccttttttttaatgcctctctgctcctatccacacttttcctgactctgcaaaacaaagattcggacaccagtttggcaaaaaactaaattaggataggaacagcaagaatacgtcccaaaacatttgcctaaaggagctgagaacttgttttcgataactagaaaagaaatgtaataatctgaagttctagaagatcctcatgaaactcttgtagatgaagatatctctgactccatagcaagtctgaattaaattggaacttttttttatgcgtctgaagttaaaacacctcttctcaatagcctgccaaatccggcttctgacttttgactcttaagagacacagcttttcccacagtctctcaaaatatatgtgccaaagagcagtgtcataatgaacttcttataagtatgggctttaaaactactaaagaggctgtgcacagtgggtcacacctgtaatttcagcacttttggaggccaaggcaggaggatcacttgggcccaggagttcaagaccagactgtgcaacatagggaaactctgtctctaccaaaaaaaaaaattaataaattagccaggcgtggtggcctacgcaagtgatcctatgaagttgaggcttcagtgagctgtgatcaagccaccgcactccagccggggtgagagtgagaccttgtcttgaaacacacgcacacacaactacaagaagaaagagaaacatggaataaagtatacccgcattcttagtacaaacagattgaagagggattaaaaaaaacattcctcaaagagaaagattggctctcttgagaatatggggaatataatttatttgaggcaggtgtggattttgtccacagtggttgcatgtaggaaagctgtgttcctttttttgttctgaaatcaattaactctaactctgaaagtaccccccaaatgcgcacatacataaacacacacacacacacacacacacacacacacagagacacacacacacacacacaaacacactgtacttaccggagtagcaaaaaaaaaaaaaaaaaatctaacgtctgtcatgttttcaagaggattcttcctctctctcttataatgtgggaatcctggaggtcttacaccatcaagaacctccaagaaagggtctgtagttcttcaggtcatctcttgcccatgccctcctggtcctgaaggtcccacaggcttggacacaggggactggcccaggctgggaacccagtgccagggttcccagagattccagagccttccatgtctgcagacacctgtggcctctgcagattggctcccttgacccgtcccaacccttggaactcttcttacttcagatcatccggctctgttgtttctataagccgaggctggacaccacagcctctggtgtccagagcagccaggcaggtgcctgacggaggaagcattccatgtggcaactgaggcacacacaggccccagcccgggcagcccccggtcagctccagccaactgaggcactgcagaactaaggtcgctaaatcgtccagtttttcaaaggaagccaaatattcaaagttttatgtgacatctcccaatttttcaatgttagcaactcatccgttttttgttttcttttgtttttttgagactgagcttcactcttgttgcccaggctggaatgcaatgatgtgatctcggttcactgcaacctccacctcccgggttcaagcgattctcctgcctcagcctcccaagtagctgggattacaggcatgtgccaccatgcccggctaatatttttgtatttttagtagagacgaggtttctccatgttggtcaggctggtctcaaactcctaacatcaggtgatccacccgcctcggcctcccaaaatgttgggattacaggcatgagccactgcacctggctcgaattttaaaataacaacaacaatatgtaggccaattctgcttgccaaacaacacatctctgtctttgcctacagcccggggggactccagcatggggactgtcttctgacggcaactttgcatcttagccctacagtcctaatgccattaacatggccctgagagctcttctgcctccttgggatggggtgtgaaaagtaactagagcagtggagacccagcctaaattaattgctcacagggtatcttgccacaggttctctcaaccaagcaacattactgagcacctgttatgtgcttggtggtggcttgctgggaaatggggatgcaaaaatctcataggtgtggtcctttctgcccttacagtgtcatgggcaaaagagtcatccagcaaaacagcacattgataaccatatagtccctactatgataacacccacagaaaacaggtatatgggggttttgctcttacagtggatcatgggagatttcgttcagggattcagaaagagcctgaggcctgagggtgagcaagacctaaaaggggtgaaggatgttctggaaataaaggaagaagggttttcatgtgaaaaacagaaaacatgtttgcagggtgagaagaaggcccgagagactgtactgctgagagggagggctgcagaggtaggcagggcctggagaccgagctaaagaccttgaccatcatcctaggctcctaggaagaaagcagtggggaatggcgggggaacacatgggcatgcctggagaccagctgggaagcaagttacaaggaggtgcctacacagcctggcggagagtggtggtaagaacaaggagagcagtggacaggttcaacatctatttaagaaacaggatgggcacagtggctcacacctgtaatctcagcactttaggaggccgaggcaggcagatcacttgaggtcaggagtttcagagcagcctggccaacacggtgaaaccctatctctactaaaaatacaaaaatattagccgggcatggtggcacatgattgtaatcccagctacttgggaggctgaggcaggagaatccctcgaacctggtagacggaggttgcagtgagccgagatcacgccactgcactccaacctgggcaacagagcgagactctgtctcaaaaacaaaagaaacaaaatagatgaaacttgaatgcagaggtccaggagaggttggtaagtgtcacggatgactcccagatttctgggtagttaacttggaggactcatttgttcaacaaatattgactgggcatctagcatgtgccaacctctattctaggcacagggggttacagtaatatacaaaaaaagacaaatattcctgccctcttggggctcactttctagtggggagagacacaataacaaaaaagtaaaatatatagcatgtttctaggatcaactaacataatttgcagggcccagttcaaaatgaactcatggagcaccttgttagaataagaaattattggccaggttcagtggctcacgcctgtaatcccagcactttgggaggccaaggcaggcagatcactggaggtcaggagttcgagaccagccaggccaacatggtaaaaccccatctctacttaaaatacaaaaattagctgggcatggtggtggccatctgtaatcccagctacttgggaggctgaggcaggagaatcacttgaacctgggaggcggaggttgcagtgagccgagattgcatcactacactccagcctgggcaacagagcaagactctgtcaaaaaaaaaaaaaaaaaaaaaaaaggaggaagaagaaattattaagaatttcaagatagcaacacaaagcgttaaaccaactacaaggttcttttaggcacagggtttatgggaccacacagtgtttgcatgcctagaattcagcctcacatgctacgtagagacaagagctaaggagaaaaagacatcaggaaagtggactagaatgtttctaggaagagaagtttgcaattttatatagagtgaacagggaagactttagtaagaaagtaatatttgaataaatacctgaaggagatgaatgacaaataatatctaaagaacaataaatagcagatatctagagaaaggtgactcaggtagaggaaacagctaacgcaaaggccccgaggcaggagtgtgcctgtggtgttttacaatggcaaagagggccaggcgcggtggctcatgcctaaaatcccagcattctgggaggcccaggcagaaggatcacttgaagccaggagttcaagatcagcgtggccaaaaaagtgagacccccatctctacaaaaaataaaaataaatagaatgggctaggtgcagtgggtcacacctgcaatcctagcactttgggaggccagggtgggaggattgcttgtgcccaggagtttgagaccagactgggcaacacagtgagacccccatgtctatttttttaaaaaaaatattagctgggtgtggtggcacatgcttatagtcccagctatacttaggaggttgaggcaggaggatttcttgagccttgggaggtcgaggctacagtgagctgggatcgaagcactgcactccagcctgagcaacagagcaagaccccgtctcaagaaaaaaagtaaaatagaatggcaaggaggccagtgtgtttggagcgagtccagccaagcagaaaggagtagataatgagactaatgaggtatcagggtgaagggaggcatgtcacatggggccttataggccactgtgaggacgttagccttgactctgagtaaggtgggagtccctgtagggttttgagcagagaagtgacctaacttgacctgtattttagcatcactcttccagaggctgagttgagaattgagtgaagagaggttggtggcagcgggagagagggcaagtgcagaagcagaaaggcaaaggaggaggccagtgccattgtccaggcaggagttggtggtggtgtggactgggatagccacaggagaagtgagaagtggacagtggttcttgagacacagtctgtattagtctgttctcacactgctgataaagacatagccaagactgagtaatttatcaaggaaagaggtttaatggactcacagttccacatggctggggagaccttacaatcatggtggaagacaaaggaagagcaaagggatgtcttacatggcagcaggcaagacagcgtgtgcaggggaactccccttttctaaaaccaccatatctcgtgaaacttattcactgtcacaagaacagcatgggaaaaacccaccctgtgattcagttacctcccactgggtccttcccaagacacgtgggaatgatgggagctacaattcaagatgagattcagttggggacacagccaaaccatatcacagtttgaaagtagagctgttggccgggcgtggtggctcatgcctctaatcccagcactggctgaggcgggcaaatcacaaggtcaggagtttgagactagcctggctaacatggtgaaaccctatatctactaaaaatacaaaaaaattagctgggcatagtggcgggtgcctgtaatcccagctactcgggagactgaagcagaagaataactggaatctgggaggtggaggttgcagtgagccgagatcacaccgccgtactccagcccgggtgacagagtgagactccgtctcaaaaaaagaaaaaaggaagtagagctgtcaggatttgctggaaacaggatgtgaattagcaagaagagtcgagggtgactctgagctttctggtctgtgcctctggaaggatggagctgccgcggcagaagattgaggccgggggagattgggagctccgcggaggacatgtcaccattaagacatctgaagtgatgatgtctagttgggaagacccaaagtgagggcagaatctagatgagaaaggcaaaagccaatttgctgaggctttgcaagtcatggaagggagttcaaatatttttcttggagacatgggaaatcatagaagagttttaggtacaatctaatttactttcagaagactgcactgaccattgagggaaggatggatgggagggttgaaagtgagaggactttgcatggcgggttagagataggggttaagatgaggatgatggagttggagaaaagggacagtgttaagacaagactcgctgatggatgggatatgatcggtattggagagagaagaaaaaaagcaaagaagattcccaggttcccattttgagcaaagagggttatggcagggccgtttactgagatggcaaagggaaaatcaaaacttcaatcagataaagaaatatttgttgagtaaagctacttgagctggaagtgatgaatggatgttcactcaggggccctggagagagaagggtgaagtaggaggtcagaaggtagatagttcaaggcagagagaacctcacatgttcccagtgtagacttgtctgggcattctgagtgaggttgtgctggaataggagaactgacggccagagggcaagacaagctagaaatgccggcaggaacctagcaagagagggtcgtttatttcgtgttacccagagcaatgggtgtctaggacctaccacgttgaattctgggtgatttcactgataaagaattggcagtatacgatattactctttctgttgcttaatttgcagagcatatgctctttttaaattttttatttgcatttcattacgggcttcttggacacttgccatgacttgatggaatcattttataaagagctgaatttatactgggtaaaagattgcatcatttctcaggttgatgagaaggacttgctggtagtcgagctgggcaatgttgttaactggctggtgtgcaccttcccaagaaccaaaaaatacatgtttgagcataaacatttctcctctggcttttgctttattagacaaagatctgacatttatccaagaatcatttattcattcaacaatatttttaaatccttacttcatgtctgaggagcctaagcgctgaggaaagagtagagagaaagcaatccatttcctgctttcatggagcttagacatatacacacgtatgcacatgtgtgcacatacacacacacacacaactacaaactgtgctacgcactgtgaaggaaaaacacagggagctaggagagtgtgtgactcaaggcttaactagcctggagagagagggatgacctggtaactatgtaaaaggggagcaaggaaagagcattccagccagaggcaacagggtgtgcaaagtcctgaggtgggacagcaaattgagataatgaaggaccaggaagaaaggcagggtagctagagaagattctcagaattgatgtaatcagatttgcattttttttttgatatggagtttttgctctgttgcccaggctggagtgcaatggcatgatcttggctcactgaaacctccacctcctgggttcaagtgattctcctgcctcagcctcccgagtagctgggattataggagcctgccaccacacccatctaattttcgtatttttagtagagacggggtttcaccatgttggccaggctggtctcaaactcttgacctcaggtgatccacctgccctggcctcccaaagtgctgggattacaggtgtgagccaccgcacctggcccagatttgcattttaaataacccttctggctacaatgccaataaaaattggaggagcaagagtgactgagggcagacctgggaggaggtcactgcaggtgtccagatgagagatgacaatggcctggaccaggatggggaggagagagagagagaagcggaaggctttttttgcaaagtaaatgagtaggacagatgcagctatgtaagggacagcatccataagaacctaaaatcaagatatgccagaatcattggccttattgatcatttgcaatatggctaatccactagaaacaaaagccctccagagctgtgagctggcagtgactgtatgatttgaataaagaatgtcaatgcctgcccctgtgatcagactgccatcccacaggctataagaaaatacaaagtaagggccctcatgaagtgagcaggacctagctcattcatttattctttccttcatttattattatgtgagaaatctcaaaacataaaaaatactatgggagcccagaggagagaagctcaatgtctgcagctgggagggtggggttgtggggagcccagggggaagaaaagggttgggggaaagctgatgagaatcccaagctgaagaaaagagcatacaactagaaaatctaggaggtgtggtgtgactggagctcaaagcgtctgttgaggaataagaaaatggctgttattccagatacgggttttacattttattcatataaaggaggcaattatctgctcaattttacagactaaaataggcttcttggatttgatgggattttaaaaaacaaatgtaactgattgcaaatcaatttttgtgcagctatagataaaacttggctgaggagctgctgataggagcaacgatagcgttcttttctaattcggatttcatcaccacttgaacagctcgcagacaaggtcttgtgttctgcctctgtgtactgctaaattttaattccagtgaactttttttttagtatgccaggcgtaatgtcactatctcaaacttgagttaggaaagagaaacattaaaggacagggggtaagtttcctcggctaatgctcaacaatacccataaaatagttatttctccataaaatgggaaaaaagaaatacatatataaccatggaaagatatttcccagatataggcttgctcttaaatatttcacagaaatctttacaaaatcaagtcaagccaatattttctatagcttttggggtgggtgagctcagcacataattttaattgttccagattatgtctatccccaacttcctttgtgtctgtttcaagctttgatttcaacctaatgttgttcaatctttagcataaattaacgcgaaggatgttctatccaaaaaagtctgactctatgcaggtaattttatattaaaatatgcatttgacttttaaagtttggatacacatggctgcttcttataatgtttcttttcacatttgtttatggaaatggaagttgaatgaaggggagggtgcaaaagtgaaagaagaaaccctttatgtgcatttcccattatgagattcctgtagctctagagatataatgtttcacaaagtgatttagtatccataaatgccaatttgcagagcattatccattgccgtcaaggaagaaaatatattctccctctccctgcccaataagtaaactttgaaaacaattacaagcacatgtaataataatacagaaactagcatttcttttttttttttgagacagagtcttgctctgtcgcccaggctggagtgcagtggcgcgatctcagctcactgcaagctccgcctctggggttcatgccattctcctgcctcagcctcccaagtagctgggactacaggcacacgccacaacgcctggctaattttttgtatttttagtagagatggggtttcactgtgttagtcaggatggtctcgatctcctgatctcgtgatccgcccgtctcagcctcccaaagtgctggaagaaacttgcatttctacagcaactttccctggagaatttctcggttgctttgcaaacagtaattaattagaccccctaacattcctgtgagggagccaagaggtgtgggtatgctttgaacaacccccaacactgactcgctgtcacctctggggttgatgaacagatgttgtttaaaaactgcatagcacacagaattcaacattttagaacgttaatgaaggacttagaattctgagatgcaacagagaattggatgtggtgcaggctttggtcttgttatgtgaatttgatagaaggatgaaagtaacatactgttttctatgtcatctgtcatcacagcatccaatgggactgcacttatcctatggcatgaagtaactctgccaggttcgtcatcctagagatgaccccattaccaagaaattttgccttaaggaatataaccaactttaaaaaaacaaaaacaaaaacaaacaaaaaaaaccacttatatagggcttattcaccaggcgctgttttaagcacttagtaactcatttgatcctcacagcaacttgttttggggtcagtattattttttattattattatttccattttacaggtgagaaaactgaggcatagaaagtttaagaaatttgccaaagtcattcagccatgctacctctcagtattagcattacctgttaataaacttgaacgcttacaaattgccacattttctcagcttgatcatgcagtttgtcttcgcaatctgctagaacactcatgtgatttaccaggagtggtgagtcagtggcaagaagccaatctgaaaagaaaaataagccccacttgcttcagcaccttggagagcatcttccaactactggcccagacaatagagcagctctcaaagacctagtgaggttctgctataaaggggtgaggctgagaacaggaagacgtcaagctaatggggattgttgctcctcctttctcttacaaagatcatgcttttatgatgacagaattaggtgtaggattttcaggccagttttagcccagttcagctggagcctgggacctcacagctctggttttcccattcttgggctattgggatgtctggggcctaaaagcagatgagctttatacttaatatttagtcctcccgttgcatatgggtgtgtctttcttttttttccccaaatcccttccaggagactatcttccagggcaattaagctttcaccgagggaccattgatgtactttttcagtttgcccataacagaggcagtgaagttcatggttagaacagagctctgagtttagactgcctgagaatttctctcaactctgccattttccggatgtaaccttgggcaaggtgcttagctttattaagccccagttttttcatctgtaaaatggagctaataatggtaactgagtcatgagattgtcctaaggcttaaataaggtaatatggttagaaaacacattttatcatgagaagaaatagggactgtggtgatgccccttcttgaacaataagattcatgtaactgacatacgttccctctctgctttggctgtcagggagcttcggttgcacagagtagcattagcaacactgtgagatgctaagacctgcccattggtgtttctttacttctcctccagtcctgaccttcccttctgattagcatattctttgatcctttgttttgtgattgtattatctgtgtcatttcaggtcactgcacatgatggatagatagatagatagatagatagatagatagatagatagacagacagacagacagatagatgtagatcattagaatgtaagtcccaaataagcaaagagttttgtctattttgttcatttctatatcccaaaggactaggatagggcacagcatatagttggggcttaggaaatatttattggagagagagagacagagaaagagagagagaaggaaggaagaaaaggaagggaggaagggaggaaggaaggaaggaaagagagagaaagaaagaagagaaagacaaaaagggaaggaaggaagcaaggaaggaaggaaggagaaagaaaggagagggaaggaaagaaggaaagaaggaaggaaggaaaaaggaaagaaggagagagagagaaagagaaaaagagaaggaaggaaagagaagagaaagagagaaagaaggaatgaaggaaaaagaagataaagagagaaagaaggaaggaagaaagggagggagggagggaagaagggagggagggagagaggaaggaaggaaagacctctcttgccaatttctttctaccatctgaccacacaactgtttcatggcttgctttgaaaagatcactagacaccccttcttacttgtcacatctgcccataagtgatgctcaaaataatctctttacttaaatttgctatggtcactaactcagtagctttgcatcggtgctgggttagctgtctgctaccactatcctaattatccatgattacacaagtctttgccaggcaaacgagctgcaggagaagtttcagtgatgatgcttctcacagtgtagtctgtctttcccctgttgtctaaggacagatgaggatgcagggcaggagactggttaggaaaattcctcatgatcaaaataaccaatctcgaaatctcagtggtgcagatccttctctaaaagctaacagggctttactgatgcaatagaaacaacagtagtaaaattagttgcagcagaaacatgcccttctgactcagagacccagtgtgtgggtggagctgtaccatgtatctaatgaggaaattcccctgggaagggctggatccttccctttgacacagccaaaggcttcagcactgctaggtatttgtgacagattactaggcaatatgaatgcattgggggtggagtggaagaaacggtcaaatccccaaccagagcacagcagctaacacagtttccaaaccctctccagctgaattcaactagcatttattgagtgcttactatgtgccacggccagagaattattgggtgtgttcaatttccaggcatttgatttggaaaagatgcttatacatgcccctctctccccaacctcctcccctcgagctgacagccttggccttgagatctttataccctcccaagtcagaatcagcttcccctccgatttttggaaggagtccagtctaccctcttctctctctcagcagggatcatataaacagcaattccaaccaggcagggagcgcttgtctttcattcccttcaggagctctcccagctctggtcttgttagaaggatctcacattggaagtctccctgggaataaacacatgtttctgataatgctaaagattaagccaatgaaataaaaattcatttctgagacatgaactgtaaatgaccaggattttccacagaaatattggtactttggcagaggctcggcaaccctcaagttgacagtaatttgctgccgtgtgccaggcaagtcctgaagtcattcaatagacaagacatcatcaaataccacatctaaattctgttcatattattagaatgaaaagggtaatgcaattcaattgcctagagaatcgtcgtacacacagacctaaacagagctggccagagacaaaatttcttagcaagtgaagtttgtctacagggcccctggcttgccttcctccacccttccaactggaccttttccttgtacaggaatccggtgtgaattaaagtcaatgcgttgcccctcccaagggtatttgtgttttaaatgaactctctaatttgataacaagggaattaaaatttcacatttgtcaaatacctaccatgggccaggcacattttcacaagcattgttcatccttactgcctactgggaacttgttcatttgtgcaagaaacatctattggctatctacactgagccaggcactgtgctaggtactggagatccagcagagatcaaaaagataaagaccttcccctcgtgggctctgcggactaataggaagaaagaggcaatcaacaaacaaatgcataaatgtttatcaggtggtgacaagtgctctgcagaaaaataaagcagggcaaggggacagagagtgacagaaagggatgctgtagaagatagggtggtcttggagggcttctcagaggaggcggtcattgaacagagccctgaagaaaatcagccaaaaggcatgttgctatgttgaagacaggacattgcggtggggagtactccaggtcgagggaacagcaaatgcgtaggtcctgcgagtccttggtgtgccccaagaaggagacagatgggagagaacagcgtggatgaggtggggaaatggaggaggcaggagcagggaagaagaggaggacagacacggaagggcttgtgggctgggatgaggactctggaatctaaactgagggacatcaggagccactggaaggtctaagcaaaggagcgaccttcattgacttgggttttcagaagctggctctggctgctgggtggacaggctgcacaggaacaagcgcggaaacaaagaggccctttgggagacagctgcagtgacctgggaaggagtgagtgagggaaggtgatgctgaaggctcgggccctaccttctgcagtgggtcttatggttcccgtcctgcaggtgaggaaaccgagatgcagaaagggtaggcagtcagccaaggccagctggctagtaagcagccaagcgtgagccctgcaggctgtccagctgcagaggcctgcctcctagcccctgccacaagcttcctgtgaccatgcggagagaggcactgctcctccgtgaaggaaacttactcctcagagagcaggaagaaggatttttggaggctgaggatttttctgggcccttgtaatctccctccagcccttgctttgaaagggttccatcaagaggaaatataacaatcgtcaacacttaacaggcttttctgtggacacagcaggcttctgagtcactcctgcttgtcattgcagattcctcacaaccgcccctgtgaaggagccgcgatcttcattcccattctacacatgagaaaactgaggcacaactatattaactggccgggatgatagggctgggatatgaaccctggaagtctgggtcccagagtccctactcttggacatggtaccatttcttccttgaagagctgctcacttttgatgtggtgctgaatttcggacttggagactgaggctcatgctgctgatacacactgaaactgactcccattgacaggaactcgggagacactggagagtgtccctgtgggggctaaatggcccctcctcaaaaagtgttgatgggggcttcctgcccagggtagaagacagatgacagggcctcagggttcccatctgtctctagggagccagtacctctctcactgtgtatcactggctcatccatccttgggcacaagccttccagatgtggggagagaagggttgagcagtcattaatgaaaccacagctgccaactcccaatttcatttgatggatgactgagatgttcccaacccttcatccttcccagttttgaggggaaaggggtaaccagaggaacaggcttacatggagaggacaaggatacaaacagagatgacacagggaggaggagtggacagaggaggttgggttcccaaaagacaaactgtaccattctgggaagaagagagggtgctgtgtgcccctgaagggagagagagaaatggaggacacaaattcacaaaatactacaatcccagacccacataagtccctctttgctctcacacttccctctacccaaaacgctttcccctcctgtccagatgcctctgtggcactcagttataagaccttccctaatacctaccacttcttaggaagaactgacctaacttccctttatgccccttttgagtaatcatcataaacaacaacaagatctctttattgaacttagtttttacgtactttttatttcaatttcatatcaaaacagccccacaagatgggtgttgttggctccacttgatagaggagacatctagagctcagagaagtgaagtgaagtgactttcccgaggtcacacagacgagtaactggaggatccacgatccaacctggaacacctgcctcagaagctcaggccttggcccttacatatctacccctccgccggctgagttagggaatggctggcacattttctcagtcacttttgcatcttcagcacccagttggtgcttagtaaatattgatgggaatgactcatgaatgaataaatggatgaaaactgagttataatgaacaggagtctataaatatgctcacatgcacttacatttgcagagacaatgctaacagttcttgagaaccatttttttattcaatataaaaagtgcttattggaaatgtactgtgtgtgaaacgctggggatatcgtgggaagcagaactgtcctggtccttaaccttcaagagcgcataaaatagaggaggagaaaaactaaaaacagtcaacaatatcacaaatggaaatgtatttgcaaattattaaaaagtgaagtaaagagtgcagggtactaaagagaggagtgtggttagacagagggggccaagaactctctccaagtgagaaatacttaaggttgaatggaagtcatccagagaaaaactgggggagagtgttccaggcagaaggaatggcatatgcaaaggcaccagtgcaagactaagagcttagagccttccagaaagtaccagaagctcagcatggacaaagcaaagagcaggggcaatggaagcagacagaggtagagacacaggcagaactagaagatgcagtccctcgtgccctcaataagtgtcctggattccagccaaagggccatgggaagcctctgaagggtgtgaagcagggaagggacctgcgtcaatctgctcctgttctgtgggcaatgcgagcagagaaggaagcaagaaacaggcagaaagactggccagtgcaatcatcccaatgggagtcgcctgggccataggcagtgatgagaaatgggtgggtgcgagatccctttggaagcaggaaatggaccaccaatgatattgacataactcagacaggtccacacatgaacccacagaggagtaaaggcagtatggacttcagaaacagacaagattctttttttttttttgagatggattctcactctgttgcccaggctggagtacagtggcacgatcttggctcactgcaacctccacctcccagcttcaagccattctcctgcctcagcctcctgagtagctgggactacaggtgtctgccaccatgccccactaatttttatatttttagtagagacagagtttcaccatgttggccaggggctggtctccaacccctgatctcaagtgatctgcctgccttggcatcccaaagtcctgggattacaggcgtgagccaccgcacctggccaggaaacagacaagattctaatccgtcacctatcttccatggctgtgtggttttaggcagctcaccgacctcttgaagccttggtttcttcaactggaaaataagagaatcagcctccccaggacgattgtcattgaatgagatgatgcatatgacagtgtggagtgcggtgagcctctccaaacaacccaacctccctttgccgtctccagataccgagagcccgacttccaagctgcccccctgatcactgggctctactgcctacgtaaacatttttaaagaaaatgaatccccatatactccatgccaaagagaaaatgcaggctggccttgctaggaaggcttgcaacagcctgccaaccttgttccactaatactcgtcagtggccacagtctctcatcacttgaacagtaactcaattaccagtccctgggcaccttcaggcacaaagcctctcccatgggtccccattgtttttctgagaagcccaggacacaagtcaatttcttggccctactgagagcttttcaccacctgacagtagctattgagcatgtgctaagtaaatgcagtcttaaggccacccaggccacttcccaagacaaaggccctagccagccaggaggtgcaacatgggctctggcaccagagcctcacacagcagatgttgctgccttcaaggctggcccaattatgatgttaacgccctggacgttaatccctgggtccttgccagccagaacctgctctgctctctggtttaataacacaagtcctctggagggatcaagtatggatcttgggaatgccacacttttaactggtcagattcaaagcccagcttcttctctgcattacaagcaaggcctgagatttccaagtattttagccacgtgaatgcctgcctacaccgccacagggcagtcggtaaggattgtgattgcaactgagattcagaaaattaaatgtctttctcaaggaaatagaagacattcatgggaactccttgaatacagatttgctttcctgacactcagatttctgagacttgttaaataaacgagaagttccacgggggtacggtaaatagcacagtgtctggcacagagtaaacatttttggcatgcatggctagtcctgattcaaattcaatatcagatctatgatgtacagttcaatggctcagttgtttaaaggtaaaatatccactctgcattatcagggacaatttcttaacatctgttgcctcaccatctagaacactcctgagccatctttccccctgtccaggttgtgtgtatgccacagaagctggtcccgggggaacctgatctaggcgcaacatcaaggagggcttccttgaggtggttgagtctatgagaaacggatggcatgtaggtgtgaagctggcactggcgcatttgggggttggggaaggaacgggcttgtaaagtgcattctgagcagagggaacagcttatgcaacatcccggggctggattatggagaaggaggtggaaagggatagaatgggatgaagatggagagagaggcaaggctcagacaatcaggtactcagtgggccatgttaagaatgttggtttttattctaaaagctgtgggaagtcattgaagagttttgagggtgagaaacggcaggagtgaaatgatcagatttgatctcgaactgcctggagaaaagcctcagaggtatgcagaaaaagcccagttgcgaagctataccacagaacgagatgcaaggagttagtggcttaggccaggaaggcagcagcagagacaaagagaagaggatggatttcaaaattttttaggacctaacggattggatgtgaggatgagtgaaagggaaatatccaggatgactcccagaatcctgactctcacaactggacgtggtgagcaagagatgctgggaaaagaccacattggagggatgggaggtgagcgacatggagaagggagtggatcatgagcttgggttgaggtgccttggagacagccaagtggcaacaacatgtagggagttggagatacgggaaactccctgtagggagtttcaagataccagggccagagttacaaatgtgggagtcactgatatgagggtggtaactgaagctacagtttcctgggatttcttcgggacagatgacatcaaagggatgtaccacaatttacttaagccttctcccactattagatgtttgggttgtttctgtcttttgacatggtaagtggcccagtaacaagcatctttgtcctcgtttgtagcttttttccatattctaggttaactctctaagtagctgacattactaacatggttagcaatgaatacctgctaagagaataaatatatatgttcattctccccagaataaaatagaaattcttttttgattgaccatttttcttttttttttttttttgagacggggtctcgctctgttgcccaggctggagtgcagtggcgcaatctcagctcactgcaagctccgcctcccgggttcacaccattctcctgcctcagcctcccaaatagctgggactacaggcacttgccaccacacctggctaatttttttgtatttttagtagagacagggtttcaccatgttagccaggatggtcttgatctcctgacctcgtgatccacccacctcggcctcccaaagtgctgggattacaggcgtgagccactgcgcctggccttgattgaccatttttcatcatggcctgtgtaacttctttcttccaatatctgggtgatttattaagtcttccctaaccaggccaaccaaagggaccttcttcctctgaattctcatggttaatcccagagacattcactccaatcttatccttcagaagcctgatattttaggacatatacacacatgaaagataatggtcttccccactatataaacttgagatctgggactatgttttatacttcttgagtcctcctcagagcctagcaaaacctggcacaagatctatgtgtaatgattattgcagataactaactaagcaagaggatagtaagagctaatctattaaacccctgctatataccagacctgtcctgggagctccaaaaaacaaagtctatttcaaccctcctaaaaaaattttaccagtgttttgcaaaggtatcagggtaatggtatctgatataataaataaacccccagatcacagtggctcgattcatagaagtttatttctcactcactttaagtccaaaacaggcagctctcctccaagtattgattcagggacatatgcctttcaatcttacagctccactgtctccaacacacagcttctgaagtcaccatgatcccctgcctcaaactagaaggagaaaaatcatggcagatcatctaggagaggctgtaatgggtaggcttagaagtgacatacatcccattcatcacagccactggtcagatcccaggcctgtggtcacacctaaccaaaaggaagcttgagaaatgtggtcaggcagagtgctagactatagggaaaacagccttaggtggttcatagtagtctctgccacatgaagatagaaagcaaagcccagagatgctaagtaacttacctgacgtcactcagcctatacacaactgaattagaattcactgtcaagtctgtatggcttgaaagtctatgctttttttcaccacatcctactgattggcaaccatcactggggtcctctccttctggggtggcctctgagctgcatctatttgaatcatcttggcaattgtttaatttcatgtataacccaattccaaactgcagtgagagcgacagatccaccgaaaccgactttcagatgtattttgcagatgcatcctccatttatttcaaatgtgttactggcttgctgctttaacaagtcaatcaactcacaggcatgcccttgcagtacggaggtacatattcctgttctaaagcccacgtcttataaacttgacatattcagatgctatgccttttatcgtgagtaaattaagctcttaaaatgtcagaatgtttttgtttcatttgacattctcaccataggtcaaactgcctccaaaacagacatgtctaaatagctgtctaaccatatcgctcagaatgactttttaggaagtctaggacatccaggagtgtggtgatcctgaagcccttgagcatcagtaattctgtttggatccgttcccatgtaagcaatttacatctgctgtgttatggatccagaggttggaaaaccaaaagggatcttgggaagtcattggctctaacctttgctttgcaagcataaaccttagaaccttaaaattgggaaaaataatgacattaggaagaacaatagcagttaccctccgtgaatgcattcattcaacacatagttattgggaacccccttagtgccaaacactgttatagaatctgaagatatggagctggcattctgatgggggaaagagtggatgcacaaataaatataaaatgagttaggtgttgatgcgtgctttgaagacacataaagtaagaaggatgcagaatgatctgataggaagttgtaaggttacacagagtggctagggagggtcactctgatatttgagcaaagacctgaagaagtgaggtagtgaggttctaggtagagagaacagttagcaaagaggcttgaagggagaatatgctggcgtcttccagaaacagcaagtagattgggtgagctggagacgtgaattgtaggagaggtggcaaagaagattgggaagggggatagattgggtaaggtcttatagcccaggaaaaggatgctgggcttcacttgggctgagataaggaggcttgaagggtaaggatagctagagaagagaggtttgaggatgaagacctgggcactccaccagttaggggtctagaagatgaggaggaatccacaaagagactgagaaggagtagccagtgaggtaggaagagaaccaagcgagggggtgcccgaaggcaagtgagaaaggggttcaaggagggagtgagcaaccaattaaatgccactgatgggtcaagtaagatgaggacagataactgaccatcagatctgacaagcagaggtcactggtaaccacatcatgagtcatgagaggatgctggagatgaaatactaatgggagagagagagaagggggaagagaaaagggattgagagagagagagagagagagagaggagaggagagagaatctcctagtattagctgggcatagcaaagtttctttacatgaatttcccaatttaattcacaggaccaacttgatggcagggggaaggtcagttgttttttcctttttacaaatgaggcccagggggatcacgcagctcctacgtgtgaaagctggacttggtcttcccgtgtgccagaccgcagagctcccctcttctttcctcagagcagcctatgtcttcgagagaccatctggggcagccgacataaaatggattctcattttttaaaaaaaaaaagtcagaaaataggtcattcagcttccctttgaacagtgcctgaatcactctaatgattagcatctctcctttcgagttgtaaatacagaggttccatcatagtccacccctgtacatgaccacacagtgtggcgtgttcttcaaggaagttcttcctttcattactccacttctttccttattaaaaataaaacttttctttgaataggaaaatgattctgattcccattgaatccaactctcagaagggcatgagcattggagtcctttttccacctcagactctagcctgaggtccagccctagccagagagcccatgtctctgctggaagatccatctggttgtcccgctggccctcatatctgttgagatgctttgagttgcaggtaagaaaacacaacccaaactggcttcacagtaaaaaaaaaaaaaataaaaagagttgctcacataaccgggcagttccagctagtttgcctgtttctcttgctatcctgaggctgagagtgagacaggacagtgccttggggccacacatccacaaaggaccagagagagtcactctggatgcttttagataaaaacaaggaagatactttctcagaaggccccagaaaacctttcctcctgtctctttggcccaagtgggtcacaggaccacttcatgctaattattgctcagggataggttacctgcctggacaggaagaccatcctggggctagggtggggccagcttcccctgaaggacactgccgacacagaggtgggggctgagaggcagttgtttcacaagatcagtgtcctgtgagaagggaggaagggtcacatgcaccccagggaagtgacacaccacatctcctacatctgagtccataactgaactcgccttcttcaccttcctccactgcattgcagtggatgaaaacaccatctgtgaacttccagaacccagggaacaggagctcccttgtcctcgcctctctcatctcacacgtgtaccgagttgctgcatcctgcatcttttgcccattaaagagctcaagagggccgggtacggtggctcacgcctgtaatccaagcactttgggaggccgaggcgggtggatcacgaggtcaggagttcgagaacagcctggccaacatagtgaaaccccgtctctactaaaaatacaaaaattagccaagtgtggtggcaggcacctatagacccagctacttgggaggctgaggcagaagaatcgcttgaacctgggaggcggaggttgtagtgagccaagatcgtaccactgcacaccagcctgggtgacagagcaagactctgtctcaataaataaacaaatagctcaagaatctgtccacatctctccatcccgccttactcaggctatcaccaactctgcctgggctatgacaacagcatcttaattcatttcatctctctgcttcccaccacatccttccatgcaaacatctacactggaagctcatgtctcaaaagataatacccgacagtgttgcttcgctttgtaaaggccttcagggtctatctgaagcttcaaggtttgggttcagctctctcagggccaacagggtccttcatgacctctaccttcccctccagccaccctgtacctctttcaatgaacctggatttatgccatcctgaggtatattagattcccaaatgcttgctgttcctgactccaagcaaaattgctcttcccctcctagataaatggtcaccatccatctggtgctcaggtaaaaatcctgagagtcatccttgattcctcttcccttcacccatgacatcaaacccttttgtggataaggttgactctgccttcagaatatgatcccaaactgccatctcctgtccacgcccacagcttctacctccacccaggccaccaaggcttcccactgggtctgccacaatacctgaccaactggtctacctacccactgccaccccttacaaactattcttcaggtcctcagcagagcccacagtgctacatcatctggctcctgcttacctctgtggccacatgaccccttcccatggtctccctcccgcactgccttcttctggtcctcgtcgacaccaagcttgtctctgcctaaaagccttgctgttccctctccccaaaatgcacttccccgggctttgcatgactgatgcagggggcagcatggaaggtgatttctctgagatggactccctggctacctttacgcccccatgccctcgcatcacattattccttcctgtaggctttgcgacacatcaccatttgaaagcctcttctttgtggattcatttgtttacttgctcactctctgttcccctagaatataagctctctaaaggcagagactttctctgtcttcttcactgtgtccttgggaaacttgggaacttgtgcctggaacccagtaggagctcaatatatgtgctgaatgaatgaatgaatgaatgaatgaagtgaatgaacaaatgactgttctacttgtctgacttgtattcttctcacctggccccctttacctgcctaactccttcatgtccttcaagttcaggtctgctgatcatctctctctctccctctgctctctctctctctctcacacacacacatacacacgaacacacacacacacacaaacacacacacacagttagttgcccctctcctctatctcccacaataacacccagcatttactgctcactgtatgtaacactttgcattatggttatggtccctcccccaagctctgagctccctggggatggggctacatccttccactctgcatctccatcaccagctcacagcctgcccagggaaggcactgggtgactgcctattgagtgaatgaatgaatgaatgaacggtgaatgaacgaatgaaggaagaatgaacatattcttcaccagtagttaaggcttcggttattccttaagatataaaatcagatccgtcttacccaactcactcaatcagtctccaagtttgggattttgaagagcatcctaattccctcccaatgttcccctaagtccttattcttgccgtaacaagcaaacacttctctgaatcattttggaactggagcctccctcaacattgtatttctgattggttgctatctgttttgacagttgtcagtttttttttatttatgccaagctctccctggggtttagttccctgaatcctctcaatctagtgcctagaaagaagagaaaatgacttacctctaaatcttttttattgaaggtgcaccataaaacagatcctctttcacctctccactctctcctgagatttaaggattcttggcttttattgttgtctttacccctcatttcaaaagaaaaaagcagtgggggttggaggggcttattatatccacctagaaggaacagcaggattcacactttcctgccagtgaacccaaacaatcagagctttctaggggagttcttgacagtttcatgccagaaacacacaccaagctgaggacatttattatatggcacacatccatggaaccgaaattacagaccattttctcctacctgtcccttccatttgatttctgggaaatgtccacggataaaaccaccaatttccactaggaaagcagaaccctaaatataaataagaggggacttctggggctcctacggagagaaactttcccttgctcgttataactagtgtttgcacacatcgtgcagagcagaggcatttgcaggaaaagaatatttcagaaactcaaatgaacattccttcctccagttacccttactccctctctaatatccatctgggcaagggtgttgattaaggtcaatgcaaagtggctttatgttttgctctattttgtctctgcatatgctagtcactgtgtacctttcaaaaacatctcgtccccaactatctattcctttttataaatagcacacattattctctgattgtataagcaaaacatgcttattataaaaacttgagtacatacagaaaagtatatagaagacttaaaataattcataacgttctcgcctagaaataatcattggtaacattttagaagaaatactgaaagttatttgccttttttctgtgaatgtacatatatgtatattattaggattcagttcatattgtatgcacaattttctcttttttcttaacatcatatcaaaatgtttgcaagtccttaatctttgaaacatgactttgaaaacataatcatattttgttagccttaaaatccatcctagataaaataaaaccaaagaagttatcaggtgacaacagttaccctgaagtaaacaagtgagtctaaaattcgaaaatcagagtcaattgctgggcatggtggcgcacgcctgtagtcccagctacttgggaggctgaggcgggaggatggcttaagcccaggagttcgaggctgcagtgagctatgatggtgccactgcactccagtttctttaaaaaaaaaaaaaaaaaatcaaagtcattcatgctaactgcttttgagtggtctccatggcaacttgccaacaggcaagactgaggtgagtttaaggcagctaagcctgagaatgtaaaattcaaagtccagctgtgggtcaccgttatctctagctagtgggttgacaagcagtttttgctttcttgattgttcctttctgtacagactatatgtgttaccgtgagcatgccctgcttttaaaatcacaaacaaagtataatgctattttcattttgaaaccaaacaacacctaattatgtatctaccctgattctctcattcattttctctccctctacacacacacacacacacacacacacacacacacacacacacacgtccccactctcatccacttcccactttcacctcccactattccaggcacataggctccacccctacccactccttcctccttcccccaggtcctagatggggtcctagatgggaggggagggagtggggggctttcatctgattccccagtctcttcatatctggctctagtttactgtctcaagcctgatgccaggttgtctcctcagaggagtgacagactttgacagagacaggctttggaatcagaagagctctgtcacttcctatctgtgtggccctggccaagtcacttaacctctctgaacctcagtttcctcttctataaaatgaggataaccagcttggaggattataccatgattaaatgaagtcggcttgcaccgaataaatgcctgtcaccccatactatactgaccatctttggggtcttcgttttactctaaagctgtcagtttttcctctggccaagactgaggccaagatctccctatgtatagctacagactcttaatcaactgggacttttctgcttggataaagtgacaccttttaacattagagctggaaaatctcccaaaagcaaaccattgaagagacagaaaccaaaatatgactcgactctttaaaaagctcctccctagttgtttaaggttctcagcttgcctttgcagggaaatccacaaagatctcataaatatggtcttcactgataaagaagagaacagaccaatgaaaccctgacagtatctattctctgatcttacattttgtccaattattagaggaggagcgggaagaaggaggaagaggaaggaagaagaagaggataaaaataagaaatggtggtatggatcagatgattcttttaaaagagaggaaaaaaaaagaagtagtcaagaatgaggtaggtcaatgctgttatgctttgccggagaagcaagcttggatcgaacatttaagtgactctttcagagactaaaacaagtcagcatcagaaatagggttagaatttggagctcacagttagtctgcaactgatactaattttaaaggtgtcgccgggtgcggtggctcacgcctgtaatcccagcactttgggaggcccaggcgcgtggatcatctcaggtcaggagttcgagaccagcctggccaacatggtgaaaccccgtctctactaaaaatacaaaagttagccgggcatggtggcgggcacctgtattcccatctactcgggaggctgagtcaggagaattgcttgaacccagggggcggaggttgcagtgagccgagatttcgccactgcactccagcctgggtgacagagtaagattccatctcaaacaaacaaaaaaaaggtgtcaatgcaaaaccaggtttcaaggtagctagctcaatctgctaaatttttcatgcctgtgcctttaaattcccaagcagcattgcctgtttctgagtagcacttgttctcaatttttgtttttttccaagaaaatgacttgaggtagaaaagcacatacagtcaaattatcttctgaaggttttatgaaaaattatttttttaaactgtagttaaagataaacacgatttctccaaagctgagctactttatcaagtcagacaaagcataatacagtttccttttaaaaacccaaattagctgctatcatcggtgatgatctggatgtgatacattacagtttgcagaatcaagcagcctactacatacttggaagcatcgttcattcgctggacaatacttactgaacacagagtttgtgagggtgttatctagaccctggggacaccaaccaaagcaaagaaggggtagcagtgccctgccctgaaggaccctgccctccaacaagagaatgggggtgggaggacatacaaacaacctcaaggcagaatgtgatcaccaaattatagagtgaagaaaggccatctcatccaaccctcgattgaaatgaggcccagagagtggatgcaacttgtccaaggtcacacagcaagttagtgggagagccagaatgcattttcagactctctatccagcgttctctcctctgtatacagaaactattttaatttttgaaacgtcctgcattctcctgccagggattgcacaaagcctggtggagcctcagagatgccttattgacaccttttacattaggaccctaacctcaaagaatgttacatctggaagggaccccaaggattaatctgtggttctttttttttttttttttttttttttttttgagacagagtctcactctgttgccaggctggagtgcagtggcatgatctcggctcacggcaacctccaactcactggttcgagcgattctcctacctcagcctcccaagtagctggaattataggcacatgccaccacacccagctaatttttgtatttttagtagagacagggtttcaccatgttggccaggatggtctcgatctcctgacctcgtgatctgcctgcctcagcctcccaaagtcctgggattacaggcgggagccaccgggcccggcctaatctgtggttcttgatcaagagggtctctcaccccagagtcacagaatccaggccctggggttggggataattcaagccaccttgaaggtgttcattagacctttcccaaagaactaggggcaggtttggaggggggccagcaagatgaaagggcaatggggaattcagaaacaggaaagaaaggagtagaaagatatgcagggagggagacagtttaggctggtcttcactggcagaagttttggaggcagacagacctgggttcaagtccaggctctgaccctcagcctgggtgctgtgggtgagcagcctgacctctctgggcctgttttctcatctggaaaagagagcattcccctacctcataggtttgctacagggctcggggcactgacggggaagatgtggggtgcctggcatgcagtcagtactgtgcgaaggactgccattgctctcaccaccaggagcaggctgggaaggtgagagaagcctctgcctggttcacggctttgcctcgggccatccccgctgcctcccacacagactccaagcatttgctggtgctgcatgatttagaaatgattctagaattccaaatcatgaattccagggaatctggtcccctgatatctgaagctcaaaggcaacaaggtcccctctcttgggatccctaaggctgtaagaacagatgcatattaatgagatgaggtgaggagtcgccgcttaggaactgtacagtctagaatctgcaagccaaaaggcccttcaagaactttgagaccaaccccgtcttggaggcccagagaagtcaagcaacttgcccaaggtcacacagagcattattggggttaatgagactgaaccccagtctctccatcctgacagcagaaataataattgggatgacaagaggactcaatgaaattttgctgtagagcattttgcacactggcccacaaatgtcttaatgaatgatactaatagtagttatcattatcatttttattaccatcgtcatcatcatcatcattattgtcagtttttaagcaattccccctagatgctcagctgagtccctttcagtggctcaaccctcactctttcagtctcagtctttctgtgtcaattaccagctaacgaagtcaccgggggcagactctggccaggcactcttgtactaactcacttggtgctcacaatgaacgcaatcgagtagatattcctgttaccccattttccagagagggaaactgggcacaggacaattaagccatatgcccaagattacaccagcaggaaggggcagagctgtggttttagtcgaggctctctggccccagcatatgaatgccaaatgcaaccttccctcatcacacttccaaatcttctccagagttatgcctccattaataatccacgttctggactgggcatggtggctcatgcctgtaatcccagcactttgggaggccgaggcaggcagatcacttgaggtcaggagttcgagaccagcctgaccaacatggtgaaaccccatctcttctaaaaatacaaaaattagcccaacatggaggtgcatgcctgtaatcccagctactcaggaggctgaggcaggagaatctcttgaacctaggaggtagaggttgcagtgagccaagatcgtgccactgcactccagcctgggagagagagagagagatcctgtctcaaaaaaaaaaaaaaaaaaaaaaaacccatgttttgaagactgaatgagaaagaggacttgtcttacctttttttttttaaacggagttttgctcttgttgcccaggctggagtgcaatggcgcaatcttggcccactgcaacctctgcctcccgggttcaagcgattctcgtgcctcagcctttcaagtagctaatattacaggcatgcgccaccaccccaagctaatttttgtattattggtagagacggggtttctccatgttggccaggctggtctcgaactcctgacttcaggtgatctgcccgcctcagccttccaaagtgctgggattacaggcgtgagccaccgcgcccagcccttgtcttacgttttaagtgatttagtgtcagagcatggctggcatgtaacaggaacctaaaaattgttccctccctccccacagaggtccagagccgaatgtctgccttcacccggcatattttggcttctgttcccacaagatggcttgtgttacatatgttgctaaactctcctttcctattctaaaagtaaggaagtaagatctaaacccatggatctccagtccatccctggacctcatgatcctcatgatgagtacatccctggacctcagcactttggggaacttattaggaaggcatattttctggtgttgccccaaatccattgaatcagaaattctgggcatagggccctgcagtctgcatttccacaagccctgcgggagattccatggcacactaataattgagaactgccgatttcaagtattgtgccacactagcttgtgcctagcacatagttgggggctcaggaaatgttggttgagccaattggccaggtctgaatcctgcccctccaccgactagctaaacaagtgtgcacaagtcactaaacttctctgtgcctcagtttcctcatctgtaaacagggaatgagagccgtgccttctttgtaatggtgtttggaaagttaaatgagatcatagatagaaagccttgagcagagtgagcggcacatagggagcactcagtaaatgtcacctgctgtttaattgttgtcgtctttggcagatacatgaaccaacatgctggaaaacagtatggtttgtctcgcaaacctacaagtttgtcttcactggctgaagatcctgttgtctttttaatgccgctctagttaggaaatctttactgagcatctactatttccagcatcttttcgattctgtgatgtcagggtgaataagacactgtcaccaggagcctgcactggcaggggaggacacaggggagcacaggggagtatgtgctacagtgcctgtgtgtgcatgcaacagaaaggcaagagggaagctccagtagtgtttgtgtgtgtgcctgtgtatgtatgcatgcatgcacacacacctcatacttaatcttcatttttcttttttttttttttgaggcaaaatctcacttcatcacccaggctggagtacggtggcaccatctcagctcagtgcaatctctgcctcctgggttcaagcgattttcatgcctcagcctcccgagtagctgagtttataggtatgtgcctccatgcctggctaatttttgtatttttagtagagatgaggtttcgccatgtgggccgggttggtctcaaactcaaatttttgtatttttagtagagacaggattttgccatgtaagccaggctggttttgaactcctgacctcaggtgattcgcccgcctcggcctcccaaagtgctgggattacaggcgtgagcccccgcacccggccaatctttgttttcctaaataaaaagcgacctatggacattagggatggaattcattctgttctcctggtttctttagtagtttcaagaatgagctcaatacctataagagatccattagacattcatccaggcagcaagtttaatccaaaagcaagtcactttttggccttgaattgctcccatctcatacaatgtaagagttctaaacacaaagtttgttaccagaacagacagacttggactatcaaacccaacagtcaggagcaggctgcttaggtgctggcagctctgacactagatttccagaagcagggaaggcttcccagaggaagtgcaactcaaatcagccttgaaggataaggattggaatagtaaatacttattcttttttgagctcctactggcctcaggccagatacaagacagaacctggtaaataatgcaaatgtgactctcattggctctggatgctctgacgcaaggccccgtggtcagcatttaatgtgtgtgtctgacgtgagctccataacaaacccagtaggtagtcacaaattaccactagcaccattttacagatgagcaaaaaaaaggtgcggagaaattaagtaacttggccaaggcccacagtcaataatattgctggaattcaaatctggggagtcttactcataagtctgtgttcttaaacactccaccatatcccaaaacaagtgaactgacaaaagaagcagaacagattttctacgtggtgattgtttatttgaaggaaaggaaaaaataccattagaatcctttttctccaaatgcatccatgtgaacacatttctctctacacagcaaacatcactctggggcatgagttttgctatcacttagtggaaagtcgttcaattgcatcccagaggaccatctgccttaagttcttatgctaggaaaggaatgcctctctgagccactttccctctgcaaacagatttggaagatttggactgaaaggtgaggtgtccaactacttgtctttgctggcctgctctgctgtaatctgagcgaagtcacagaagatggggtaggatttcctagagtctattagtccttcctagactcagcagtccaggcactgtgtgtgtgtgtgtatgcacatgcttgaacgtgttttctagttgatgataatcttttaaaatccacttaagcataactggcttataaggatctgcagaggcgccttccaacccagcacggctgtgccatttcagtgctggagtttgcctttgtgtttacacaaagcgatgaccccaagtgacagcatttaactcttaacagattgataaacatgtccagctgccacgagagtggcatgtatgtccaaatttcaagtgacaacaatcgaccctcagattaaaatcttttaccttaggaagactaaacttctctgtcacagtctgtgtcagtggaaagtcagactcgtagaatagcactttcacttcttaagttattggacaaattgagactttgatcttacatcacaaaggcagcatcattgggcaggaactttaccgccttgattatcattgactaaggagaaaagaacagaggcaaggtggatgatgggactactgtcaactgatgtcaaatgacattacggtggtctttatgtatgagggtcttaagataattcaaactgaaaacattagcagacaaacagagtcaacacttggtacatattggacaaagcgtagtgaactcaatagacactccggcaaaacatcacccatcgcattcaatcaacattgttcatttgacttttattagtactgcaactctgtatttccttggtaattttgacaattgtatgagagctgtgagcgtgagcgtaagaaatttgcacctagtgataatgtttttacattttaaacctcagaattttttaaactctgtcatcctgtggtgccatcagaattatattcatttaatacatccctacaccactcaaatttgagaaaacctagtgcagtggaatgagcatagattgataaacagaactgagttgaaatcctgcctctgccacatagaaacactgcgatcttgggccatcccttcacctttctgggtctcggtttcctcatctgagtagaaataataacattagccacacaatttggctgtgagaatttcaaaagctattttatggaaagtgccagacatgtagtaggcactccctaaaagttaatttcctgccctgttctctaaggcttttgttttgtttttttgtttgtttgctttttgttttttgttttttgttttttgaaacagagtctcgctctgtcgcctaggctggagtgtagtggtgccatctcggctcactgcaacctccgactcccaggttcaagtggttctcctgcctcagcctaccaagtagctgggactataggcacacaccaccacacccagctaattttttgtatttttagtagagacggggtttcaccatgttaaccaggatggtctcgatctcctgacctcatgatcctctcgcctcagcctcccaaagtgctgggattataggtggagccactgtgcctggcccttctctaagttttattcccatctgcaggccattctgttgtctctctccttcctttcaaaagtggaggcaagaccagagatagcagccacatccaatatcatcaattcttgcctgactgtgtccatttcattctttctgacttgtcaggactagagaaaggtaagccctggtggctaacaggaaggcagagaggtagagccggcgcttaggccatacagctgccacctgtctccccaggaaggggaaagccagtcgctcatgtaagggcagcaaggagacctggcagcagactggggcagcctctgcagcctgggatgtgacagaggagcagctgcctctgaggggcccctgcaggcacacttggctgctttcctctgggtttcaccaggttctagtccagatgaagacgcagccatatggtggcaagttcctcttgggaagaaaggggaggttggtcccaccaaaacccaatggagcaaagtcacagagaagaggctggcagtgtcctggacccagagtcctggaagccatccagaagccacctggtgtcaccagcacacaactcagaattcactacctgtcccttctcctgccctccacctccacccaggatggcacttagaatcagacaatcatactgcacatgtttattgattagctgccatggccaggtaaatactgcagagctccaatgcttatactcttggcaagcagctaaaacgtgtaggacttttaaggttcgggttgatggttaccaacccttagaatgtggcaggtgttcaacacaatttatttcacctaattttcccagagctcctcaaacgcaggagctagtatgccattctacaggtgaacaaacaggctcagagaagttaagcagagaggtgatgaagtcagagttcagtcattgggctgtctgattctaaagcccatatccatcccatcacaccacattgccttttgaatttaagatgggaaaagagactgatgttgtattgactgcctactagatgcccaggatcagggttttactggatttcttccttttaaacttataataagcctatggggcagatacgattatatatctttttcagatgaggaaacagactcagattaagtaaattggctcaacatgaatagctggtaagtgacaaagccaaggtttacaccagatctgtctgcctccaaaagctggtatacttcctctcatttagttccctcctctgagcaaatgaccagattacagcatttccagcatgactgatacaatgcttttacctgccctctgaactaacatacatagaacacctactttgctttcagccctgtactaggctctgtaatggatttttaaaaaatagtttctgctcctaatccccaaggaacatctatccagatagatcaacatgaaacataaagaaagaatattaaatatgtctgtgctcttcaagactggaacatggagaaataccaatctccccacccccatgacctggtctagcaagttcctagtcatcttcaaggtctcaatttcaacatggatgccttgggagagacttcattgaaaacccaaactaggttacatcccagttacacatctccaggagcccagaattccacttcccaacacccacatgcaccataacttggtcaatgtctgtgtccctttcctggcctgtgtgattcttgagggaagggatggtctctgattcattcaccactctccccagcgcccagcatccctttgcctatcacaatgcccaacacagagtagaaaataaatagatcatcatggtataaatgaatagtgcattagtcaggaaagacttcataaaggaggcaggattttagttgtgctttgaagaatatggaagactcaaataggtcctgagaaaggagatggcagttgaagcagagagaactttatgagccaagcaagcaggatgcaatggtgttgggtcacccaggtctgtatagggaacgaaatgcatctcaacccctgcttcataccatacagaaaaaaaaaaatcaattccagatggattacagatctcaatgaaaaaggaaaacagtcacactttgtccagacctctatcagcaatactctctagtttccaggaacttacactctcgctggggagacaggtgaatgggaacaattggagacaggaaaatccggtgaatcgtaaggcgctagactatggcgtgcagccttaccaagataaatcccagtagtgaaagacaggtatttaatatgtcttatctaaaatgcagctgcatgaaaaatgcatcagaaattcaaggatagaattctaacaagggagaattttaataataattcaatattaaaataactcaacaacaataagtaacatttacagagttcttagtatgtatcaggcacttctctaagcatcacaccaaattaactcatttgaccttcacacaacactaggaggattatacttttcttatctccatatcacagatgaggacaccagggcaacaagaggttaagtaattcaaggacattgtcactcaagggacacgagatctggagtcagatgacataagtttctgagttggggtctttggggcaaatgattttacttttctgagctctggatttgaaaaataggagagataaacactccatctaccacgtgtgtggttgaataatattatgtgaggaataaataagagaatgtttgaacatagacacactttcataccttgacatgcagtacatctgtgagttctttctttttttaactaacacaatttttttaactaacactattttttttaactaacactattgtgacattatttctttggaaagcagaaagctaaatcagactgtgttccacaaatatttactgagcacctgctacatgccagtcatgggtctatactctggtgctgcaacagtgagcagagcaaagccccgccctcgtggatcgtccattctaatgggactaacagtaaacataaaaataaataaaaatgtgatagtggtaagatgaatgcagggtatgtgataagaagaaaattaacccagctgggggaacagagaatgatggtcatatcatttttgtcctgaataagtgaggagcccatcatgcggatgcaaaacaagagcattctagacaggggagccatggtgcaagaggcccagaggggaagtctgcttgttgtatggaaagagaaatcaggaatccagtgtggctgagcagtcagattgtggaaagcggcagttgagcgtagcagtcatcacagactaaaccaagaagggccctgcaggtgtggtacccatgagatacaggaaatccaaccactgggcagtagtttgtgcagtttgttcactagtcttatctgtgagattcctgccaatcactacaaaccttgtacacacacttgccctcccaaccaaatcagatgcagccttataggctgtagtggacatatggctgcgaataccttcattcaattcatttattctccagacatttactgggcacctggtgcaagccaaagccctggatgggcagtggaggtacattgtgaacaaaatacacatagtccgttctccaagagcagacctctgctagagagggagataggaagtaaactgcatcacagtgacagaggcccttgtcatctggcaccgctcaagagatgaggcaaggacaagggaagcttggaaaggcgaaatgcattcttcccccagactccgaagcttctttctccatgtgcagtaagtccacggacataagccattatgtcagtactgccaattccagatctcagctagtaacgagcaaatggatcgttgcaaaccacagaaaatccccaaacctcctttgagtcaataggtgtgttctcttccctccacaagcttttcagtaactacgctaagcccagcaaaattgattatggcatcacaggcctcaccacttgctgctcccaccaccctgcctgctctctgtggatgtgctgacccggggctggatggtgcttgggtgcatcggaaacatgagagggtggacaggctgcctctgcctctgcctcaggatacaatgatgaatgcagcagctcttcaaggggctttcacaccagtggaggagacaggcaaggaagcaggccacaggcctttcaatgtagtccaggaatgtcgccataccaaagagtgcggggtgccatgggaaccagaaggagctgccggctcaggatttggggtgatgtgggggaagggacagtcttcaaggaagccttcctcaaggaaatgatgtgtaaactgagcactaaggcatcaatagggagtatccaggggtgggcagagaggagaagtgatagagaagtgagttgggaaggacagccaggaagcacgtggcaaacgtccagagataggagagagcgtggtgggtcctgggacttacaacaggatgtagtttctgaagatcaaagcagctgtcgaattgtggtggaccctgttgaccttgtcaaagagtttggacgtcatcctgtaggaatggggaggcactgaggagaggcagctccgatttcaccttttgtaaatcacagtgactacagagtggaagtaatcagtggtagggaagagggaagcaggggagccacttgggggttggagggtgttctgagagtgcagggaacggttggtaggggtccagattcaagacatgttaaagaattggcgatttgctgggagtggagatgaagaggtagaaatcaaggatgactccaaggtttgcagcttgggaaatgggctggaggaaggcatgatttattattgagccagcataagaggatgggggaaatggacactaagttcaggttgaggttcagatatctgtgggatattcacggggggacagccagcgcaccaagaactcaagggaaagaagacaggactgggttgtatataaagacttgtgggtcatcagtatgtaagtgaaaacggaagccagagatgagatttctgaggaacatatgtagaatgaaaagagaagacagccaaagagagagccccagaaacaccaaatgtacaagataatcagaggaagaggaccttgcaaaggagtctgaaaatgaacaggaagaaaaccaagcaaccttgaggacccagacgccaagggaagacggcacatcaagaaagaagccaggtggtcagattactcaaatcatgtcaacggtgcatagcaaaagctgtaggggcatgtgtagatgctgactgtagggacatgtatagaaatgcctcccacactagcacttgagggagaaaggtattagaaacctttgcattttgctttttcattactccctgctgtgcatgaaagtacaggtgtgaaatccaagattcatttactgcagtgttccccaaagagtgatccaaagattgtagccccgtgagatgaaagacacacatgcacacacacacacacacacacacacacacacacacacagagagagcctgtaatgaaatgaacttttggaaacattgagcactatattcccacattagagtttgacaatgcagttagcatagtaaaggcacagaaaagccctgaggtaaggaaacctatttaacctccccttgttcagcatttcccaaacttacttgccagtggaacccctttattttgtatctcctcttagcatctcctggggctggaatcagcagaatgaactttggaaatcacagcattagcgggaaaggatgtgtctaatggatgaaatacccgcagccggtaaaccactggtaaaaagcatcctctcccaagcttaggacaaaagacttctttggtctgggttctctcattcattcattgagctaaaacatatcaggcatctgctaagtggtagcaagctggaaggtggtggagggggtatgtttgggaaagtgaggattgaggagcgtgggaagcacattctttggacatgtgttgtgtgctcgtggtggagcgtatgaccagccaaataaccaggcggatgctggccaagtgagagggttgtgggaagaggcataaccaggaggtggcctctctcctccaagaagttatgagatttccagggacgataaactatgaatgtacggaagatattggctggtaaaaacaatgaagaaaactagtaaggatctcagggacttaggaggctagagtcttttactccaggcagagtggaagattattctcaatgtggttgtagtcaataccatttattaagcatctactatgtgccaggcaccttatgttatactaatatagtaatggctgacatttaatgaatccctactatgcataaagtactcttctaagtccattacaaatattagctgacctatccttccaataccccagtagatacttatcattgtattctccaataaagaatgtaaggcactaagaggtgacatgtcttacccgaggtcatggctagtaagtggcagccctgagatttgaacccacacaggctggttcttccagatattatactcttatgcattacattctatatctaataaaatgtcctactgatacttgaacttggattgctggagtctgcagctaaagtgcttaccattaagccctggaaccacccacattatttatgctctttaatcttcacaaccatgttttgacattggtgttattaacccggtttacagaggaggctcagggtatccacacaactcatagccagcagcactgacactcctgaattcgtggagtctgatgctgaaactcatggtcccaggtctctactcccttgtccccgagacggctatcatttttacaggctggaattggggatgatggtcagcagatttcacaactgctgaggcctcggtcctgaccagacagaacagacgccggccacagtgctagaacaacagcctggagacccgcggctggtcagactcccacactttagttgctggggaggctcaagagatcccagtggaggggctggagggaccaaagcagtgggcagaaggggcatttcggggtgcttggacagcaggcattttatcaactcatatttgactattgatgtagctatatcagtacctgcctgcctgatgtcagtcctggccaggatcacaaacacagctgtttaccagttcctggcagccttgagcttcattgcccttggactctgggccaagtgggcttaaaggcagttcccctgtccaacatttgcctctgaagagtctgcacctgacctggggtcatagccctgagtctcaaataggtcaggttcatttgcatcattctgtggtcacatgctgcagccacaatcctagcatatgcagagttccaagcacagaatgggccgggaccctccatcacctctaccagaaatgccaaaaagcagtgcccttgagcccgaatctatagagggcagctctcaaggctgggaggcaccatcccagcccccgcagtcccttgacagcgctgcagatccccacacacaacacccttaagtagctcctaattgaagggcttgccaagccctctgtgcattgtggatctaattaagttccgacatcatatcaaattgaatccttttattaaacatttatcttcagattccagagtgtcacaacaccacattgttttaaatgacaggaatgcaaacagtgtttgccttcccaatggcaactaaagcagccactgctgaccagagccacggggagtagggaggtggggagtagccttgggggtcttccccgtgcccactcttcctaagcgagggtggcagaggccttggcggtctccccaagaacccctacctctcccacacatatgcaacaactggtgcaaccaactcagcctccctgaccttggtcttcgctgagctgtctggatcagctgcaacttctctcagtaactttccttgtcccatggaagccccattcctcctggggattgtggtaggaggtggccccgctttctcatctgcttctctgtggacaggctggctttgggggtcactcctctgtcctcccctgcccctcatctgtgaagatttcagagcaaagattctggccttctcatcctgatctgcctccctggcacagagaaggcttccaaagtgtttttattcaattagtcaatcactcattaaagactaactcttgccctcagctttgtagtctcaataccactctttacacttgtcccagggaccatcacggtctgggggactgattcctcccaatcacgctctggggagctgattcctcccaatcacactctaaggggctgactcctcccaatcacgctctggggagctgattcctgcccaatcacgctctaaggggctgattcctgcccaatcacgctctgaggggctgattcctcccaatcacgctctggggagctgattcctgcccaatcacgctctaaggggctgattcctcccagtcactctctgggggactgattcctgcctgatgacattctgggatactgattcctgccggatcacactctgggaaactgatttcctccctgatcacacactgggggacgtattcctcccaatcacactctggggtgctgattcctgcctgaccgtgctccgggaggctctctgaggggactgatccctgcctgatcacgctctgggagactgattcctgcccggtcacgctctggggggctgattcctgcctgatcatattctggggggttgatttcctgcctgatcatgctctgggggctgattcctccctgtcatggtttgcggggctgattcctgctcgatcaaactctggggaactgattcgtcctgatcatgctctgggggactgattcctgcctgatcacattctggggggttgattcctgcctgatcatgctctgttggctgattcctcccaatcatgctctggggggctgattcctgcccgatcacgctctggggggttgattcctgcccgatcacgctctgggggggctgattcctgcccaatcacgctctggggggctgattcctcccgatcacgctctggggggctgattcctgcccgatcacgctctggggggctgattcctgcccaatcacgctctggggggctgattcctgcccgatcacactctagggggttgattcctcctgatcacgctctacgggctgattcctgcccgatcacactctagggggttgattcctgccggatcacgctctggggggctgattcctgcccgatcacgctctggggggctgattcctcccgatcacgctctggggggctgattcctgcccgatcacgctctggggggctgattcctgcccgatcacactctagggggctgattcctgctcaatcatgctctgcggggcagattcctgcccgatcacactctgggggtgctgattcctgcccgatcacactctggggggctgattcctgctcaatcacgctctgggggtgctgattcctgcccgatcacgctctggggctgctgattcctgcctgatcacgctctaaggagctgattcctgcccgatcacactctagggggctgattcctgccgattagactcacaagagactcacatatccatatacatgaacggcttctgaggcagaatcctctctcctggggtgagggacagtgctgagaaaaaccagaggctctgcaggtgagaggtcacctggaaacactgagagtcacattttattcattctttttctagatttgataatgccaggccttcctgtgataacaacaacaataataattaacaatagctagcaggtactgagagctcactgcatgtactgttcaaagagctcacatgtagattaacttagttaaccctcacaagaaactgtgaaataggtaatgatattattccagtttacagtaaggaaactgaggctcaaagaggttaaatatatgttcataacatcaggttcatttgaaaaaaaaaaaaagatgttgaggaatttgcccaaggcaaatacacacccaggtagtctgatagcatcagtcctgagtccctattaaaaataatggctaacatttatcacctctatgaacctccagtttctcacctgtagaacaggctcattaatagaacctacccaaggggttgatgtgatgagtacatcagatgatatatgaagcattgggacagagaggatttttaaagtctcccatatctactgagagagagagaacagaaagtattcagttcaatccctgtcctcgatgcaattccgttaggaaaatgacacacaagcttgtgaaatctgaaataagacaagacagcaatacaagagatgtcatggggtagcctgtggtaaattgccagctgagtgatcttagaggtaaaggcagtgatgaaaggagggagaggcagctcgggctgtgaggatcagggaaggcttcttagaatccctgcttccaagggatagaaggaacctcagaatcccagctactgtagaaattctctcttcagcatccctaagaggcagctgaaccccctctgttggtacccctccagtgacagatagctcactaccttgggaggcagctctgaaaacacaacacttacccggatatcaacctgacctctccttccctacacagggcccaactagggtaaagcaagcaaggtgcaaagttggagatgcttacgggactccttaaattttgcaccctagatgtctcaccctagtctcgggtctacctgtacattaccacctgtggcttctagctctgctgtccagagtgaaatgggtgttgttttaggtggagaagagaggagagcttaattcggctgggagagcatgatggcagagtcagagctgagaagatgagagttttggatctgattggatctagctgggaatcctggttctatgtgacaggcaatggaggcaatggaaatctttgagatttctgagcaggggtgtgtctttggcctggaaatgggaatgtggctacatgggcatcctcaggcctgtgggtcctcgttgcacgagctatttccgctctcatgggttaatggtgtaggtggtgtttgagcactctggcttgactctatgccacaaaactgaatatacatatgtgattaaaatggaccaaggggaccaggtgcagtggctcacatctgtaatcccagcacttcgggaggctgagaggtgaaagaatcacttgagcccagcctgggaaacgtgatgaaaccctgtctctacaaaaaatacaaaaattagctgagcatggttgcgcgtgtctgtagtcccagctactcaggaggctgagatgggaggatcacctgtcacctgagcctggggagtgcaaggctgcagtgagccgtgattgtgccactgtactctggctggggtgacagagcaagtccctggctcaaaaaaagaaaagggccaagacaggtttggggaaatctgtggttagaaaattaaggtatattttgccaagtaggaaaggccacaagcatttttcacccgatggaggaatctgggcccatggcttctggtcttgcccctccagtcctttccccactcagccaccagggcaaacagatctggtcacattaacctcctacttaaaacccctcagtggctccccattgctcgtaagttcacacatatacactcacagacatacacacacaccacacacatacaaacacaccacacacagacatacacataatacctacacacacccatataaacacatacacacatatacacacacatgcatacacacaccacagacacacacacagactcacacacagacatacacacgtacacatacatacacacacacagagacccacagacacacacatcacacagacatacacacacacatacatacaaacacatacacacacacacacacacacacgcacagcccaaccgtctggtttccgtcctctaaatgacacttctggcttcagcatcctgtcctctctctggttggccctcacttgctcttctctcaaacacctccctgccctccctttcatctgccaatttttacttatccttcacggctcatccgagatggtgcttcttccaggaagccttcctgacaacctgccagtacccagattatgccatgcactgtccctactacccagcatcctgtactgtgctgtaacagtgcagcccagcagtcacctagaacctcctgcccggggtcagagcccagctctttcacttacacgagcaatgaatctttagaggcgttccttcacccctctgtccctccacttccatatctctaatgtacggagactaatagcgtccacctcaacaggcttgttgtaaagtgcttggccccatgcctggctcatggcagcttgttcccggcgaccagccaacgccctcgctgcccttgtggtttcattctgggtcgtctgcattaattatttgtctagggtcctctcaagactcagctctgggggacggggaatccgtctgtattgatcccttctctgctgtggaacctagctcaacaccaacacctagtaaccacttgataaaaattcaaggacgagctgaagtactgaactgaaagatgaacaccttgtccgagagcacatggttaatacacggcagaaagagaactcagacccacgctctcctgcgagaggcacagccaccacaccacagggcttcttaagatgaatttagggctgttgacacatgacagtgtttattcattatccgcctactccagggactctggggttgacagagtcatttgaaccatcctgtttcataggatctaagtgcatgcggttcccatagctccttgggcaggctctcttggcacagcagagtgtaatcaccggtctctcccctactagtctgtgagcttcttcaaagtagagactgtgtgatctatctgtgccccgaccgtggggcccagcaaaacataatcacacctacctcttagcgagctaggtgacagccactgtgctgagccctctcaatgcagtgttttatgcaattctcacaactctatgacagaagtttaactgactcctcattttacagtggaggagccaacgctcaggttcagtggcataactagaatgtggacccaggtagccagcctccagaccctgtgaagctaaccactgagcatcactgcctctctcatacaggcagacttgggagatactgaggattcggttctggatcaccacaatacaccagatatcataacatagtgagtcacacaaattttttggtttcctagtgcatataaaagttatgttggggccgggcatggtggctcatgcctttaatcccagcactttgggaggccaaggtgggtgaatcacttgaggccaagggttcgtgaccagcctggccaacatggtgaaaccccatctctactaaaaacacaaaaagtagccgggcatggtggtgggcacctatagtcccagctactcaggaggctgaggcaggagaattgcttgaacccaggagacagaggttgcagtgagctgagatcatgccactgcactccagcctaggcaaaaaagtgagaatctgtctcaaaaaaaaagttatgttgggccaagggcagtggcttacacctgtaatcccaacattttgagaggctgaggcaggaggattgcttaagcccaggagtttgagaccagtctggacaacatagtgagacccccatctctacaaataaaaaatcagccagtcgtggtgacacatatctgtggtcccagctgctcaggagactgaggtgggaggattgcttaagtccaggaggtcaaggctgcagtgagctataattgtgccatttcactccaacctgggtgaccgagtgagattctgtctcaaaaaatatatgttatgtttacactatactgtagtctattaagtgtgcaatagcattatgtctgagaaaacaatgtacatacataattttaacatattttattgctaaaaatgctactgaccatctgagccttcagtgtgccatcatctttttgctgatggagggtcttgcctcgatgttgatagctgctgattgaccagggtggtggttgctgaaggttggggtggttgtgccaatttcttaaactaagacaacaatgtagtttgccacatcaattgattcttcctttcgcaaaagatttctgtatagcaagtgatattgtttgatatatttttatccacagttgaacttctttcaaagttgcaatcaatcttctcaaaccctgctgctgctttatcaactaactttatatcatcttctaaatactttatcatcatttcagtgatgttcacagcatcttcaacaggaacagattccatctcaggaaaccactttctttgcttatccataaaaagccacctctcatccactcaagttttatcatgagattgcagcaattcactcacatcttcaggcttcacttctaattctagctgttttcctatttccagaacatctgaattacttcctcttctgaaatcttgaacccctgaaagtcatctataagggttggaaccaattcttccaaattcctgttaatgttgatactttgacctcctcccatgaatcacaaatgttcttattggcatctagaatgttgagtcctttctagaagatttttttatttactttgcccagatccatcagaggaatcactgtctctggcagctatagccttatgaaatgtatttcttaaataataagacttccaagtcaaaattacttcttgatccatgggctgcaaaatagatgttgtgttagcaggcatgaaaacaacattcatctccttatacatctccatcagagctcttgagaaccaggtgcatggtaaatgagcagtaatatttggaaatctttctgagcagtagatcttaatagcgggcttaaaatattcagtaaaccatcccataaatagatatgctgcatgtaggcttttttgtctcatttatagagcacaggtagagtagatttagcatacttcttaagggctctaaaatttttagaatggtaaatgaaccttggcctcaacttaaagtcaccagttgcattagcccctatcaagagagttagcctgtcttttgaagctttgaagccaaccattgacctctcttgctatgaaaatcctagatggcatcttcttccaatagaaagctgttgcatctaccttgaaaatttgttgtttagtgtggccaccttcatcaatgatcttaaccagatcttctggatgatttgttgcagcttctccatcagcacttgccccttcaccttgcacttttctgttatggagacagcttctttcttaaacctcatgaaccaacctctgctagcttccagcttttcttctgcagcttcctcacctctcttagccttcatacaattgaagagagttagggccttactctggattaggctttggcttaagggaatgttgtgtctggtttgatctatccagactgctcaaagtttctccatatcagcaaatatatttcactttcttatcattcatagagagtagcacttttaacttcccttaataactttccctttgcattcatatcttggctaactgtttgacttaagaggcctagctttcagcttgtctgggcttatgacatgccttcctcactaagcttaattgtttctagcttttgatttaaagtgagatatgttcaactcttcctttcacttgaactcttagaggccattgtagggttattaattgccctaatttcagtattgtcatgtcttagagaataggggggtccaaggagagggggagaaacagggacatggccaactggtggaacagtcagaacatacatagcatttatcaattaagttcgtcatcttatatagtgcagttcttggcactccaaaacaattacaatggtaacatccaagatcactgatcacagatcgccataacagatgtaataataatgaagaagtagtccgggcgcagtggctcacgcctgtaatcccaacactttggaaggctgaggcaggcggatcacctgaggtcaggagttcaagaccagcctggccaacatggcgaaaccccgtctctactaaaaatacaaaaattagctgggcgtggtggcgggtgcctgtaatcccagctactcggctagctgaggcaagagaatcgcttgaacctaggaggcaaaggttgcagagagccgagatcgcaccactgcactccagcctgggtgacagagcaagattctgtctcaaaaaatatatatatatatatttttagaatgtgtttaataataaatacatataaaagactattttaacaaacaacaaaatgaaagggcaatgtacagattgggaaacacatttgcaaaccatatattagataagggttaatatctgagtttttaaacatatattcttgtttaaactaaagtctcaatatccaagatttataaagaacacatacaactcaatagcaagaaaatgtataacacaatttaaaaatgagcagaggactttaataggcatttctccaaagatgacattaaaatggccaataggtaaatggaaaagtgtccaacgtcactaatcttcagggaagtgccaatcaaaatgactgtgagataccacttctcacccgttaggagagctattatcaaaagacatgagataacgagtgtcggcgagggtgtggagaaaagggaatcctcgcacactgttaggtgggaatgtaggttgatgccaccattatggaaaatagtatggagtttcctcaaaaaaaaataaaaatagaactcccatatgacccagcaatatgtcttctggtatatacccaaaggaaatgaaatcaccaccttgtaatgatacctacactccccaggcgcagtggctcacgcttgtaatctcagcccttcaggaggccgaggcgcatggatcacaaggtcaggagttcgagaccagcctggcccacatggcgaaaccctctctctactaaaaatacaaaaattagccaggcgtagtggcaggcgcctgtaatttgggagcctgaagcatgagaatcgcttgaacccaggaggcgaaggttgcagtgagccaagagtgtgccattgcactccagcctaggcaacaaagggagaccctgtcccaaaaaaaaataaaaaataaaaaaggtatctacactcccatgttcattgcagcaatactcacaatagccaaaatatggaaacaatctagatgtccatcaatggatgaatgaataaagaaactgtggtgtttacatacaatggaatattatttctgattcagcctttaaaaagggagagatctgtcatttgccacaacatgcatgaaactggaggacaatacgctaagtgaaataagccagacacaggaagaaaactattttatgactccactcatatgtggaatctttaccaaaaaaaaaagtcaaatatcaagtatgtagagatagagaataaaacagtggttaccaagatctggggtgagagggaagaaatggagagatataggtcaaaggattcaaagtagcaaatatacagggtgaacaagtccagagctctaatgtacaacatggggactattgttaataatattgtattgtattcaggatttttgctaaatgagattatagctgctcctggcacacagggaaaaactgggtactatgtgagatgatggatgtgttagtttttccactatagcaaccattttgctgtatatatgtaatcatacaacatcatgttggataccttaaagtatacacaataaaatgcacttaaaaaaaattttaggccgggagcggtggttcatgcctataatctcagcacttagggaggccagggcgggcagatcacctgaggttgggagttccagaccagcctggccaacatagtaaaactccatctctaccaaaaatacaaaagttagccaagcttggtggtgcgtgtctgtaattccaactactcaggaggctgaggcacaagaatcgcttgaactcgggaggcagagtttgcagtgagccaagatcacaccactgcactccagccttggcaacagagcaagactccgtatcaaaaaaaaaaaacaaatttaaaaatcaagcttttttaaagactattttaacttgtacaggttatgttcattaggattaggcttggctataaagtttcccgcatttttttttttgtttttttggtttatttacctaaaattaaaaagacaggacgggtgtggtggcatgcacctgtagtcccagctactcaggagactgaggcaggaggatcatttaagcccaagagttcgaggtcacagtgagctatgatcatgccactgcactccaatctgggtgacaaagcaagaacctgtctctaaaaaaattaaaagtaagaaaataaagatagttgatagtttatttctttctcgttgcacagctctggagataagttatccaagactggtataacactccatgggagtgtggctcagataccctttatcttattctaccatcatgcagctctccattctcaagattgtctcattgaccaagatggcggctggagctccttagtccacttgccaagaggaaaggactgagaagggcacatcccatgccctaaaggccattcctcccaagttgttcccatcatttccactcacatcccattggccagaactttgtcacatgaccacctccagctgcaagcgaggctgggaactaaagcctacgttctgggaagccatatgtccaggcaaaacttgaaaagaacaagacatatttggaaacagcctctgtcacagcagggaataaagaataacaataaaatgaagagtgcctatgcactcattacgaagttaaaaaatagagcattcctaggacattgaagcagttgtgtgccctaccctatctcaagaaaacattcttttttttttctttgagacagggtcttcctctgtcacacaaactggagtgcagtagcatgatcatggctcactgcagcctcaacctcccaggctctagcagtcctcctgcctcagcatcccgagtagctgggactacaggtgtgcaccaccatgcttggctaattttttatttttttgtagagacaggatttcgccatgttgcccaggctgggttggaactcctgggctcatgcgatcctcccacctccacctcccaaagtgcagggattacaggtgtgagccaccacgcccagctgcaaacactcttaaacttgatgtttatcattcccttgcttgactttacagttttgccacatacacatgtatttctaaataatctataacatgtttttaacttaatgaaaatggaatcataccatatgcatttttctgcagcttgatttttttctgtccagtgttatgtttgtggaattcatctgggttgacttgtgtagctgtaattcactaactttcactgctgtacactacattacatcaatatactatgctatcatttctccgataatagaaatctgggctattccaagtttgttgttgttataagcagtgctgttatgaacattctcatacatcgtgtgcatgtatgcaagtgtttcttcaacacacatttctaagcagaattgctgagttgcaggctatacgtatgttttgatatattcaaatagatttggattgggggcagggtctcactctgtcacccaggctggagtgcagtgacatgatcttggctcactgcaacctccgcctcccaggttcaagcaatctcccacctcagcctcccgagtagctgggactacaggcgcgtgccaccacacttggctaatttttgtattttgggtacagacagggtttcaccatgttggccaggctggtctagaactcctgatctcaagtgacctgcccaccttggcctcccaaagtgctgggattacaggcgtgagccaccgtgctcggccagatatagtcaaataggtgtcttttgtttgttcgtttgtttgtatttttgtttttggggagttgttttgttttgtttttagacggattcttgctcttgtcaccaaggctggagtacaatggcacaatctcggctcactgcaacctctgcctcctgggttcaagtgattctcaggcctcagcctcccgagtagctgggattacaggcccccgccaccaagcccggctaatttttgtatttttagtagagacagggtttcaccatgttggccaggctggtcttgaactcctgacctcaggtgatctgcccacctcggcctcccaacgtgctgggattataggcatgaaccaccatgcctggccaggtatagtcaagtaggtttttcataagagaagtgcaaaagatcttggtgccccagggattctaatatttggcatgatgctcaactgtttaggtgaatggaaatgtgtagtacagtcgctggacacccacacacactaactcattcatttatttatttgttcaataaacttttttcaggcagccattaccattaattaaaaggctcaccatcaatgtgataatgatgtttcaggagaaaagagacacactgcagtgaagtgaacccgtgaattataagacacatctcaatttcagaaacattgaaatttgcatgtgagcgtcttagaatcaaggaaaatatggtatattcagggaatcctctagaagaaattctgcccttgaggagcttacagacttgcagctctttgttcccaaacaacaatacacaaagagaatatgaccaaagcagctaaaaggtgcttgacagcctcgctacccaacccaaagtgtggcccccgccactggggcctggcagcgtgggcacttcctgcaagctcatgagaaatacagagtctcaggccactgagagtcaccgaatctgaacctggcttaacgtgatccccaggggcttcccatgcccattaaaatgctgaaaagcactgcataggagcgtaggagaggaaagagtcttcccagctaagggcaatcaagaaaggcctcctgaaagaggtgccatttgaaagagaagaaaaagaaggaggacctacattgttgagtatctgttctgggttaagaactgcactggggcccttcacttctgttatttcatcgagtcttcaaagttaatccccttaccccctcggtgaggactgatattgccttcttacagcaaaggaaactgaggcacagagaggtcacataacttgctcaaattcacacagctactaggtaacagagccaggcttagaagccaaatctttctaactctggagcccaatctcctcccccaaatcacatgtgaagaactaaaggggcctggcacagtgggtcatgcctgtaatcccagcactttgggaggccgaggtgggtggattacctgaggtcatgagctcaagaccagcctggccaacatggcgaaaccccacctctactaaaaatacaaaaaattcgccaggagtgatggctgatgcctgtaatcccagctacttgggaggctgaggcaggagaattgcttgaacctgggaggcggaggttgcagtgagctgagatcgtgccattgcactcctgcctgagcaacagagagagactctatctcaaaacaacaacaactaaagaaggaactctgagtggctgaggagggcggatcgcttgagcccaggagttcaagaacagcctaggcaacatggcgagaccccatctctacaaaaaaaattcaaaaattagctgggcacatgcctgtagtcacagctacccgggaggctgaggtgggaggatctcttgagcccagaaggtcaaggctgcagcgagccatgatcacacccctgcactccagcctgggcaacagagagagaccctgtctcaaaaaaaagaactgaagaggtagctatggagacaagagccaggacaggatgcaactgaaagttggatgagcaattgttcattgtggtcagctcctgagtgctggggacttcagtgaagtgggagctcagagccaatggaaggagcaaattcatggcaggcaggcaggacagaccacttacttcatctcaccctgcccagtgcctagcacacagtaggcattcgaaactacccactgagactgccctctcccttcttgacccctagctcttcctcccctccctccttcccaaaaaacaaaaaaagaaagaaactacccactgaaagaatgaatgaacgaacgagagaacgatcaaactcataggatgccacacgttctgttgttgcaaaccatccaacccaagctggtggctgcgctgtgccccagggggctggggttccagccagaaacaagccaggcatggcccaccctccctgaggcctcccgaatccctgccgtcagggaggtattgccaggaaagcaaaaagccaggagcagcaaaggttgaaaacacagagaaagcagctcccactaaacccttcctttgcttcacttaaaaaattactcagacagcctcctccccacgcctcagctcgctccaccgtgtcccctcctggctccagagctgctctttcagcttctcatgaatatgtggaaaataaaacagagtctgttcagcccctaatgaccaggtttatgaggagcttattgtatctaaagaaacaagacagcagttggtgtgagatattaatgtgctttttacaaagctgatgaaacctcctcttaaactacttaatacctgcaagctgcaattcccagcctgacatggtaaactccttgagccagagctgtgccagcccacggcacagcccttggcctttccgcctcagcggggcctgaactcactcagcctggcggttggtggggcactgccactcttctgggatggaggttccatggagagtcatggttgttgagccccttagctgaataaccctttatagttcatggtgggagagtcttccctgcatcccctttcctctggaagctcaaagccaatgcctgaggggacagcgggcagtgagacccctgcactccactccagccatcacccaccctcaccctcaccctcacccacccagccctctgatgggaccagtccttttgcaaatctccaatcccaccaatttgtcacgtctttgtaccagctgactcctcacataggatcacccttcatccagtggtgtgctggtacatgtttaacaatcagctccctgggctggaggtggggaacttggtttgtagcatttgccgtgggttcccatggtgtgaatacacctaccacggctgatttcaaactgctaacgagagctgggaagacactggtgatgagctcccttgagcaggggcgagccggcccgcacactgctggcttcgggccctctctcaagtcctgttactcccaactctgctctgggaaaccttctcccacccccagggacagtgtgttccctcctatgtcccgcactatcctgactgctcttgctagaaagcccttctcaaccctccaccacttcctcatcacgcctacacacacagacacatgcacacacatagacacacacacacccatgcacacagactcacatacccatgtacacacagagacacacacaaagacacatgcacacacagacacatacatgcacacacacacatatgcagacttcatctcaccctgcccagtgagcacacagtaggcattcaaaactacccacatacagacacagacacacacaaacacacatgcacacacagacacacacatgcacacacacacccatgtacacacaggcacagacacacaaacacccatgcacacacacacacatgcacacacacaccgatgtacacacacagacacacatccatgcacacaagacacacacacagacacacacacccatgcacgcacacacatacgcacacacacccatgcacacacagacacacacacatgcacacacacacagacacacacacagacacacacgcgggcatacacggacccctccctgcttcatcaggctgacttctccactttgtgtcagctcaggcacctgctcctcctcaggaggcctttgtcacccacacactccctcgcctggacacaccttccatctgtgtgccccagacacgctccactctcctctgtcatcacacacatcctctacaccacagcgtgtgttttctgtctgccatcatagactgcaagttccttgaggacagaaagtatatttttccccctctgttctcagcaggttgcatggagcgtggcatacaattggtgctacataaatgatagctgaacaattgtgctgccataaggcctcatacctccttctaatatagtatgtgaaggattgcactctagtaagttctgtactatctgtctttgcccctagaatgtgagcctggaaggcagagatgagattagattttcctctaccatcccagtgccaggcacttggcccttagtctctaccacagggacagagggtgcctaggaatgaagctagttgggaggaaagtcagagatggagagaggttccagattttggagcacctggatccatctgtgcctgaagccatcacaacccctggggtggattaccaccaaccagaaggaaatacaatggaaccctaggctggccttagggaaatgaaatctcattcatttcatcaccactcaccactctccccttactggagtgatgtctgttgacgtagatgtcctatgaagttcaaatttcaccactaatgcttgagtgctgctagtgccccctcccctcctatacctctccccagcaccaccattaatcagactgaatccagggcccaccgagctccaagtgctcctggagaccctgtgctcctccagctgaccctcacagcctcatggccaccagaggcgttgggaccaatcgcacagtgacctgtatcccagtttaccccatcactcctccctactcatcacttgtccctcagggctgtgtgtcctctgatctggctggatctctaactcccccgccctcctaaatccttgccatggcaccttctagaatttaggtcacagtgccagcagaatccccccattctgtccttgctctaatggaaatctggctttccccgaaggacaccaccgcccctgcaaactctcactgtcgagagtgttttactgctcacatcccaggcctccctgggcctcatcgacatttccggtccatttccctgcctcctccctaaactccctgcctctgtgaaacacatcccagcctacctgtccgactccctcatggccgccgccattcagtctttggggagctgagcgctggctcactgcctttgcctccaatgctgctcccgttatcatccttgcagattccacaaccaggcaatcagcccctccagtccctggccgtgaccccttcactccaacctgatgtgccggtgctgcctcactggttgttaaatattgaaatactgttgtaccgatcagtcttactatgtcagggaagctggctgggggaaggggtggctcctgcattgggcggggcagagagaagagaagggctgggaccaaggctccatctcctctcctcgctccccaaggctgggttaaggactcagctctgttctcaggttctataaactccaaggcccgccccaaggatgggggcaagagaagaagagtctccctactggtcctgactggtgggactgggctgggctgggcgcacaccactgccctgccgatgagagcctctacccctctcacagcctcccactaccttcccattcccggccctgacctcctggggctgctgggcacagagaggtcctctagtcgaaccgtagaggacaacttaggagaagattctgcactcgccgaggtggaatgacccttactctaacagggaagcttggggagcatctggtgtggtttcctgtgtcaaagcatggtccagtcaagccatcatttagctcataacagcctcatcatcaaaagatcacaccactcatttctaaaaaccaatcggtgatttggggcttattagaataatttgatgaatcatttgcacttcaaattttaaccgggtaggcagtttcttaatatatactcgatgtatatagaaaataacagcgaatgttgtagttttgccttatctattaatttgtgtgacctttccagtgcatacttgaagatcatccctacctctgcctgccccaagccacctcattcggggtcttacccttgcccttggcatttccaatatccacaccccctccactctctgtcttttgcatcccactctctggctaccacgtgccaccgttgcagctcactcccatgcacccccatttcaacaatgctttgaccccaccccaaccccaggctcaaaagcattgactgccctccccgctccaccccccacccccgcctttgcactgcctcacttgcccttcaggtcctcatttccctgtttacccagcttagactccatatccatcctcataatccctcccattccaccctctccctgttgcactcacctcacaaacctcctcctggttagacgcaactctccagctaactgcacccacgccacaaatgtggccagagaaaaccacagaatctcagaagtgaccttcaagccactgacacacacacttcacagcctggtccactgtctcccactctcgcttcccttcccctgtcctcccgtccccaacccttcctcactctcagttgatgatcctgcttcccatttcgttgggaaaatagaagcaacagaagagaagtgttacaccctcccaccatgtctgcccatccccagcactgcacccacgagctctgctgtccctcctggcacagcaccaccccccttgtgctgtgtcctgggcctcatctccttgcacagtgcacctgtattgctcccccatctctgcaggtcatcccttctgtcctcctttcttttacttttttattttgattttattttcaagacagagtcttgctctgtcaccagactggagtgcagtggtgctatcctagctcactgcagcctcgaacacctgggttcaagggatcctcctgcctcagactcccaagtaagctaggaccacagacacataccaccacatctggctaatttgtttttattttttgtagatatagggtcttgctatgttgcccaggctggtcttgaactgctgggttcaagggatcctcctgcctcagcttcctaaagctaaggctgagccactgcccccagcccctcccttcttccctctctactagaacattcccactagtatcatacaggctttaatatctccccccttaggccgggcgcggtggctcacgcctgtaatcccagcactttgggaggccgaagcaggcggatcacgaggtcaggagatcgagaccacagtgaaaccccgtctctacaaataatacaaaaaaaaaaattagccgggcgtagtggcgggcgcctgtagttccagctactctggaggctgaggcaggagaatggcgtgaacccgggaggcggagcttgcagtgagccgagattgtgccactgcactccagcctgggtgacagagcgagacaccgtctcaaaaaaaaaaaatatatctccccccaacacagagcagccagcactagccagctagtggaggacaccccagtagcacagtgcagggaggcagaaggaggttaggagaaagaggcaacagaggacgtggtgggagttcaggcagcaggaccagcatgcatgtgccacggtcctgaggtaggagggagcatggcaggaaagaaggcagagatgcacagggagggaggaggtgggtgggaggtgaggccagatgtggaggttgggggtcaggctttgttagagatgttgagcttttccccgacagcactgggaagctggagtgtttccgagctggaggtggcatgatcagatttgcatgtacaaaggatcactgtcatagctctgtagagaaggataagagtgggtgcaaactgatgagtggggaggccgcggcagccatccagggagcagggatggtggcctggtagtgggcggtgctgtctcagagacatcaggcaagtttgagacactaaggatctaatacagacaggacgccctgatggatggagcctgcagggaggaggaagagatagatgtcagcgctgacaactaggctcaggcttacacaagggaaccctggagaagcattcgccaagctaactggggcctccagagtgccaggctagagggaaagatcaggagttcatgttcagtgcctttaaaacatccaccaggagatgtcaaataggcagctggatacccaggtccaggcctcaaggagaggtctgggccactgattatctcgcacggcctctctgttagcatctcctgaaccctgcttctgtgccaggcactgcgctaggagccaatggtccaaggatgagtgaagcccaggcttgcacacaaggagcaactaggctccccgtagaatgtgagctcctgttcctgcggggaacaggagcgggtgtggcccaccaggatgcagctggggccctgctgggtgaagctctgtcctcaatttgtgggacgcctcagggcatgtcagtactgctctctgagcctcactcctgcacagattctttataaagatgcctggcaccggcttgctgaaatatttgtcagattgaattgaaagaaaatgagagtgctttgcgaagtgcttttcaaatacactgatttgtaattttaacaatagggagaatttgttatcctcttagcagctggtatgaagacttttcccacagagaagggtgcatggttggattaggaaaacaaggtactagggaggggacaaggcttccttttaacaccccaagatgcaggagggcagaggggccatgacacgatgggggtggggacagcaaaaagcagggaacccaaaacactcagagaagacacctgtccatgggaccattttgagtggccctaccaagcttcagtgaagcgaccagaagtcccgatatggtctggggaattgtttttcttgtagaactcaagaaagttagtgaatttggtacagggatagctcatgtgtgaaagggagttacagagattcctcttttccattatatgcagcatataatcatagccagaagttcctaaaatgcttatattcctacgtagtacgtaagtatccctgtatactatatacctgtgtactattaggttgatgcaaaagtaattacggtttcactattacttttgatggcaaaaaccacagttgcttttgcaccaacctaatatataggtctattttatacacacacacacatatatatatatatgtctaggctgggcacagtggattatgcctgtaatcccagcactttgggaggccaaggcaggcagatcacttgaagtcaggagtgggggaccagcctggccaacatggtgaaaccccatctctactaaaatacaaaaattagctgggcatgttggtatgtgcctgtaatcccagctactcaggaggctgacgcaggagaatcacttgaacttgggagttggaggttgccgtgagccgagatcacaccactgcactcaagcctgggtgacagagtgagactccatttcagggggaaaaaaaaaaaaaaaaggtatatgtaataataccgtaaaattcctaattaatatctatgacacatactagaatctgcccctattttataagacatagtctcaggactgtagaagaaaatcattgccaacatgtattgagggctgtattaattaggtcacagtagctactatgttggtggctggacacagtcaaatttcatttctgtctcacgtcaatgcccccaaggacttcctaaatgtgtcaggcactgttctgactactcaacatgcatcagctcagtgaacctccacgacaatctgccagggaagaattcttgttatcgccactctcaggtgaggacactgagtgatgcacagctggacccaggcagtctggctgtgcaacctgcatcttacccactgtgcatacgccccagcatacacccaatctttcttccattcagagaaggttaaaggacattcactgtgcctatgctggtgctggagataagacagtgaatgaaacaaagtctctgctgtcaggaagccgatgctctggtgattgtagagtctgtgctacttatcggtttttagaaaggccacattcaagagttcacgtgctcatcagtgaacactggggaggacctgcctgtgacactgtgctgggatttgccccaggccagttctcaccttcccagcaggcaccgaggaaacatttagagtcaaaagatcctagtttcagccctgattccgtcatttcctagccacaagcacttgctcagatagttcagcctttctgagcctcagtttcctcatctatacaatgaggatgataatacccccctcacaggcctgtggtggaaccaaaatgagctgtagttcaaaacccaaaagtccagcccccagggggctcaacttcctccccacccccatatttatttcagagcagttggcggctgggtttggtgaattccgtgcggaattgcagatgggaaagtgttttgcaggctcttctaaagggctgtggcagcatctggcagcaccagtgcggggtgtgtcccctttagaaagtgatctgctactttctcacatgtaaaatgcaggatgactcccagctatgctggggcacagagacgggctgaggagcattcatcggcctcctgcgtggcagtccccagctcggaatcaaacctccactgctgccaagcctccgctaatcctcagaagcttcagtgcagggacagaaggcagcgttttgaagtcgtcggctttagatcctctctgcagtactgcgggtgtgtgtgttgtgattcaccaggcagatgtccaaacggacaaagcgaaaccttccttcaggggtgagggagagggctgagtgagtttccaaagagccagaagttgggaagaggcaggtgggccctaagcgcccccaaaactatgatgtttcatgtgctccttctccccttgttttgcagggaatttcaaaggtctgtgcaagcaaattgatcacttcccagaggatgcagattacgaagctgacacagcagaatatttcctccgtgagtgcacacgattgtttttatctccctcctggtggtgggccctgcccttccatccttcacagagtcaaggaccaggcctacctagaggccctcatcacagcagagggcaggaaaaagctaagcctctctcctttccggagtacagaccttcatatgtgctgttccctctgcctgcaatgcccttccctgcccgtctttgtctggcaaactcctactcagtcgacctccaggtctcagctaaaacatcaccttctccaggaagtccttcctgccttctgcatgagttcctagaggacggtactttatcatgctgtagggtccttggctatttgagtaaccatctcccaactctgctagggtatggactcaccctagcattcaccattatattctcagcccagtgcttggcatgtgataagcactcagtgaatatttcttgaataattggatgaagtaacccaccaggcagtgccagattggaacttctaatgaaaaaaaaaaaaagagagagattttttcttcccccgcaagtcaagtaagtcaaagttaaatcctgatgtaacagctgcaatcttaaatccacctgagacatattatcaagagaaagcattctgaggctccaaggaaatgtctcaagtatcagcaaaaactaacaaggctacctattccctgagaaagggatttccaagagaggggctgagagtccttgaggcctgggacagcaaagccgaggttctcaggccatctctttggaaggaggtttgctctcctcccaggagcaaccccgcctctgctccaggccctgccacctccccttcccaacagcacaaggattgccattgccctcagatcacttttatgaagcatgtaggaggcattttattatatagattgcccctgtctctttcaataattacttctcacatcaagcccagctctcaggtcagcctggaatctggtttcattgaaaagcccgtggaatgtaaagtcagccaggcagctgggaagaaagagggagggaacacgatgcaatttttagattcttttttttaaaggaaaaaatatcataccctgctcttcatttccttttatgaattccttcaagacgttgctcttaactggaattcctaaaaggccatttggttgtggttacctgttacctgcgactgtgtctggggtggggctgcaggagcccagctgtgcggtaaacgtgggttgagctccttctgtgtgctggatcctgtgctccgtgctggggaggccaagatggatggggcctgcccccaagaagagcacagcctggcagggagggcccttggaaaaacagctcaacttgggagacacagcatggcagaggtgaggcctgaatgtagaagggggaagccagcaggcaaagccaagccccacactgggagccacattcccggagcacaaggctcaccaggtggagctcgaatgatgtcatgctttatctgctaggcagtaagtgcctgggggcagaaaacttgtctcattcattgctgcccttataacagctcaatgaatgctttttgttaagaagagatagaggattcttcagtagcaattcctaacaactcaatgcctccatttccttgtttttaagaaagaagagcatagagcatagagtatttggttcattttggtgtccctggacaaaagacttggactcagattggcaacgacaggattctgaaggtctgatttgagttgacttaatccaacaatattttttgaacacctgtagcaggggtcggcaaactttttctgtaaagaatcagatgttgaatattttaggctttgtgggccatgcaatctctgtcccatttacccaactctgctcttgtggccactgacaatatggaggcatatgtgtggctgtgttacagtgaaacttaacttgatttacacaaccaggcagcaggcttcatttggtatagtttgctgacccctggtctataaaatgctagtcctgggccggaaaacaaaaataattctttaaagctggaagacgcaagtttctatcattctctacgaagttctaacctagatcttgagagaagctggaagacggggatgatttttctagaaggatcccctgcccccagtccctacccccgcttctgattcagaagctcctctggggcctccctggcaccctgcatgtgtctacaattcaaccccgaccacactttgctgcaatgtcactggttcacactcgggatccccaagagactatgagcttcttgaaggcagagctatgtcccattcatttctgcaccccaagcacccagaaaaggccatggcagggaatttgacccaaaaaagcactttgatgactgagcaatgaagtgactgggtgggtgaatatgtgaacactcaagtaaatcatggtctaatgccccgagatcaatgcaagcaacaggcttccagaggaaaacagctgggcccccattcgccagaagtaggcaggtggctcccagaggtgggcagagcttaggctgaaggaggcgggctgagctgcacctggggtggagagggcctgagtccactcctagttaaggtctgtcaaacccatctgcaccgctcatctgccgcaggggaggctgtgagggggcagaagcagctcctctccctgagggctagccatctggagggagacctacagacctaatgtttatgctgcatgctggaatagaaggaatcgtgtggtgctgagggaacctgtcccctaacccagaccagaggaggtccttccataagagttccctagagaaggtggcaccagagccaattcattcattcattcactcgagagatatttactaagcactcactgagtgccagcactattgtcagtcctggggatccaagagtgaaccaaataaagagggccagtgccttcgtgaaggttacatcctagtgtaagaaacaagtaataaacaagtgtgaaacaccctgtccctgccctctgcaccctgagatagttttgttgttgttgttgttgctgtatcttgctctttcatccaggctggagtgcaagtaatgccaaacctctgcttcccgggttcaagcgattctcctgcctcagcctcccgagtagctgggattacatgcatgcgccaccatgcctggctaatttttttgtatttttagtaaagatggggtttcaccatgttagcctggctggtcttaaattcctggcctcaggtgatccgcctgcctcagcctgccaaagtgctgggattacaggcgtgagccaccacgcccggccccagctgagatagtttctgagtggtctgggaggggttggagagtggagagtgatgggggaggggccagtgggtcctgagggcatgtcacttagataaggtggtcccaaagtttctctgagtaaagaaagggaaccaggtaagaagatttctggggaagagagtagctgatggagagaatagcaagagcaaagtccttaaagcaggcacagagcatcatgtttgaggatcagaggggtagctggtcttgcaggagcccagtgcaggggtggagtggggtcctacagcagagacagcagaggaacccagtcatgtgggcctgggaccagggggagacctcagctctcattctaagtgtgatgggaatgaccgatttagacacatcagcctggctgctgtggtagtgacggttggaaacagaggcagggagcccaggatgggggagagggggcaaccagagtgtagccatggtgatggtgagaaggaaggagatgtttgggagacagagctgacagcagcaggggtggccactgatggggcatgggccatggggcagggaacagatttcaggatagggacggaagtgaaaggagagggaaggagcagtcaagcaactcttctttctccccaaaaagcagattccaacccatgtagagcatctcctaagggacttggggcttgttttccaggttcccaaatagctcctcaattaattctttttttttttttctttttttttgagacggaatcttgctctgtcacccaggctggagtgcagtggtacaatcttggctcactgcaacctctgcctcctgggttcaagcaattctcctgcctcagcctcctgagtagctgggattacaggcacccgccaccacatctggctaatttttgtatttttagtagagacgggattttgccatgttgaccaggttggtctcgaattcctgacctcaggtgatctgcccacctcagcctcccaaagtgctgcgattataggtgtgagccaccatgtccagccctaaattaattcttcctggaaaagcagaggtgtgagctggatggggcacaatccatgccttccggagtattcctaaacccaagacctctgcagcatgaggaactggaccaacctgagccccaccaggaacgcacaacgcttgggccccttaaatttcctatgaagtcacaaggtccatgaaacagatgtagcgtcttccttcacttgtaagtgtgagcaattcacacactccacagatctttctggagtgggcccccctgtatgccaggccctctttgaggtactgaggttatggccctcagggtacttgcagtctgcaaaaaatgaaactaacaggtgaatgatataacatgttagactaagataagccctatggggaaaaaagtcaagcagggacgggggatggggaattctagagtagggatgggatcaagaatgaacagtggccaggcgtggtggcgggtgcctgtaatctcagcactttgggaggccaaggtgggcagatcacctgaggttgggagttcgagaccagcctgaccaacatggagaaaccccgtctctactaaaaataccaaaaaatttagccaggcgtggtggtgcatgcctgtattcccagctactcaggaggctgaggcaggaaaatcatttgaacccaggaggtggaggttgcggtgagctgagaccatgccattgcactccagcctggacaacaagagcaaaactctgtctcaaaaaaaaaaaaaaaaaaagaaagagcaaacagcaagtgcaaaggtcctgggttgggagcatgcctggaatatctgaggaataggactgagccccgtgagacaagaagagagtgagcaaggaagagcaaaggaagagcaagtgtggagagcctcaaggaccctgtgggttgcagcgagaatttgggggtttgctctgattgacagacaccatctcacttttgaacaggctctggctgttgtgttcataagggactgaaatcggaccagggcagaagccgacagaagagttaaaactctgttgctataatttaggcaggaggtgatgacagcttgaaccagagtggtagcagtgaagggggtgaaataggatcaatgttgaaaatatttccagggcaccgcacacaggattttctgaaaggctgaatgtggatttcgagacaaaggaaggcggcaaggatggtgccaaggggccgtgcccatgggggaacaacaggttgagactggggctcaatatcagacatattcagttagagatgcctgtgggacttcctgggacaatgtcacgggctcggtatggacctgaggccagggttcacaggagaggtcctggccagagatagtgagttttcacgttgttggcacgtaggtgatatttaaagccatgaaactcaatgaactcaccgagggagtggcacagagagagaaggggagaagcccagacactaagctccaggacaccacgaaggcttaggggccagtgagatgaggacactccaggaaagggggctgagcaggagtggccaatgaggtgtctggggtaactcccaccatccttgctacaccagctggactggggatgtagagcagagagggaggacagagaatgccagaagagcatggctggacagcagttcagagctcatctccgggggtggaaaggatggtggggctcaccgcgctcaagccagcaggccaagcttaagatgttgtccagcctcttggagggcttggcagaaggaaggcactcaattaatatctgatggacgaatgaatgaatgaattaatgaatggacactcttactccccagtgcctatgagtaactgaggagtcccccagcctctcctgaaccacactgatagagaaacagctataggagtccctcatcactaccccggcctccataaagccatgaccaatatggatttcgccccacctataactggcttacccagtaatgaatgtgactggactgtttctcccaaccagcgctgtgggcccatcgaatgtgtctgctgtggcagcctccatatcctcttccctcattaaccaaagattaaggagcgtggtgaggaacgaggctgtggtgaccggggtgtgacttctcttgaatgtcaagcgtgcatccatgcatctgtctttgtgcatgagggcatgagtctgtgctgtgttctgtgtctttcggtacccgcatgtctgtgtgtttgagtgtctatgtctgaatgtgtaagcgcttgtgtgtttgcacatgtctgtgtgtatgtgggtccctgtgtgttgtgtgtgtgtatgtgtgcgtgttgtgtccaggagatgggaggtgacatttcctagctgtcctattgtgatttggagtaagggaagaagaatcagaggaatttggcttcctccaacagtcatgtattaagcacctactgtgtgccagaccccaaaatccactctattgtggccactcattgtccaggactgcggggtatggtcaggtctccccactccatactcagagcctggggctggaggtgtgggtgaggggcccagggctggctgctgtctctgacgtactccctccagggggtgtgacacaggccacacacacaggcctcaatggggggatcaccaggccacactccatagccagaagtggagagaagggggaagggaggcaggccctcatcaaagcagatgcccccactcagctccccacaacacacacaagagaggtacacccagttgcgcttaaatttgacacctccccagggattcactgaccacctgaggacgatgacaggcagcctgggggaagccaacagcaggagtggaaccaaggagggaggcagaaggcggccaaggcagggaggacccatacgatggccgtctggggggtgaatttacagaacttggacaccagtgggaggcaggctttggcacactcggggcttcaaatccagctctgccacttcccggtgaacctccctgggcctcggtttccttgcaatggggatgatgctcattgtcatcttcctagcattgccatgaggattaagggagttagagtcggacagcaattcgcacctgccccgaacccagtgagcattcagcaggcattcgccacaatccgtgttcactgtcgcatcccattgcagagcgattgccacgatccatgctcactgttgtgtcccattgcatagcgatgagcgcaaagaacaaagaggaaacagggaggagagatgggcgcccggggagggcttcagtttgcaacagggtggtcagaaagtccttgtggcaaaggtgacattgaagcagagacctaaaggaggtgagggagtgcttgggaggtgcatatatcctggaagagcattcaggcagagggaaccgccagtgcaaagcatctgaagctggcaggttcataacagccaggacgccctgtgataagcagacgaggggaaggcaggtggcagaaggggtggggaccaggacttgggagcctctgctttcctctgagatgagaccaccacgggtgggttctgagcaggggacaggcatggtctgatgtccaggctaccagtatcactccagcttctgcaggagagggagaccacttaggagaccacagctatctccaggctcaaaaggcaggtgctcgggcccggtagtggagaggtggctgagaaggggtttgatcctatatgtatttgacaagacagccggcagctttttttttttttttttttttttttttgagacagagtttcacttttgttgcccaggctggagtgcagtggtatgatctcagctcactgcaacctccacctcctgggttcaagtgattctcctgcctcatcctcccaagtagctgggattacaagtgtctgccaccacgcccagctaattttttgtatttagtagagacgggtttttaccatgttggtcaggctggtctcaaactcctgacctcaggtgatccacccacctcggcttcccaaagtgctgggattacaggtgtgagctatcatgcccagtcgagctggcagcttttactgacagcctggatgggagaagtaagagagaggtcttgtggatggcgaggagttctggctggcagatggggcaaacattactgcccttctctgaggctgggaatgtaggacgaggctgctgtgcggggaggtgaccactctattgccggtctgtttcatcttggtttctgttacggaatcttctccccacggactgtgaacagcttgaggacaccacaaggagtggctgcaaatagagtgtcctcctcccacccatccaccccctccagcacagggcctttcccaggatcagacccaggagaggtttgctaagtgaataaacaaggtaccgcccgccctagggcagctggcatgttcaccctcttcccagaatgaggtcagaggaggatattgggtgtcaacctgggccagagccacccttcctggcctcagacagtgtccctccttcccattgcccctctctccccacctccaccagtcccaccagggaacatgagccagggaagtgtggggagaccaggtgtcaaaacccgaggttgttacttagaataaaagggcctgaattcaaggggtgctccactctgtgacctttggcaagttacacaacttctctgagcctcccgtgaacagtgcttttttaggtctccccagagccccagtggaacagcatgaggggcgtccaccaggcttcacccgcctagagttttagaagtgtaatgatccatcattccggcttttttttttttttttgagattgagtctcgctctgtcacccaggctggagtgcagtggtgccatctcggctcactgcaacctccgcctcctgggttcaagcaattcttctgtctcagtagctgggattacaggtgcacgccatcacacccagctaattttttgtatttttttttagtagagacggggtttcaccatgttggccaggttggtctcaaactcctcacctcaagtgatctgccagccttggcctcccaaagtgctgggatgacaggtgtgagctaccgcacccagcccatcatcctagcttaggatcacccagccccaccctcccattttacagatgagggaaaaacggaggcccaagagggaaaatgacctgccccagcccggcacactttctgggactgcaccctgggagcattatccaggtccattatcctgctacctgtccactgcccagggctctcagccccttctagaaaacattgccatgagggggcttctgagagacatcccctccagaagtcatcacaaccagtgcggctaaaactattgtgaccccaccccatggttaggaaacatctaagctgccacttgtactcactcacatctgcagaaccagagcaaaatgttccccaaaagccacccagccttcctgaacgcacactggccggcagtttctattctgtcctagttcatttcttttttttttttttttttttccaagacggagtctcactctgtcgccagactggagcgcggtggcatgatctcggctcactgcaacctccgcctccccggttcaagcgagtctcctgcctcagcctcccaagtaggtgggactacgggcctgcgccaccacgcctggctcatttttgtatttttagtagagaccgggtttcaccatgttggccaggatggtctcgatctcttgacctcgtgatccacccgcctcggcctcccaaagtgctgggattacaggtgtgaaccaccgcgcccggccccggttcatttctttaagggctggttgctaccactacaccgatttcatgacctagtaatgagtcacaacccacactttaataaatagcagcctcagtaacccaaagcccggtgagagacagcaacaatttgctccgctggaatgatgagcacgatttgctggtgctcctcgcataccagacattattctcattgcttcaagtgtgtgtactcagttactcctcatagcaccctgtgagctaagtgtgcttgtgatctccatatggcagagggggcagcagaggcccccgggggaccaggtcacagctaggaagatggactccggcagcctttctcctgagcctgtgcgactggtcaccaatctctactgacagcaggaagcagggatgtatccggcatcctgcacagatggtactccccaagttagctccctgggctctcaaaatgcttttcatgtgctattatatatagcacacgttcattgaacacttgacgatgtgccaggcctgacacttgaaacattatcttaattcatcttcacaaccaccctatgagggtgagatgatcagtgtccccatcacacagatgggaaaggcaaggcacagaggctacagagccagtgggggtccaggaggagaccccaagcgggctgcatctggaacccatgctccaaaccatagcgtttgacttctctttctatttctcacccaccatctttgttctcctctttcttctttgaggtctttctgactctctctctctcacacacacacacacatacacacacacacacacacgcacacacagaggcattttggagtgtttttttttttaattttttatttccagaggttgttggggaacaggtggtgtttggttacatgagttagttcttcagtggtgatttgtgagattgtggtgcacccatcatccaagcaggacacaatgaacccaatttgtagccttttatacctcatcctctccccaccctttccccctgaatccccagagtccattctatcattcttatgcctttgcatcctcgtaggttagctcccacttatgagtgagaacatataatgtttggttttccattcctgagttacttcacttagaataatagtctccgatctcacccaggttgctgcaaatgccattagtcattcctttttattgctgagtagtattccatcatatttataccacagtctttatccactcattgatggataggtatttgggttggttccacaattttgcaattgcaaattgtactgctataaacatgcatcacacaggcattttttgaaacgcatcccttctcacggccattggctacaccagccagcacagcgtggaaggagaagatgggaagagatgcccaagagactagaaagctccttgcaacccagcaggtctgtgcaggtctgtgactgtagactgtatcccctaatgcggattgatcctaatgatcctaattcatcctaatgatgagtcaaatcccagatgggataagagcataacactaggcacagaaaatgaggaacctgcccgctacatacctgattacggtgactattttgattcaaggtcattactcgcacagggaacaggtaaggcagcagcatggcctggctgtatgggccctggggagaggtcttgatgggcacgggaccatcattgagggacagggccttagagatcgtctactccaacctcatcagagtgcagatctgaggccagagaaggaatagcacatgctcaggtcccgtggagagctaggcaaagagtgcacagcaggcccaggtctcctgacctccccccgtcgtcacatccccacccccactgaccaccagcccaccctcctccgctgccagacacagtgagaaaacctcggggccccgcgtgccctgtctggcctggcctctggctatgcccaccatgaagcaccatgtcacagcgtgatggccagagaggctggggcccaccgaggcacaagatcacaagatgatttgtctagggagtttggccaaaaagcagatttgcaaagaacagatagctcaggccacccgttccagaaggcaagatgtcgcttgcctcctgggcacttaggatactctttatttctgtcaccctcatagaaaataataaattgctcatagttcactgacatcctgcattttctaaagcgtccacattcctcttcctgcttaatccctgtaacccagtaaggtagacggagttaggattttcatttccattttacagaaaaggaaattggggccaaggaacactattatttgcccaaggtcttcttgagatggtcactaaccattggggctccccaagcctcaggcctaagcctctcttcatccataggcaagctctctgtgtgtctgtgagatagcttcaacccagatggcacccctgtgctccacatctgcacacccaactgccccacccacactctacatgcacatccccaaggcatctcaaactcagcatgtccaaaaccaaacctttgatcttcctcctctagtctctttttttgtttgttttgttttgttttgttttgttttgttgagacagagttccgctcttgttgcccaggctggagtgcaatggcacaattttggtgcacggcaacctccacctcccaggttcaagcaattctcctgcctcagcttcccaagtagctgggtttacagggatgcgccaccacccctggctaattttgtatttttttagtagagatggggtttcaccatgttggccaggctggtttcgaactcctgacctcaggtgatccaccggcctcagccttccaaagtgctgggattacaggcgtgagccacctcgcccaggctcctcccctactctctactcactgctaggctgggtcctctcccagtccccctaagtggttttttccacccagctggcaagtctgaaacctagaagttaacctcaacgccaccctcttcactacccatatccatccatcaagcttcaattcacctcctaaacatctctcagacacatctgcctctgtccatgccctttgtacctaccctggcccaagcaccggcatcactcctctccgatcagctgcagtagccttctcgctgcttccctggagccacccttgaccccttcgtaatccgtttgcttcttaagatgcaaatcagatcatgacagccctgcctgttctaagccctttaaagtttcccattgctcttgggataaagctaagctctttagctcaactcatgaggccccacgtggcccagacccgcctgcctcctctccttaggtgctccccacactcctccactggctcctcccttcagtgctccccacactcttccactggctcctcgtgatccagccttcttccaggtctctgaaggagccatgcctcctccaccttcggctcctgctgctctctctcccacagccctgccttcattgtgcctaattagctgctccttattcgccagaggtcagctctaccaccacttcctcagggagacctgtcctgatccccacataagctcagaggatgctttgaagggcagcaaagtgtagagcctgaaaagaagggaatgcagtggttagacacacagaccctagagtcagactgcctggattcacaaatcttgaacaaatggcttaacctctccttgcttcagtttggtctctgtagagtggggataattaaaatacctctataggccatgtgtggtggctcacgcctgcactcccggcactttgggaggctgaggcaggcatatcatttgaggccagaagtttgagaccaggctggccaacatggtgaaaccccgtctctactaaaaatacaaaaattagccaggtgtgatggcacatggcctgtaatctaagctacttgggaggctgagacacaagaatcactcaaacccaggaggcagaggttacagtgagccgagatcacgccactgctctccagcctgggtgacagagcaagactctgtctcaaaaaaataataataataattaaaaagtaaaaaacaaaagcattggatttgaatccaggtctatcacatttcagaggccatactattatatgctgcttaagataatgcaataagtagaactaaaataaatttaaaaaataaaaataatatgaagtacttacttcacagagttgtaatgagaactaacgagtttgtgtatgtgcagtgctcaaaacagtcctcggcatactctaagctctctatggacattagttgtctacatgtgacattagcctgtcacataccctcatggtgccatataggtacttttctttcatagcacgttatccaggctgtgtgattatctgatggcatacatgtccttcatgagagtataagctctagaaagacatgaaccaggcctgttttggacccctcatgtctctcatgccaagcccaggtctagcacagcggtgggcactcagtccatatttgctcactggattcacagctagcctagagcaaagcatctccctgctctggaccacgtggccttttccccagtatagagtatactcttggccacagctggccaagtatgactagcaggccaaatccagcccatccagcccaccacctgattttttttttttttttgagatggagtctcactcactctgtcacccactgcccaggctagagtgcagtggcttgatctcagctcactgcaacttctgcctcctgggttcaaacgattctcctgcctcgggctcccgagtagctgggactacaggcatgcgccaccacgccgggctaatttttgtatttttagtagagatggggtttcgccatattggccatgctggtctcgaactcctgacctcaagtgatccagccccctcggcctcccaaagtgattttgtaaataaagttttattggaagacaaccacgttcatttgtttacatattgtttatggctgtttatgtgctacaactgcaaagttaagaaattgcaactgagaccatatggccagcaaagatgaaaatatttgctgtctttcccttcacagaacaagtttgccagtgtcagctttaggcgtgtgtaatctccttgaagccaaagcccatggcttcatggggctggtatgaggtttacaccgctcttagaacaaggcctggtacaggggaggggctccataaatgttgtcaggtaatgtgaagtgccatatgcttactcataggagaccagtaaatatttgttcattaaataaatcagatatttcctgactcttgtgatagattttggcaacaagaccatgcttggctttgtaggaagtgaggacaatttatagggaagttatgcctggactgatgttttgggaagagggacctcagaaataaaaattgctaccttttactgtgcaacttctagtgtgagacacagtaaaaggtaggacccaatttaattctttttttttgttgtttttgtttttgagacagaatcttgctgtgacgcccaggctggagtgcagtggtgagatcttggctcactgcaacctctgcctcccgcgttcaagcgattctcctgcctcagccccccaagtagctggggctatgggtgtgcaccaccatgcccagctaatttttttatttttggtagagacgaggtttcatcatattggctaggctggtcttgaactcctgacctcaagtgatccaccagcctcggcctcccaaagtgctgggattacaggtgtgagccaccgagcccagccccaatttaattcttataacagcacttctcaaactttcatatgcatgcaaatcttgctctggggatctcattaaaatggagattatgactcagttgggggaaagagctgaggggcggcatttcttttttctttttttctgagatggaacctcgctccgtcacccaggctagagtgcagtggcgaaatctcagtttactgcaacctctgcctcccgggttcaagcggttctcctgcctcagcctcccaagtagctgagattacaggcacttaccgtcacgcccggctaatttttgtatttttagtagaagcaaggtttcgccatgctggccaggttggtctcgaactcctgacttcatgtgatccgctcacctcagcatcccaaagtgctgggattacaggcatgagccaccatgcctggcagggctgcctttctaatcagatgccaatgccgctgggcctcaggccacacttgcagcagcaaggccttacaacattcctataagctaaatattatttttactattcccatttcacaggatggggaaactgaggctcagagcagtaatgacccttgcccaagggtcacactgttgataactgacaaagcgaggattcaaagtcaagtgtgactaactccaaaatccccattccgtttgtgacactacccagccagaaatacctccttcaagaaacgtctccaatgtagaagtccctgcttgctcctaaaccagcttccttcccacctggatctgggccctgccaagtctagtggcctaagcatggtgctatttgctggttgcccactgttgccttttttttttttttttttttttgagatggagtcttgctctgttgcccaggctggggtgcagtggcgcgatctcagctcactgcaacctccgcctcccaagttgaagctatcttcctgcctcagcacccccagtagctgagactactgacacgcaccaccatgcccggctaatttttgtgtttttttcagtagagacggggtttcaccatgttagccaggctggtctcgaactcctgacctcaggtgatccacccacctctgcctcccaaagtgctgggattacaggcgtgagccaccgcgcccggcctgttgccttctttctgggcaaagaggcctcttccacgaaaggccagagcttggggctggctcttctgtgccgaagaggcttctgtttgtattccccgctggtggtcattatttagagcatgtcatacgctgccttggtggcttctgaagccgttctgattcctccacattgctctttgctggctgcaacacagcagacccctccctgctctcccgccgccctccatcttgtccacacatgcctggcctctggctgcccacacgcatgcatcccagctccctcagcagccgacgctccctccccctgctggcaggaaggctgagctggggcatccgggttcccacagcagatggggctcaactggaaaaatcaagccctgggctgctgtgagtccatttgctgtgagggcacaattgggtcggcgacctgcaggcatcctgtgggtagtaagaccccactttcttggagggggaaggccagagcctttcttctgcctgttcctctgagctgctgctgctgcgcctcggaagccacaccgacctctttctttctttccttctctcttctgtcattcccctttgtggctggccaggaccatgtccacatggaaagggcagagctattagaaactatctaacggccgggcgcggtggctcaggcctgtaatcccagcactttggaaggccgaggccggtggatcacctgaggtcatgagtttgagaccagcctggccaacatggcgaaaacccatctctactaaaaatacaaaaattagccggacatggtggcgggcgcctataatcccagctacttgggaggctgaggcaggagaattgcttgaaccccgaagacggaggttgcagtgagtcaagatcacgccactgcactccagcctggggtatagagcaagactctgtatctaaaacaaacaaacaaaaagaaaccatctaacaggccataccccatgttacacaggggaaaaacagaggaagtgagcacccgccttagccacacagcaagtgagtggcacagctgggacccaaacccagttctccaggccctgtggcactcacccttcctgggctccttggaagccacatagggagactacagggtgctccaaaagttgagctggtctggatatgaatcctggttcactagctgggtggcaggggagtttctctctctgaacctcaattttcttgtctgtaaattggggcaaaaaaacacaccctgccgggctgttatgaggatgaaattatatcatatatgttaggtacctgctcaagacccaacaccgaatgggtgtttaacaaatattctctctcttctcctgggttttcagtaagctctcaccatcctcatgtgcttataaagatgagagttaaggtggctttttagtcatgcatgtctgtcacgcgtgggtgtggatgtgggtgtgtttgggctgggggatcaggttagggatacagcgtgttgtcttagcaatgatttgcaaggagagaacacctccctggggtctgtggaggagcagccccatcccgcccaagagaaggagggtgctgaggctgcagagtagcccagccaccccaagcccccatcctcccacccctgcttccctatatgcagctcagttttgccccaagagccctgcccttcttcaggtcccccccaaataacccactcacccatttgtgagcagtgtagactatgctgcagatccatggtgaggacagaagaagagttttcacatcacacacatctcagcaaactgcctaaaatccccttttaacgcctgtaatcccagcactttgggaggccgaggcgggcagatcacttgaggtcaggagttcaagaccagcctggccaacatagcgaaaccccgtctctactaaaaatacaaaaactagccaggtgtgatggcgcacacctgtagtcccacctacttgggaggctgaggcaggagaatcgcttgaacctgggaggtggaggctgcagtgagccgagatcacaccactacactccagcctgggcaacagagcaagactccatctcaaaaaataaaaataaaaataaattttaaaaaagaaaaagaaaaatccctacagttctatatagagaaattctcttctcacagatccttcttgaacacactcccacccaaaggggtggggacggggatggggataagaggaagctccgctcctggcacattcccctccaaaaccaacctccctgaccaatccctgggcttggccaaagggtcctgtaattatcaggactcaacttccttagaaaccacttaagcaccatttaaagaagacatctttggccaggcacggtggctcaagcctgtaatcccagcactttgggaggccaaggtgggcagatcatgaggtcaagagtttgagaccagcctggccaacatagtgaaaccccatctctactaaaagtacaaaaattagccaagcatggtggtacccgcctgtagtcccagctacttgggaggctgaggcaggagaatcacttgaacccaggaggcagaagttgcagtgagccgagattgcaccactgcactccagcctgggtgacaggggaagactccgtctcaaaaaataataataataaagaagacatattttccctcacccctgcctcaagccagctctgcctcctgcctagcccatggctcccaggacacggagctgggtcctgaggtcactcactgcctatttgaatttggattaaaaaaaaaatgttttacttcgcaaagacactttgtgaagggctccccaacacctctgggtcctcattcaggtgctgctccccccacaaacacatgtagccccgacctctgcccttagccacctgtcccccttttcccccatccacccccaactgtaggagccctggccctcaccttctgtttctcccttttcattaccatattcttttcttctccggtcctgtttgtcagtccttatctagaggggtttctcttcttactttgttttctttgcaatgtgcctgttccttccttctggaccacgaccccacatttattcacttaatgagcttctattggcagactactgtgtcgttgaacagagaggataaagacaagaaactttttctttgtaaagccacagtccttgtctcacgacccatggttcatggtggaagcatatgtatacacaaatatttattataatatcatgcattgaatgtttattatagacaccagaaacttatctaagtgcattgcctgaatcaactcatttaatcctcacaacaatcttaggagcttggcattattaccatccctgctttacagatgaggaaactgaggcacacagaggtgagatactttttctattgcacagctaataaatgctgcagccagactcaaatccaacccacgtggttccacctaaccactataccacactgcctctcagcgtgcccaagggccccaaagtgcagacgagggagctcataactttgcctaaggaagtcagggaaggctttacagaagaggggacttcgagctgggttttgaaggatgaagaagagtttgctgagtgaagaataggaaagacattccagtaggaagctctgtatttcaaaagtcagcagcatgaaatgacatgtcgtgggaagtttgatgtggtgggacgagagagaacatgaggactgggagccgtgggagctggaagtgggcagaggccaagtcacacagggccctgtgtgcctgacggtgtgctggagtttggccctggaggcagtggggagctcctgcagggctgtgagctgggcagtggcctgctcgctgtctctccctccctaggattgcaaagcaacctctcctctaaggctgtgtccataaacccccagcgcctcggggctgctctcccacctgcctctgtgtgcctcagtctcacagccatgccgttctctttctccctgaccctctgtgttccacaggggccgtgagggcctccagcattttcccaatcctgagtgtgattctgcttttcatgggtggcctctgcatcgcagccagcgagttctacaaaactcgacacaacatcatcctgagtgccggcatcttcttcgtgtctgcaggtaacagccactgatccagtcctgccactgggaagaaggctggggtctgggtgctcaggggccacgagggcctggcagagagagatggggagagaggagaggaaatctccaagacttgcactaggtcgtgttgcaggggaggaaggtggtgggggggctcctgtcctgtagcaactcccgagcctgtaccaaatcctccaggagcatccccacaccccatcttcttcccaccacttgagaaaaggcccaaatgcccgcttcctctcagggtacttggccaattgccacttaccctttcccttcccggtgcaagtaaacccatgaggaggctggagagagggcacccaagtgcctcgctgttccaacccctatgggatactcagcttcaccttggaaaccaagggtggactctcccctcactgttctactcaggtgggagcaggcaggcacccacatccagatgtctgagcccagttacatgacagatgagtcacactcacttcagatgccagaaaaagaacctgggtgtagcctgagccatttaataagaatgaccaacatcaggccgggtgcagtggctcacgcctgcaatcccagcactttgggaggctgagacaggaggatcacttgagctcaggagtccgagaccagcctgggcaacacagcgaggcctcaagaccgcgtctctacagaaatttttttattttaatcagctgggcatggtgacgcatacataatcccagctactagagaggctaaggtgggaggatcgcttgatcccaggagtttgagactgcagtgagctgtgatcacaccactgcactccagcctgggtgacagagcaagactgtatcttaaaaaaaaaaaaaggaaccaccaacatctaagagtactcacatgtattcacccatttaaccctctccgtggccctaaagagtaaggcttaaccttactcccattctacagatctggaaactcaaaccaaggttaacttgcgaaggctttgaacgcaggccagcctggctccatcagcccgccttcacccgctgctacaccagctttgaagccctgtgcagccttaagcaagttccttaacctctctgtgcttgtttcctcatctgtgccctgcttgagaagcaccaagcagtgaaagcaggtagagaaggctcaatgaacaatatctattattagttactcagcgccttgtgaaatgcctcccttctcccgccctgcccatgtctgtttccattagcgcttcccttgtggctctctctgaatggaaagataaaatgttaaggggaagcttgcggatgtccatctacaccgccccacctgttcatgaaggcgcgggaccggggaaggcccacacagctgtccccgtcctttacggctgccctgtggccgacttcctgagaaactaacgtccttctctctgatcccccaccccgccaccctgcgccccgcaggtctgagtaacatcattggcatcatagtgtacatatctgccaatgccggagacccctccaagagcgactccaaaaagaatagttactcatacggctggtccttctacttcggggccctgtccttcatcatcgccgagatggtcggggtgctggcggtgcacatgtttatcgaccggcacaaacagctgcgggccacggcccgcgccacggactacctccaggcctctgccatcacccgcatccccagctaccgctaccgctaccagcgccgcagccgctccagctcgcgctccacggagccctcacactccagggacgcctcccccgtgggcatcaagggcttcaacaccctgccgtccacggagatctccatgtacacgctcagcagggaccccctgaaggccgccaccacgcccaccgccacctacaactccgacagggataacagcttcctccaggttcacaactgtatccagaaggagaacaaggactctctccactccaacacagccaaccgccggaccacccccgtataaagaccgcgggcctcgccagaagaccgcgggaggagggcgcggtccccgggggcggggcggggcggggagacccagaccctccgctgggagaccttccaaaagcaaaaacaaaaaacaaaaaaaacaaaaaaacaaaaaacaaaaaaacacacacacacaaaaaaagagaaaaaacataacaagtaaattttaaaaaaaagaacaaaatataagaggaacaaagaagcaaaacaacaggaaatgtgggaaaatataaacgagggaagaaaacaaactttaaaaaaaagcgagagggataaaaaattaaaaatagaaaataaatctaaaagaaaatgcatgatttcccatgtaccattattttaacatttaataaaaatcaatttaaatgaaaaaataaaagggaaccaagataacattaaagcaaaaaaaaaaaaaaatgagaacagaaaggaaaggggatgtcctttgtatttttcagggtttatgttactttttttttttttttttaactcggggagagttacttttctgttccctttaacccccagcgggccctgcctccctgggagattggggggcgagactcaggggccctggggccaggtgagcctgcagtcactgccaggtccctggagcccctgggtgggtgccccaggaacgccaggaaggctcagagctcgagccggctccgcccagcattgatggggcaatcgtaggcctccaggtgaccgagcccttgtccctcctctccgttagggtgcctggaggggggtacacttggggcttgcctggccccaggttcccagtccttaatgctccttaacccactgtgatgacttcctaggccttgaggaaagggaaggagaggggaggctgccggtggcttaccaagatgccggaaaccccggaatcctcagggtgagcctcttggggtcatgtccccaagctcctgtccttggggtcaggagatgccaccccccccgggggacatgaaacagctctccctcctcacccctcacctcagggccacctgatgaccctggggcgatggtggaccccctgactcataagccccccagtcccctgggaagggggttcattgaccctttgggggtccttggactcactgatgcccccttggggcccagcgggttcaacaatgacactgcaaaaaggtttctttttacaaaagaaaaaggaaaaacaagtggtgatttttttttaataaaaaaaccacagactataaataaatgtaaatacaaaataagtggatttacttgcaagaaaatcagatagtatttttcttttaattcttttccagctttaaactgtgaaaacaaaaaatggggcggggtgggggacttaaactttagcagggaacttgtaaagaaaaaaaaaacagaaaacgaatatacaaatccatttacaaaaacaaagcaaaaccgttgtgagaggtgagagctgggcttgaaggttggagggagtagcggaaggtcccagtgagctgcagggggtctctgtgatggaaaggtggcttcctcagacaaggaaggtgctgcgaatgggggaagacagaatccaacaaagaaagagaccacacaccccacacgcacacaggcacgttcacacacacatacacagtccacttagcccagcactgcagtcactcacagggacacactcagtctcaacccttccatcccatacacggccaggggcgtggctcaaaggaaattgactcatgccctccaaagccatggacgacaacaactccacactggcctttgtgttcattcacaacctcccaacagagcatacacatgaacacacacatgcacacatacccacacacgcacacatacccacacacacacacacaccactcgcatgcatgggaagggcacccgtctagaatccaggactggattccggaattccttgctgcatggcctctctgggccttaattttccccccatgtaagcatgtggattgacccagag

SEQ ID NO: 15128 - DNA, 41380 bp, Human
  misc_feature (1)...(41380): n = A,T,C or G
cttgaacgtaggaggcggaggttgcagtcagccgagtacatgccattacgctccagcttgggtgacagagtgaaactccatctcaaaaaaaaagaagaaatattttcattaagatattcagccatcactgtaagctttctcagattttacgtgtgagagggaagcaactagccagtttgcctttctcagggtagaattcaagagttttgttcccctgctgtttatgaatttgatattccttgactaatgtattcagtttctgttctagacatgagcatgaatttctgatttgcagatgtgaatcactgcctatgcatatcgtgctgctttttgttacaggtcctgccttaccttgctgtctctcctcttgcagggtctgacatttcaggaggtggagaacttctttactttcctaaagaacattaatgatgtggacactgcattgagtttttaccatatggctggagcatctcttgataaaggtaatgaaactcaaaaagtgtttttttgaaggtatgaacattggatctgtaatctcttaggtgactgcccctcctggaacagtaaaagataagtttttcttggcatccttgaaatggtgttttgatttgttgacattgtatgagccttgcatttcaccctgagatgccaagttcagtgaatatattttcttgtgctaaggccgtagtctgggcaggtgcctatctttaaatgactaaccttgaaaataagcatctaagctgaggcacagggcatgaagctgcagaacttcccctatctgagccagagtcattatatatacaatgtgaagctaaagtcactatacaacttaagttgcgtctttgatgagaaggaatgctttagtttatttcttatattaagactttttttaagacaatatgactctgagaataacaccccgctcctttggcttacttcatagaaattcagttacagtttgtacaagcaacgtgagagcacggaggaattgaaagcacaatttttccctcaacatttcattatgaaaatttttaaacattcagaacagttgaaataattatttaaataacatccacatattcagctcaactgacattttgctatatttgcttgatcgtatgactatgcatattttcacctctctaagtaatcattgatcttatttgacatgttcaaagtaagttgcagacgtaagtatacttcactcccaattagttcagtatgaatattaactaaagttcaagattcatttaaagttctttcagtccccttcacagtttttgcccccactcaccaagaggcaacctttgtactgtatatttttccaccatagattaattttgctttttctagaacttcatacattggaattatataaatgtacactcgtctaaggtttcactcaatgtttttgagatccatctccgttgtgtgtcagtagtttaatccttttttatgatgagtagtaacccattgtatgaatatagtcaggcatggtggttcatgcctgtaatccgaacactttgggaggctgaggcaggtagatcacctgaggtcaggagtttgagaccagcctggtcaacatggcgaaactccatctctactaaaattgcaaaaattagccaggcgtggtggtgtatgcctgtagtcccagctactcggaaggctgaggcaggagaattgcttgaatctgggaggcagaggttgcagtgagccaagattgtgcaggattgcttgagcccaggagtttgagaccagcctgggcaacatagtgagaccccatctctctctttttttttttttaataaggagtatatgaacatatatgaaagtcctgaaatgtcagctattgtaaatgctgccaacttggtcttctttttcaagattactttggatattctaggtcatttgtatttccatataaattttagaatcagcttgtcactttctatgccaaaagaagtggaattgtgattacagtaacattgagtatgtagatcaatttgggaagaatcaacaccttagtgtaatatagcatcttataattcacgagcataatatatctccccattttttaaggtctcattttctctcagcagtggtcttatagttttattaatacaggtcttgcacatatatttttaaaatttgtgcttaagtattttatggttttcgatcccattataaatggaattggttttattttattttctaattgtttgctgctaatattaaaatataactgatttttatatattaactttatattctgtaattttgctaaattcacttattcttctagttgttttgtagattcctcaggtttttctatgtaaataatcctatcatcttcatacagagatagtttcatctccttttttaaaaaaaaatttatggctttttttttcttgctttattgcacttgcttaccccaccaatacaatattgaatagaagtggtgagagtggacatccttggcttctttctgaactttagagaaaagtattcaatattgtaccattaaattggatattagattagatttttcatagttgctcgttgtcagattaagaaaattattttctgttatttgaaaagggtttttgtcatcaatggctcctgtattttgtcaaatttttttctatatatattgaaatggtcatatggcttttctgctttattcttttaatatggtagatgacattgactattccttatcctgaaataaacctaatttgtaatgatgtattagcttttttaatgtattactagacttgatttcctaacattttgttaaatattgacagatattggtctgtaatttttttttttttttgtaatgtcttttcgggttttatgtcagagtattttatcctcataaaatgagttagggactgggcacagtggctcacacctgttatcccagcactttgggaggccgaggcaggtggatcacctgaggtcaggagttcgagaccaggctggccaacatggtgaaactctgtctctactagaaatacaaaaaattagctgggcatggtggtaggtgtctgtaatcccagctactcaggaggctgaggcaggagaatcactggaacctgggaggtggaggttgcagtgagccgagattgcgccattgcactccattctgggcgacaagagcgaaactctgtctctaaattaattaattaattaaattaaataggccaggcatggtggctcatgcctgtaatcctaacactttaggaggctgagacgggcagatcacctgagatcaggagttcaagaccagcctcgccaacatggtgaaaccccatctgtaactaaaaataacaaaaagtagccgggcttggtggcacatgcctgtagtcccagctacttgggaggctgaggcaggagaatcacttgaacccgggagatggatgttgcagtgagctgagatcacgccactgcactccagactgggtagcagagcaagactccatctcaaaaataataattaaataagtaaataaataaaatgagggatttttccttctctgttttcagaagtttctgtaagatgagtattgtttctttctgagctgtatttgatagaattcatcagtgaaactatctggacttgccaatttctttctgaaaaggttttgataatttaattttttaagtaaatatgtaaggtttgtgttttatatgaattttaggttatatttttgaataatttgcccatgtcatctatgttattgaatttattgacatgaagttgttcataatattccattattatccctttgatgtctgtagaatctgaaatccccttttactcctactgttggcaaattatgaattctctttcttttttaaaaaaatatttcttactcagtctacctaggggtttagcaattttgttaatcttttcaaagaaccactttttgactttgttaattttctctatggtttgttgcctattgagttgatttctgctcatacctttgttacttattccttcacttattttcagtatatattattttgtttttctttttctaagcttcttaagatgaaaccttacttaccttttctaaggtaagcttgtgaagctataaatttccctataaacactgctttagtctgggcgtggtggctcacgcctgtaattccagcactttggaaggtgggtggatcacttgaggccaggagttcaagaccagcctggccaacagggtgaaactccatttgtactaaaaatacaaaaactagtcaggcatggtggcacacacctgtaatcccagctactggggaggctgaggcaggagaattgctagaacccaggaggcagaggttacactgagctgagatctcaccactctactccagcttgagagacagaggaagactctgtctccaaaaaaacaaacaaacaaaaaacacataaccaaaaaataaaacacacacacactgccgggcgtggtggctcacgcctgtaatcccagcactttgggaggctgaggtgggcggatcacgaggtcaggagatcgagaccatcctggctaacacagtgaaaccccgtctctactaaaaatacaaaaaattagctgggtgtggtgatgggcgactgtagtcccaactacttgggaggctgaggcaggagaatggcgtgaacccaggaggcagaggttgcagtgagccgagattgcaccactgcactccagcctgggcaacagagcgagactccgtctcaaaacacacacacacacacacacacacacacacacacacacacacacacaattttggtatgtaatattttttacatcatcctgttcaaaatattttctatttattaggtaaatttgtggactatttaaaagtatattgtttaacttccaaatattttggttttagctgcatgtggtggcttacacctatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtttcaccatgttaggcaggatggtctcaatctcctgacctcgtgatctgcctgcctcagcctcccaaagtgctgggattacaggcgtgagccaccatgtctggccagatagttaggtttctaaaagaaaaaaaattaggctgttaacagatagatacatttaatttttcttttttacatttattgtttattttaaaaaacagagatggggtctcactgttgaccacgctggtcttgagctcctggtctcacaggatccttctgccttggcctcccaaagtgctaggattatagtggttggtattgtaatagttaaattcacattttttgtttgcttttgtttttgtagactacatatgggtgggttttttttttttctttttgagacagagtctttgtcacctagactggagtgcagtgatgtgatctcagctcactgaaacctctgcctcctgggttccagtgattctcctgccccagcctccccagtagctgggattacaggcatgtgccacgacacctggctaatttttgtatatttagtaaagacagggttttaccacattggccaggctggttatgaactcctgacctcaagtgatccacctgccttagcctcccaaagtgctgggattacaggggcccagcctcatatgggtaatttttaattcttggttgctgtagtgggttacgtggtggcccccaaaaggatatgtctacatcttagtcctcagaacctgtgattgtgaccttgttggacacagggtctttgcagatataattaagttaaggtccttgagatgagatcatcctagattatccagctgggctctaagtcaggcatgattacaggcatgagccactatgcccagccaatagatgtttattaattgaattactcttcaaatattcaggagctcaaaaaaataggcactatcagctgggctctttggctcacacctgtaatcccagcactttgggaggccaaggtgggctgatcttgaagtcaggagattgagaccatcctggccaacatggtgaaaccctgtctctactaaaaatacaaaaattagccgggtgcagtggcagcgggcacctgtaatctcagctactcaggaggctgaggcaggagaatcgcttgaaccagggagtcggagattgcagtgagccaagatcacaccactgcactccagcctggtgacagagcaagactccgtctcaaaacaaacaaacaaacaaacaaaataggtactttccttgattccttagtctcactcacatatttacttcttcaataaatccttgagtttacctccagaacgtaccctgcatctgcctccttttctcgctctcctaccacagccctcgcctctttactgactgtggctttacacagggctacctatgccatggcccctgtatactctctgagttcataaaatatcgtttttttcccagttcactccactccacattgttctttttacattccaaatacaccaagcttactgaaggccttagctattggagttagttaaggcctttgtatcggttgtttctacctcaagcgctcttgcctgggatctccatgtatttagctccttgtaacttaggtctggtataagtcatttcctcgggaagaccttttcattctaaagtagttccatcatcctgtatcatattatcctattttttatagcatttatcactccctgatattttctcaggtttatgtgtttgcttattatttgttgcaccttactagaatgcttatctgtcttgctcatggatgtattccatgtgcctagaacaacacttgggatagaggaagaactcaataattatatagtcaacaaatgaatgagtgaatgaacatattgatatatctgaacaagacataaacctctacccttctacccttcccagcagcccagggaacaaactcatcatgttcttctgtaaccctcatccttggacttgacatatgtttcaccttcttccatgtaaaagaggtgatgatagtagtaattttaactgttcacctgctgaggtgtgcacagaagactagcatgcactcagctagcctttccaaatccttccatgctcccagatgtccctgtctcttacaagcactccttgggctctgcccaggcctttgcttttaaacctccctcctcctgacccggactagtgattctttccattggtttgagttctacatgaatgacaggcctctcctccttgctccacagaacaaaggaattttactgctgagatgaatcttagaaaagaggaagaaatgtgtaatggttaagagcagaagttctgaagtcagactgcctgaatttgaatgtctccatcatttactagctgggtagctttgagcagtttctgaacttagtttctgtgtttattttatttttttaatttttttgagacagggtctcactctgtcacccagactggagtgcagtggtacgatcttggctcaccgcaacctctgcttcccagggtcaagaaattctcctgcctcagcctcctgaagtagctgggattacaggcacatgccaccacacctggctaatttttgtatttttaacagagatgggggtttcactatattggccaggctggtcttgaactcctgacctcaaatgatcgcccacctcagcttcccaaagtgctaggattacaggcatgagccactgtgcctggccctctgtgttttttaaataaagataaaaatagttgtcccttggtatcttcaggggtttggttccaggaccgcctccaccccccgaccccgccacacacacccagagttacaaagtctttgggtgctcaagtcccatatgtgaaacggttgcatagtatttttgtatataacctacacatatctttccatatactttatttctttatttttaaatcatcatcaaaatatggaacacttcacgaatttgtgtgtcatccttgcacaagggccatgctaatcttctccaaatcattccagtttgagtatatgtgctgccggacgagcactagatgcgggtgacccttgaacagtgagggattagctgttttcaccccacacagttgaaaatcctaggataactttagactccccaaaaacttaactactaatagcccactgttgaccaaaaaaggcttactgataacatacagtcaattaacacataaactagtatctatatattttttatgtattcactacatacatttttcctaatttttttggtacgtctatgctgtgtggtccatctatgaggttttccaaatagtcataagcctccaaaaatttttccaacgtaatttattgaaaaaaaaatctgcacgtaagtggacctatgcagttcaagcctgtgttgttccagggccaactgtactttaaattatctcaagattacatataatacctattactatgtaaatgctaagtaaatagttgttatgctgtatttttaaatttgtaatagtttattgctgtgttgttactttctactggttttcttttcttaaattttattttatttatttattttttttttgagatggagttttgctctgtcgaccaggctgggctggagtgcagtggcatgatctcgactcactgcaacctccgcctcccagattcaagcgatcctcctgcctcagcctcccaagtagctgggattacaggtgcctgccaccatgcccagctaatttttgtatttttagtagagagaggatttcgccatgttggccaggctggtcttgaactcctgacctcaggtgatccacccgccttggcctcccagtgttgggattacaggcgtgagccactgcacccgacattttaaatatttttgatctgcagctggttgaatccatgggtgtggaacctacacatatgaaggaccaactggacccacctcatagggttgtgagactaaatctacataaagcacttaactttgtggctgtcatgtggtgaacgattagtcaatgtcagctgcttctattatgaagttgataatttaaacaaaatttagtgtggctcaagtatttattcacccaaaagcaataggtactgtgctaggcacagggttccaccctcaagaagctcagagtctaatgggggagaaagataagtgtagaagcagttccagttgggtgtgataagtgctaattagaataagaggttctaggagcttaaaagtggaggccctaatttataccagtggttgggaaagagtgaggccagagtagagacaggaatactttttatctggcttctgctgtgagtctcagctgtcttcattttttcccaaaaggttagaaccttcagaaattggcaccttctaggccctggcactgtctcttccttggctattttagaggttacaaaccagtctttaggcataatttagcacagaattttccaaacagcattgtgaagaacactgtatactgcaatatgatgatggttctgtggatttaaaaagaaaaaaaaaagtattccatggttcaaataagtttggaaaatgccagagttatatagaatttcttcttgcagcactcctgctgccaactttttaatatatgaaggtgcattattaatctctggaagagggatatagtttccaaatttgatttactccagaccatcttttaataacttacagagttaatgttccttggaataatttgaaagatccaggcaggtggccactgcagatttactgtattagaacatagtccagttcctccagagtaaaaaatgtcacatttcttttttttctttttctttttttcattttttctgtttgcccctcctaccatttgaaaaaaacatcaaatttaattaaggctatttctttagttctgcatgacccatgtgagaataacaaccatcaggtaataatgaagtgttttcaagagttctaaccatctgaagaaagaacctttctccacgaaatactgtgtgtctccactatcaggcgtctcttcgtttagcacttaagaagaactggttctattgctcattcgtacgcacactgggcataaaattagatctatgacctctcagcggctggctgattgatttaagtggtctgctgaagaaggtaatggaaaattgaacatgactcctttcccaatggctttctatgatgaaaaagttagaaattatttgagctggagctctagagtgagcttcagcccatataactcagaatattccaatttctgccaggagaatatccaggtacaataaagctccactgtaaagcacctcaggatagtacagatgcagtaaacctgtgggttcagttacgtcctcggtgtactttgaactataaaatcagaaaataatcacacaaatatagtccctggtctttactattcacgcccctgcacaattctacttacactgaaaattataatttatggcatagttggccttgattctttgtagttattctatacgtgcagtttaccttattatctgacaagccgaaagaaccaataataaaatctatggcataactcctacaggagctttctgcaaccccaagtattttttctgaagttttagtcacatcttcaaatggtctcagtttcttttgtctctggagggacaaggatggcagagatgacctctgagaacctttgcagctttcaaattctttgagtctaataattggaatgagtaagggagcctcaagtcttttgtcatttaggctctaactggattgttggggaagtcagaaattactgatggagtcagcaatttctagcacacaacaaactcttatattctgaacaactgtctttaacagacaagctgccacccactcctgaactgtaataatccggtagcactgtcctgtccaggactgtgaggccatcacacatctggaacactaacagcaactctcatttcatagtagtttctctgtgccaggcacaatgcttagtgctttatgcatgttatcgcttttaatctttaaaacctgaattatcctcattcatcttcactttatggatgaggaaaatatcaaatgaagccacttgatcgtggttatccagcttagtggtggaaaagccaggattcaagctcaggtctctctaattcccagtctgtgttctttccacatcgtcgtgttgcctctcagtatactccacaattctgttagagtctgaaaagctttgctgaagcacaatccagaggggactgtggctttaccatttcaaaccatgcttcacagtagcattgggaagacagactctggacttttttttcccagttgcttttggctaagagttgaccattcttagggtgagaatgaagtccttttgataaactatgatgttttagagatagtgcccttctcttgaatatgaaatgtgacctttttttcccctacaattgtctgttctgttcaggtataggttctacagctcagacacagacatccatagtccttaccttacaataacagactcttggagttgtctaatctagcttcttgtcctgcataggaacgccttagtagacacatctgtgatctttacctttggaaccatattacttttcactgaggaaaccaatacacaaaagcctgaagtcatttaaataaagtcatgtagcaagaaagttgatatccttttaagggataccacagaccagaaaaaggcatgtatgctaagctgcgcttttctcaacatcaaaatacaggatatagatacaccttccaatgaccaaggtgttcctcaccacctccgctcattggtataccagtgctctgttgcacttttagatactgttctaacatctagcatttattgagcgttaactatatgcaagaaattgtgctgaatataaattttggttttaagttcaaacctgagtttgagtccccgctattcactagttttgtgaccttgaacaaattccttaagttctcaaagcctcagtttccagatctgtagaatggtgatagtagaatacttgtttcagggttattgtgaaaataaaaagagataatactatattaatatactaggttgacattaaaattgtaccaaactgcctgttctggttttcaacccataggtgctggctttcttctgcctgtttatcttattagggggctggaaacaacctataccaacatggcaacatcataaaaagtgtttttttttttaaatcatccttaaaaaaaaaaaaagcaccagataaggcttactctttgttctctgaggaagtggaatctactgcttttttttagtcacttttgacatttttattagcttagaagttctaagttgtttatactcattaatgaggattgaagcttctagattctcctaagtttcatcattcatccaaaaattattggtgtctctgccttcagaagcctttattaaaaaagttctctgttcctaggaatatctaacccctattgatatgtctcatatcttcagcattcaagggggaattcattagactgtaaattctcaaagacttgaaccatgttttctacaactttgtgtgctattcagagcctagaacaactctttatataaacagatgttcgtttatgttatgtaaatgaattaattctagacctttccagatcctgcaaaggatgatgaaatactctagtaagagcgtagggtgaggggaagagtgttaggactgtagcaccttcccatgtcattaatttcctttgactccttgagcaggtcactactctgaccctcaggttggagttataagtatctctaagggttcatgcagatttgaaattgtatgattataactaaatcagctttttactgaatgaagtaatgttttaagtgacatgtcatagcctaaaattatttccaaatctattgcctcacagggactgttagcccaacttgtttatgtgaaatctttatgaaagtgaactgacttataattgtcaggtacatttgaagtaagagcaagacttgaattcccaaaagaagtgtggcagttttaatttatttccttgttaggaaatgtaaaacttaattagaccttggctagtttccctgtaagatctaatttatggagtttggtatagtaggtaaaacagaatgatggttctgtaaagtgcactctgtcaaaaaatgagtgcaggccagggacagtggcacaaccttgtaatcccagcactttgggaggctgaggagttccagaccaacctaggcaacacagtgggactctgtctctacaaaaaatactttaaaattagccaggcatggtggcacacacctctagtcccaactacttaggaggcggaggcaggaggatctcttgagcccaggaggttgagggtacagtgagctatgatcatgctactgcactccagccggggtgacagaatgagacactgtatcaaaaaaaaaaaaaaaaaaaaataggtggcgggggatgagggatgagtgcggctctatataacgtagaagttgaggaacttcaaaaagatagtcccttgtccgggcacagtggctcacgcctgtaatcccagcactttaggaggctaaagcaggcagatcacctgaggtcaggagttcaagacgagcctggccaacatggggaaaccccgtctctactaaaaatacaaaaattagcctggtgtggtggtgggcacctgtaatcccagctactcagaaggctaaggtgggataattgtttgaacccgggaggcagaggttgtagtgagccaagatcacgccactgtactccagcctgggcgacagagcgagactccgtccccctccaaaaaaaaaagacattcccaatcataaatgccttccccactggccagtttctgtgattcagagtgttggcacagcatagctgggttctctgcttaggatcttaacaaggatgaaatcgcagtgttgttggggggccttcattttcatccggagttcagggtcctcttcaaagttctttcctgctgttggcagaattcaggtcctttcagttgtaggaccaaggattccttttccttgctggctgttggccagtcattgctctcagcaggtgactacagctccttgccaccaggcccctcacagcatggcaactcacttcttcagagccagcaacagaatctctcgcctcagtctgctaagatggattcttacataacatagttatgggactgactagcccatcacctttctcatatacagtaacctcatcacaggattatcgtagtcacaggttctgcccacctgaggagaggggattacacaggatatgtggaccagagggtggaaatactgggcggggggcacgtcagaattctgctcagcacaccagccatcattttagaaacctacacctttggttttattattctgaagatagggacattttaactgatttaaattttagggctggaagataacttaaaaatcattttgtttaaacccttactttgttttttggttttttgtttgtttggttggttttttttgagacagtcttgctctgtcacctaggctagagtgcagtggcatgatctcagctcactacaacctccgcctcctgggttctagtgattctcctgtctcagcctcccagttagctgggattacaggcacacaccaccacgcccagctaatttatatatttttagtagagacagggttttaccatgttggccaggctggtcttgaactcctgacctcaggtgatctgcccagctcggcctcccaaagtgttggatttatagacgtgagccactgtgcccggcctgcttgtttttaacattcataaagggaaatgacttgctgaaatcacagaccagaagttcaggttcagcgacttccacaccagggttctcattagtaccctggcacctactgctgctagaaggagctagagaattacatcgaggactcaatgcttttatgtgatgccggaaagtggggcaaattcacagcaagaatgtagggagagcatcccccagacagccaagacatggcaggaaggcaggagtgtcacaaagacatgtaaggaagagattacaacaggaaaaaagctcctattttataaattcttttaaagtttgtgggaggcaagctcttgcacttcagttcatcattacatttggtaaaaacatttatatgtgaagaggagtgttggccaggattccattcatttaagacagagtcatcaatttttaaagtaaaattattcatgatgtaggcaaggaagctcaaattctgaaataaatgtttgctttatgaggcattttctctgcagaggcctggtttattttcccaaatttaaagtcacttagcaattctaaagattgattctggcttatgatcactttgaatatattatgatttagtaaaattaggtaagtgccctaaggaggaggagagctgctttagggattcatgattaccatcatgaattacatcacaaagagaagagatgggggtaggataaactgttaaagcatccacataaatagataaggaaagacaaaatcagccaacattacatcccactgagaaaaagatcagaaaaagaatgattactagaattacatcaatatcgggaaagtgtagagggagtatttattataagcattgcttctttgggggtttcaaggtttactaccttgagaagcctcggaaggtttaataagacactgtggctgggcccagtggctcatagcctataatcccagcactttgggaggccaaggtgggtggttcgcttgagcccaggagttcaagaccagcctgggcaacatggtgaaaccccatctctacaaaaaaatacaaaaattagccaggcatggtggcgcgagcctgtagtcctagctacttccgaggctgaggcgggaggatcatttgagcccaggatgttgaggctgtggtgagctgtgccctcactactgcactccagcctgagcaacagagcaagaccctgtctcaattaaaaaaaaaattttttttaataaaattgtttaaaaatgcaaaacctagccaggtgtggtaatccacacctgtagtcccagttactagggaggctgaggcgggagaatcaggagcccaggaggcagaggttgcagtgagccatgatcttgccacagcactctagcctgagcaacagaaccaagaccctgtctcaaaaaaacaaacaaaaaagacacttgtaaaggtgactatttagtctttaatttcaacaaactgaatttaaatatatcagttactctcagtttagccatcagagattcagactctgttatagctgacccccacagaccacaaaggaaataattttttaaagagaaggggaaaaggtaccttcttctcaagattgagataagaataaataaggaactggttaaataaacaaggaaattatgatccatcctgtcagtggaatactatgcagctattgaaggaagctgctcatgtccatctggaattatttctaagatatgttgttaagtgagtaaagcaaaacaatatttagtacaccaccattttgtgggaaaagggaagaagcgaagagtacatatttgattttatatctacaaaatatttctggggaaactagtgatattgattgtctctgaatgactgggtgactggggtataaggttgggagagagacttcaccccttttgtaccattcaaattttgaagcagatgactatattagcgaatcaaaaacatcttttttttttttttttttgagacagggtcttgctctgttgcctaggttggagtacagttgtgcagtcatggctcactgcagacttgaactcctgggctcaggtaatcctcccacctcagtttcccaagtagctaggactgcaggagcgcaccatcgtgcccaactaatgttttttaaaatttttcgtagagatgaggtcttcctctattgcccaggctggtctcattcttggcctcccaaaccactaggattataagcatgagccactgcacctgtcctaattaaaaacaacttttaaaataaagctaacagaatgaatatttaaacaatgtgagagggaaaagcaagttactattggacggaggcttgctctgtcgcccaggctggagtgcagtggcgtgatcttggctcactgcagcctccgcctcccgggttcaagtgattcccttgcctcagcctcctgagtagctgggattacaggcatgtgccaccacgcctggctaatttttgtatttttagtagagacggggtttcgccatgttggccagtctggtcttgaattcctaagctcgggtgatctgcctgccttggcctcataaagtgctgggattacaggcgtgagccaccacacttggcctgttttaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagcactccttcctgcttttaatactgtattcaaacagaaacccccaacccacatcactcactaccatacatgcgcagttggtctcttttctcccttagaattcagatacaggccaggcgcggtggctcatgcctgtaatcccagcactttgggaggtcaaggcgggtggatcacctgaggtcaggagttcgagaccagcctagccaacatggcgaaaccctgtctctactaaaaaaaaaaaaaaattagccggacgtggtggcaggcacctgtaatcccagctactagggaggctgaggcaggagaatcacttaaacccgggaggcgaggttgcaatgagccgagatcgcaccactgcactccagcctgggcgacagagcaagactgtctcaaaaaaaaaaaagaattcagatccaaaatgtaactcataccaaatacacactattccattatttcccatatgtgtgtattaatatatctgatatctgtctcttctacgtgtttctccatcttaatgtgtgtgtgtgtgtgtgtgtgtgtgtgtgtgtgtgtgtgtgtgtgtatagatatatatatacacagtctcctccaccaaactgtgattgtcccatgggtgtgtcagctgaaatcattgactacctaatgatgcttgcagaaatgctagccctttgtggaaaagatgtgatggggatttttaataaacccagatacaatactagacaatggcaataaatcttactgccaagttagtttgtaccaaattaagcgtgtaagcccattgaagccatcatctgggatgatgcgctcaggctcagaaaacagatcttctccgtggtgtgtcctggaagttaggagctaggattagcagcatcacctctgacagtcaggcagcctgagtacacagggggtcagcgggcatagggcctaagagcaccgtacagaacaaggaattgttatcatttccattacttgtaggctgcattgctcttggctccttaaattgctagttctcctaaatgttgtcgtttcccctcccctcaccccagaactaggttaaaatgtgcatttgtattaacaaaagctcatggaaggagatacaaaagacaggacacatgctctttaaggaaatatcctcccccttgttccacccaaagccatctagggatggacttaagaaaacaagacatctgcatcagcctttccagggctgaagcagaaccatctcccctcacttaaccttggccgtcaccagtcagcttttgattttctccactgcagtccggtaaggcaggaatagtacatggccacacagcttagagactgtcagcccaacttgtcataccacctttccaaacacttttgcattaggaagaggcaggtagctcctaactgggtcatgctgcctaaagctgtatctgtgcatcagaggcagctgtggagaaaaactcccagggccacattcgttacatgtgcttttcgttggattgctgttgaatacactttttaagttgtccctaaaattgtcggtatgagttcctagggaatactcagtgtcttccactgtagggggtagtcagatccacggccaacctataattaatgctggtgcctcacaactcccagttattcaattattcattcatccctcaccaaaaggacttgagtatttcccatgtgacttttctttaatctaaaccctttctcctcagggtgacagattcatgtcatggaggaattgatattgtccatatatggaagggatcatgtggacccagtgtgtatagggaaagggcaccagccaaaattcgagacccagctctgttaccatctagcattgtgaccctgggcaaattatttaacgtcacatttcctctgaggtatcttccagttctaagattctctgattccaagtggacatttgggctctcatcacttcagagctcttctgtttaactattgtggtgaatagatttatgtatgtagtttctgatattatatcacacaaactcagggtttctttttactgttgaaacagccagtcatgaatcatgctggagagtaaattggggacctgacacaactcggattctgcctggactttgcaaaaagccagatggtgccagatttttgagtactagttgagcccacttctacaaattctctcccatcccaatctaataggaatcacccaatcgcacttaaaccctttgttcaggcagctgggccagatttgtacaaaaatacgtagtatttagaaagctaggccttcgctggggtgccttcttgctccctgtagacatctttcagattgggagctggaatcccaaccatcagtcagcatcatcaaatagggaggccagaattccagtaccaacaactggtctgcataaaaaagttgagatctgggaggaaaacttgttctgcttgctgtgattatgactggattcagagatattggaagcaaatatgaatgaaccaactctcaggaccagctgtcaagcacttggcttgtaatctgccgtcatcccactcatcccaggtgctcctagtttgacagctcaccagctattaaatgttggcttcctgcacgactctgattcgtaccccaggggcctataatgaggatcttgtaccaggaaaggggaccccagctaggctgtttgctggctaacatcccagtggtttgggctacaataacttagcagccctagttcttcctcctatggtaggaaggacaccagagccctctccatgtgagatggaacataatctataactttctgtgaagagatggcatctgtaatgaggcattcttgctggaggcctccagaagtccctattctacaaccacttaataccaatttaatgagcctctcattagaaattgtcaagagctctcactgacatccttgagtattatttaattaatggtttatttacaggaaagggcaccatcttcatggggagaagatgagtacttgaaatatcaagacaattgcagaaggctgtgccctgagagaatggaagaactgggaaagagaaaaggaagtcagaagcttaaggttgatgtgaaatgcagaaaaaggaatggttaacagaaagtgttcatgtttatctaatacagaacaggttccgatccccttctcaggacacatttctgtggcagcaaagagtaaagctgtaggcaatcacagtttaagcgcttccagttccttctgatctcattctgttttcactgagtaatcttttgaggttaatcttctgaggtgaatggggtttccttagtagctttcctactgagaagtataatgaccagctgtcatcattgtagttctcttaacagttactattcttattgcaaattggcctgatttctgttccttctgtggacagtttagttagcaggaataagtttttcctgagccaaatcaagtatctagatttgtgaggctaaatttctaaactctagagcgctatagtcttgtagatttcccaacacacatctcatgaatatccaccacaatatcttatacttcagtcttttagtaccaaagaatgttaatttcctcttcaccctaactcagatcctgggagaaaagatgggatatttccaccccatcctcaccctcagattctagatgacaccaataaacccttctttgtgctagtaagccgcctcagcagttgtctggtggcatccctccacttgaacatgagaaaattaaatctaaagagatcaagtgactccatccgggtcacacagcacgttggtggtggggccagaactggagcccgggtcccgttactccaagccttgttttctaccgcattaccttgctcctctgcattgctccagtgtttgcatctgctgatgttgggggcactgtggtgatgtattaattaattcttgcattgctataaagaactacctgagactgggtaatttataaagaaaagaggcttaattggctcacagttccacaggctgtaaaggaagcatggctgaggaggcctcaggaaacttacaatcctggtgaaaggcgaagaggaaggaggcacgtctcacatggccagagcaggaggaagagagagaggtgggaggtgccacacacttaaccagatctcatgagaactcgcttactatcatgagaacagcaagggggaaatctgcccccatgatccagtaacctcctaccaggcccctcctccaacactggggattaccatttgtttttggattttcagggtttttttgtttttgttttgcttttgtgagacagagtcccgctctgtaaccgaggctggagtgcagtggcacagtcttggctcactgcaacctccgcctcccaggttcaagtgattctcatgtctcagcctcctgagtagcttggactataggtgcgcaccaccacgcccagctaatttttgtatttattttagtagagacagggtttcaccatgttggccaggctggtctcgaactcctgacctcaggtgatccatcagcctcggcctcccaaagtgctgggattacaggtgtaagccaccacgcctggcctgggaattacaatttgacatgagatttgggtgggggcacaaatctaaaccgtatcgggtaaatatatggaggtgatagaggcaaagtgaaagatcaaatgcaaaaaatgacaagatgggctgataataggaactgaaattataggaatgcgataaacaaggcacagtggttctagtttaagttcacttggcttctggatgaatctaatgtgatgattatagagagctcttcattaccagcataaatggaaattaatccttttctttccctcatattttacctcacttaagaatgtgtccagaagcaataacatgatttataggtgtagctagaccaggtttgaggataaatgagagagaaggcagtggaaattgcctcgtccttcctgtcttgtctttcatgagaacccaattctaacataattgctagtgtttgacggtgaatgtctgggaaagagaaaacggcaagagaaaagtgattttttgctgaggtctaaaaatatatattttttaaaagaaagatatgcatcctgaactattggccgggcccgctgagtgtggtggctcacccctgtaatcccagcactttgagaggccgaggtgggcagatcacctgaggtcaggagttcaagaccaccctggccaacatggtgaaaccccatctctactaaaaatataaaaattagccaggcgtgatggcaggcaccagtagtcccagctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggccacatggtgaaaccccgtctctattaaaaatacaaaaattagccaggcacagtggtgcgtgcctgaaatcccagctactcgagaggctgaggcaagagaatcacttgaacccgggcaggcagcagggagcagagatcgtgccacaacactccagcctgggcgacagagcgagactccatctcaaaaaaaaaaaaaaaaaaaaaaaaagataatagtagatggcaaaaccaggatttgaactaaaactgtactgccccctctgttttatttactatattaccaccctctcttaccccacagccagtatttgttgttcatcatcctccagaaagctgggctaatggaattcaagagcctgctcaaaagctccagcctatggagcttcccttttggtcccagcataagaatcacttctgggcttttttattccttaacatggttccctgagctttttaagggtagttgcaagtccttttcaccttcctaccccccataggaccttggatagtacttctcacataataggtgttcattaacttgaattatttatgttattaagttgaacttgagttatttaaatctctagccttggcctggcgtggtggctcatacctgtaatcccagcactttaggaggctaaggcaggaagatggtttgagcccaggagtttgagaccagcctgggcaatatagtaagaccatgtctctacaaaaaattttaaaaattagccaggcatggtagcacatgtgtgcctatagtcccagctactcaggaggctgaagtgagaggatcgcttgaagcggggaagtcaagactgcagtgagccatgatcacaccactgcactacagcctgggtgacagagtgagaccctgtctcaaaaagtacaattaaataaataaaataaatctccagcctatacctacaaaaccaaggttgaactcaaaggaagccctagggctaggttaaagagatggcctcactctcaggtaggggtgggtttattctctagagctgccctgtccacagtatgataccaccaaggcacatgtggctattagctacatttaaatttaaactagctagtggctactgtattgaatagcacaaatataaaacatttcccacatcgcagagagttctaatgcacagcagtgctgtagacatatattaactttctccagatttttgttttcactccaatcacttctaggtggtttaaattttttccaaaaaacatttatttcttattatttttataatttttgaagccaatatccaagacctggtctgtgaagtaaatatgggaataaatgcaactagcttctcaagtccccccttttccctagaagtcctggaaaatgatgtttgattttctagctttttagaaagaggttctgtcattatctacttaaatcacctttggaaaattatttaacatctctgagatttattttcttaatctagaaagaaaaagtatacttaacaaaaagccgttgttatttttaccactgcaagatcttaggtcaaaatgccaaaggaaagcctgtagagtggctcacaactgtaatcccagcaacttgggaggctgagatgggaagatcacttgaggccaggagttcaagaccagcttaggcaacatagcgagatcccatctctacaaaaaataagtttagccaaggtgtggtagtgtgtgcatgtagttctagctactggaaagctgaggtgtgaggatcacttgagcccaggagtttgagactgtagtgaggtatgatcctagcgctgcactccagcttgggcaacagagcaagacctcatctcaaaaaaaaaaaaaaaaatgaacaaacaaaataaagtgccaggggatggagaattcgattttcaaatagacttcttcatcacagattttagaattgaactcacaaatcacacatgcatgcaaataacatacagttatagacctggttcacagtaacaaaatccactcatagtggtcatgtggtccttacggaagcagaaggtaaacccatagtagtttgaatgaagtgacttcatattttttcattttcaagcttctttttcttttttcttttttttttttttttgaggctcactcttgttgcccaggctggagtgcaacagcaacagcacgatcttggttcactgcaccctctgcctcctggggtcaagctcttgttgcccaggctggagtgcaatggcatgatctcggctcactgcagcctctgcctcctgggttcaagtgattctcctgcctcagcctcccgagtagctgggatcacaggcgcccaccatcacacccggttaattttttttgtatttttagtagagacagggtttcaccctgttggccaggctggtcttgaactcctgacctcaggtgatccacctgcctcagcctcccaaagtgctgggattacaggcatgagccaccacacctggcctcaagcttctttttatacaaagtgtaagaatcctgtttagaactttctgttctcttaattacatttttttttaaatttgtttttgtttttttagagagaggtctcactatgttttctaggctggcctcaaactcctgactcaagtagtcctcccttcttggcctcccaaaatggtggggttataggcgtgagccaccacacccgctctgtcaccaggcaggagtgtggtggtgcgatcatagctcactgtaacctcaaactcctgagttcaagtgatcccctcacctcaacctcttgagtagcttcagaggcacatgccaccacacctagctaatttttttgaattttttcgtagagaaagagtcttgcgatgttgcccaggctcgtctcaaacttctggcctaaagctgtcctcttgctttgacctcctgagttgctgagattacaagcatgagccaccacacctggcctacatttatttttttcttttttttttttttcgagacagcatcttgctctgttgcccaggctggagtgcgggggcataatgttggctcactgcaactcccgcctttcagactcaagcaattctcccacttcagcctccaaagtagctgggcctacaggcaggcaccaccatgctcagcttattttttaactttttgtagagacagggtctcactatattgctcatgctggtcttgaactcctgggctcaaatgatactcccacctcaacctcccaaagtgctgagattacaggtgtgagccaccatgccccaccttggcctatatatatatatttttttctttgagatggagtttcactcttgttgctcaggctggagtgcaatggcacagtcatggttcacggcaacctctgcctcccggggtcaagcaattctcctgcttcagcctcccaagtaggtgggattacaggtgcccaccaccacgcctggctaatttttcatatttttagtagagatggggtttcaccatgttggccaggctggtctcgaacttctgacctcaggttctccacccgtcttggcctcccaaagtgctgggattacaggcgtgaggcaccgtgcctggcctcggcctacattcttgataagccaaattattcattacttttcagccaagcaaggcttttttttttttttttttgagacggagtctcgctgtgttgcccaggctggagtgcagtggtgcgatctcggctcactgcaagctccacctcccaagttcacgccattctcctgcctcagcctcccgagtagctgggactacaggcacccgccaccacgcccagctatttttttttgtatttttagtagagacgaggtttcaccgtgttagccaggatggtctcaatctccggacctcatgatccgcccgtctcggcctcccaaagtgctgggattataggcgtgagccactgcacccagcccaagcaaggctattttttaactttttattatattgcaatataatatatggaaaagtacaatttctttttttttgagacagagtctgactctgtcacccaggctggagtgcagtgacgccatctctgctcactgcaacctccatctcccagattcaaatgattctcatgcctcaacctcccaagtagctggaattacaggcgcccaccaccatgcccagctaattttttgtatttttagtagagacagggtttaccacgttggccaggctggtcttgaactccgggccttaagcaatctgcccgcctcggcctcccaaagtgctgtgattacaagcgtgactcactgtgcccagcctaaagtacaaatatcttaagtgtacagcttggtaaatttttaaaaagctgaacacacttgtataaccagcattatttagaaacatcacattaccaggactatagagccctacttggtacctccagtcacttccttccccaagagtcaccacttttctgacttctagtaacacagttttacctttgtactttatataaataagccaagtgtttttttgttttggttttgggttttgttttgttgggtttggttttgggttttgtcttgctgtggggggtttcctgtctctgaggatgcccatactctcttcagccagaaaacatgagccagtttaggttttgggtactctacagaagtaaaccatttattccttcttaccacactcttcccagaccaatcatgagtagaggtaggtttgtgggtttcctgctatcttatcaccaccagtaatgggtgtcattattttaatcaacaggcccctgggtgtcttgcaaagggtgactgtacctctgctattacagtggttactgttctgtgtggcttgggtggtttctaattaaaacagatgctcttggccaggcgcagtgtctcacgcctgtaatccagcactttgggaggccaaggtgggcggatcatgaggtcaggagattgagaccatcctggctaacacggtgaaacccatctctactaaaaatacaaaaaaaattagctgggcatgatggtgggtgcctgtggtcccagctacttgggaggctgaggcaggagaatggcatgaacctgggaggtggtacttgcagtgatccgagatcgcaccactgcactccagcctgggtgacagagtgagactccgtctcaaaaaaatatatatgtacaaaaattagccgggcatggtggcatgcgcctctagttgcagctactcaggaggctgaggcaggagaatcgcttgaacctgggaggcggaggttgcagtgagctgagatcgcgccactgcactccagcctgggcaacagagcaagactccgtctcaaaacaaacaaacaacaacaacaacaaaaaaaaaaacagatgctctccaaagtttcttccagccctctgacactgaagagggtggattaggaaaccatgagaaaatgggctcaatccaaagccaaagtttgattttggttttcaccacgaaaccccctcaccatctctccattacagcagagagactattgcagcagtctcctaactgaccccaatattccaggtgtgccgccttccaatccatcctcacacaaccagccagaaaaatctgtccaaaatggaaatctgcctgcttcttactcccctgcttccagtttttttctgatgttccattgcctggaagagaaagtgccagacctttaggagcaatacagaccctggggggacctgtctcctgcccacctcttttttttttttttttttccaagagacatggtctcactgtgtcacccaggctggagtgcagtggtcatcatagcacactgcagccttgagctcctggtgattgccgcaatcaccgggtggtaatcaagcgatcttcctgccttagcctcccaagtagctgggactacaggtgtccaccaccatgcccagttaatttgaaaaaaatttttagagacagggtctcgctatattgtctaggctggtcttaaactcttgacctcaagagatcctcctgcctcagcctcccaagtagctaggaaatcaagcacaagccaccacactcagctccctgccttcctccttagtttacttcccatgcacctgcttctttagtgtccagcaatacctaactgcctacttgcagttccctggcagccacgctgtatcctgcctgtactcatgcttatgctgcttctcctccctggaatgcctccctcatctccccttaacttggccaattgctgctaatcctgtgagattctactcaggagtcacttccaggaagcctttactatctgtatttgcattaccctcagccagggtgggagattcttcctctgtgccccccatagcatcctccgtttaccccacactgtggtataataatttgtctctcctacagcctggaagtatttccagggacaaagcacaaagctcatttatctccttgttctaaacacctggcacaagacctggcatatactgtattttcattcaacttttgtcacactacactgaactgtcactgagttgcagttggaaatatcgaggaaggaataaactaatgaattctaggataagagaattgagtttggctgtggagaatgtctgggctttgaaatccactttgtgtggacaatggaattatatcagtggtgttgttccaaggccaacacttatccctgttgtttttgcctcttcctctaggcaatggcgaactgagcaataaggaatttgtttccatcatgaagcaacggctgatgagaggcctggaaaagcccaaagacatgggtttcactcgcctcatgcaggccatgtggaaatgtgcacaggaaactgcctgggacttcgctttacccaaacagtaaccccacactgcaagaggggacccctccacccccagtaccctggaccccctccgcagagtctcggcagagccctttgtgctgctgcttctggaagtagtctcccttcctcccgggatgacctcaggactctgtcggtttcccctctttacccttccccgtccccgtgttctgctgggctctgattctgcccaatgagtatccccataggttctcaaaaacatgaacaagtctgtaaagctcagacatttgtcagcctcaacagcaccacccattcaagcatcctgtggataaagaattcagggaaccatccacacacctgccaaccctgggaagcatccagttctcaaatcgtttttgctatggatttatactaacaagaacattccttgacttccctcctgctggtgttttaaagccacaagtagggaagatatctggcaggcagaaagaagtctgtgatgataaacaatgatgaggatgacctaggcaccctacgctagtgtgagaagcctgcgccccaggaaggatctgtgttagtccctgggatggctccaaggcctgctctaggaaggcagcatgctcagtgggaacacagcaagattcagaatttaaagtagttgcttcatggctctgtgcactcccttttcttcctcgcagcctccctaagatgactccagtgtgaccctgtgcttagtgagcaatagtgattgagctcatgttccctgcaagtgccatttcctctccaggatgggcctctaaagctgaggcctggctcagagcctgtttgccctctgtcttaaacaattgtaaatatcacttaaattataaccatttgcaataaacatccccaaagttccctgtctcctttattttagggtcctctaggcccttttcattttatgtccccactggatttgagatcttgctggaagcagacctgttttctttctaccagagtctggttctttctgatgaagagcagctttaggcacagacaaaaagtgagggcttttggaggttagtggtggcattgtccccgcacagtttggttagcatttcattctgggccaaggtacacagtccttgcttattcatgccccacagtaaagaactaagatggggagtatgtgaggaatcatctagtatggtggacctaagttgtgtggggttttttggttttgcttttgttttgagacagggtctcgctctgcaacccaggctggaatgcagtggcgcaatcctggctcaccacaacctctgcctcccaggctcaagccatcctcccacctcggcctcctgagcagctgggactataggtgcacgcgaccacacctggctaatttttgtattttttgtagagacgagttttgccacgttaccctatgcatttcaccataaggacctaagttttaagaaccataacaaccggcctggcacagtggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15129 - DNA, 55886 bp, Human
  misc_feature (1)...(55886): n = A,T,C or G
aagggaagttttttaatgaaaaattagattggctgaagagtgtggaaatcatcacatagggaagtggtcagcactgtggatatacaccaaacagtattacagagacatactgaaaataaagcacactgacagaaagaaacctcattaggatagaattttgggagattggtgtcttgttattcccagagtctgacttttctaatcacgtagcattgtcagggatatctaaattttaaacttcagattttgtacaaaaaaacctaaaaggactatattttaaaataagaagcatgtacaaataattgtaaaggaaagagtgtgagttttgtagtctccagttctgtgtcagtaagaatttgatgaggaatagccaatagcatttatgctggtccaggctggatcaaattgtgatcgtacttctagtcttcaagctgcctggttagaaattatgcagcttactttgatgcctgtcctactactactattagccttttagtggttaccttaagaataactgaataatactgttactttgcatctctcaaagaccgtgcgctgttcccgcatactttcttgcagacgtattgtcttctgaaggatggtgcccatgggcacagcaatttggggcatcttttggtaggaagcatgatttctcctgtttgggcacaaaagagtgactacggaatataagctaaacaccttctcccagaaatatcagttgtaaaacttagctcattaatgtaatgttgaacgttttcatgtgagtcatacttgaacttcttgaatgtgagtaaataacggagttgaattgtataaaaccctgatggatggcagaagggaaagaacatccctttcatctgatccatgcctgagattccttccctctactatactactggaaataaacaacttgtctggtgctctaaaaattaatgctattatcattatagagagaacaggagtgagtgcttttaggttattacttgttcttactaaggcatcatattctttcttcacgtgttttgtgtttgaggctagggataaaggtacaggaaaaaggatctaagaaaaaaactcgaatctctaaacatggagtcttttttttttttttttttttttttgaggtggagtctcactctgttgcccaggctggagtgcagtggtgcgatctctgctcactgcaacctctgcctcctgggttcaagcaattcttcagcctcagcctcccgagtagctgggattacaggcgcatgcctggccaatttttgtatttttagtagagactggtttcaccctcttggccaggctgttctagagctcctgacctcaagtgatccagccacctcggccacccaaagtgctgggattacaggcatgagccaccacacctagccaaacatggagtctttactcaacattatagtaacgtgaaagaggagatcatgagaattaatgtatgttttagaaggcatagattacttataaaaaaggaaagatcaggctgggcacggtggctcgcgcctgtaatcccagcactttgggaggccaaggcgagcggaccatgaggtcaggggatcaagaccatcctgaccaacatggcgaaaccctgtctctactaaaatacaaaaaattagccgggtgtgatggcacacgcctgtagaacctgggaggcagaggttgcagtgagctgagatcacaccactgcactccaccctggtgagacagcgagactccatctccaaaaaaaaaggaaagctcaatctgctgtaaattatgtgcttgtttcaacaacccttgtttcttttccttttcacttctctttttttttttaaagcggcctaaatggggtgaagagtgagttatctgacaaatttagattttgcaaacctgtgcattgatgagagtgctattgaaacacattaagaaagattttcaacgcaggaatgtgtcatttcctttcttcatgtaccagatgctgaaatactatgagataaagattttaggtttcaattgtaaagagagagaagtggataaatcagtgctgctttctttaggacgaaaggtaaagaaaaaaaaaggcttattttaatgttttttccagaattgtttctattgattgttatgtgtgtactctgtgtgtgtgtgtgcatgcatgtgtgtgatatatatttgtgtgtctgtgtgtgtatgatgagatgaatgctttattgtatcagcaataatttggtttggtttttttcgataatcaaaaaatagggatttctgctaaattttccatgagtgaaaaacatatatgttcacaagtacatatgaaatacactaaatgctttgtagtttgaaccagcaatggggttttttcatataattaagcatattttgtttaaaatactggttttattcaaagtataatttgacatatttcacctattctcctttcataacttttcatggaacatttttggctttaatctaatgccttttattatcttcccttgattatatagcaaatattggctgggtatctactatatgcacttcattgaactagatgtggggaaaggatacaaaaaataagatatagttctttttgtgctccggaatcttatgatttaaaacatatccccaaataggcataatgtaatttgagcaccttaagtagtatgaaagtactatagataattactagcaccttaagtagtatgaaaatgctatagataattactatgaaaatataggcgaggccaaaattacttctatgtgaaaaaagtctatcaaaaataaatcttcatggagatgctagaaatctgattaatcttgaagactaagtaagattcacacagcatataatgggaggttggcatttgcactgaccaggtaaaaatacttatagaaaaaccatagaactgagattacagatgttttatgcagtgattagccgttttatgcagtgggtaagagctaatcttctgggagtagactgcctgtgttcaaattccagctcccctgctccctagttgagtaacttgactagttacttacacatttcagttccctaacctgtaaaatggagaaaatactacttgtacctcatgaagattccgtgagaacaaaataagaaaagctcatatttaaaaaaaaagtgatattttaaaataacagggattcatatattgatggttttctgtgtaccaggcaatttacaaaaattatttttaattctcgcaataattctttaaatttatattgtgatcatattttacatatctaaagaaagttcaattcaaataagttaaaatatttgcctaagatcacacagctaaatgatgtcacagtcaatactcaaatctagatttcagattcaaaagttgatgctctttcttctttgctaccaaggatgaatatcagtgacatcaggcacaatataaatatttccatttcttactaaaatctgtcttacagacgggttccttaagcataaagctgttagtttcacaaataatcttaatttaattttcattttatatacacattcaactgctgttacaaaaatcaaagttattattttatataataaggaggatcacaagcttattatttattccaaatgttgaagataaagttggccttaagaatatgatgggccgggcacggtggctcacgcctgtaatcccagcactttgggaggccaaggcaggtggattacctgaggtcgggagttcaagaccagcctgaccaacatggagaaaccctgtctctactgaaaatacaaaattagccgggcgtggtggtgcatgcttgtaatcccagttactccggagtctgaggcaggagaatcacatgaacccaggaggcggaggttgtggtgagccaagatcacgccattgcactccagcctgggcaacaagagcgaaactccatctcaaaaacaaaaagaaagaaagaaaaaagaaagaatatgataaaaaaactaaatagggaaaaatcttaggaaaacgaatgcatgtcaagtatgaaaagacagatggtaaatatgtattaaacataaagagctgattcacatgcttaggtaaaagaaacctgtggggatgtataagcagtgaatatgaatagataataacccaagaagaacaatgtatgacagacaattacagtgaaatctctctcttacattaataataaaaaataaaaatgaaaaccacttttaggtattatttaactcttatcaaaatctaaatgattctaaaataagctttattattcaatggtagtgaattttgcttgaaactgccatattcacatataagtctggaatatttataaatttatgttatctttttaaagatcactaagacagtagagcccaagaagttcaaaatagttttcctttcactttttagtttcacatatgatgaattatcctaaagaaacattttaaaagaagaaagctaaattatgaaaataatggccggggcagtggctcacatctgtaatcccagcactttgggaggccaaggagggtggatcacctgaggtcaggagtttgagaccagctggatgaacgcggtgaaaaatacaaaaatgagctgggcatggtggcaaacgcctataatcccgctactcgggaagctgaggcaggagaatcacgtgaacccaggaggcagaggtttcagtcagctgagatcacaccattacactccagcctgggtgacaaagcaagactcaatctcaaaaaaaaaaaaaaaaaggaaatatttataacatcattatttatatcagtgaagcattgccccctgggaaaaggaaaaaaagtttaaaagaaaaaattatattttagaaaaatggctgtattttttatttagaaaaatggctgtataaataagattttatatatatataaaatatatataaaataagattttatatatatataaaatatatataaaataagattttatatatatataaaatatatataaaataagattttatatatatataaaatatatataaaataagattttatatatatataaaatatatataaaataagattttatatatatataaaatatatataaaatatatataaaataagatttcatatatataaaatatataaaatatatataaaatatgattttttatatataaaaatatatataaaataagattttatatataaaatatataaaatatatataaaataagattttatatatataaaatatgattttatatatataaaatatatataaaatatatataaaataagattttatatatataaaatatatataaaaatatataaaataagattttatatatatatgaaatgtaaataagattttatatatatatgaaatgtaaataagattttatatatttgaaatataaataaaataagattatatctaaatatatataaaataagattttacatatatgaaatatatataaaataaggttttacgtatatatgaaatatatgtaaaataaggttttacgtatatatgaaatatatgtaaaataaggttttgcgtatatatgaaatatatgtaaaataaggttttgcgtatatatgaaatatatgtaaaataaggttttatatatataagcaagtctttgctacataataattcaacacatatatatatgttgttttatatatatatatatatatatatatatgtgtgtgtgtgttgtattattaggtagcaaacacttggaaccaacccaaatgtccctcagtgatagactgggtaaagaaaatgtggcatatatacaccatggactactatgcagccataaaaaagatgagttgatgtcctttgcagggacatggatgaagctggaaaccatcattctcagcaaactaacagaggaacagaaaaagaaacactgcatgttctcactcataagtgacagttgaacagtgagagcacgtggacacagggaggggagcatcacacaccggggcctgtcagtaggtgggaggcaaggggaggcatagcattaggacaaactcctaatgcatgtgggacttaaaacctagatgatgggctgatgggtgcagcaaaccaccatggcatatgtataccaatgtagcaaacctgcacgttctgcacgtgtatcccagaacctaaagaataataaaaaaaatttcaagtttgaaaaattcgtttgaaatattaaaataatgaggtgattttaaggaaaacgcgtaataccaaatgatacgtgcatgatgatatgaactatgttacaggtatacatacatccaaagactcgagtttcatttaaaaaattaagggtttttttcctttattagggtgatgagatgacagaaatttcatcctaacatatctataatattattaaaatgttttataataaaaacaaaaaagtaaggtatatggttcccaacaaattaaccttgaaattctttcattatgaatttcctgtaaacttttcatccacttgataaaatgctgatattacagaaacgtgtttcacttctcatgagcacgtgcttttaatagattacacaaactccaaggattttacaatcgtttatcagcacactgacatttaataggaagagtaactttatgtgaagctactttttgtcctaactgtggaactgatattaaaaggcacacttgaacagtgtgagttgttcactgcctgctaatgaaggctcatgcaagtatgtatgttcacgttactaaaaaattacaatgattataaccagagtaagcagctgaaataatctggtaattttaataataaatgcttttgaagcaaagtgggttcactgagggtaatattttttgtttcagtttgctagttacgtgcagtgcagagagaaatattttattttccaatatgtaacagaagaatttttaaaatccctactttagtgaaccacaaagttttcttgaggcataacctaagatataaaatccagtcatcttgaaaaatatcttgcctttcatttatttatgtaattttaaatacggcattatgtatgtaatgagcaccttcaggaactctctgatccctgaaccaaagagatcaaaagtccacatcatggatctggcttggatgagagaagacagatgatagacaagacaaataaggaatatatgtttttgggggaaagaaaatgaagccagggtggggaagacaaagccccaaggggttgtaggttgaaaatggatgttcaggaacagtcagcttgcttgcttgcttgctttttctttctttcctttttttttttttttttttttttttggagacagagttttattcttgttgcccaggctagagtgcagtggcctgatcttggctcactgctacctctgtttcccaggttcaagcaattctcctgtctcagccttctgagtagctgggattagaggtacccgccaccacactcagctaattttttgtatttttagtagagacagggtttcatcattgggccaggatggtctcgaactcctgacctcaggtgatccacccgcctcagcctcccaaagtgcaggaattacaggtggtctgcttttttgagtcagactttaatgacggcctgagtgagacgagaaggcattcaggggctttgagcatgggagtgactcaatctgccttactttttaagaggattcttctgggaagtgtgtggagaattaattcaagaatgtaagcgtgaaagtcagggagctattaaaatcaacaaggtgaggccatgctcaatagctcatgtgtgtaatgccaaaaatttgggaggctgaggtgggtagattgcttgaggctaaagagtttgagatcagcctgggcaacatagtaagactgcatctctagatatagtatgggcatggtggcatgcacccgtagacccagctactcaggaggctgaggtggaagaatcacttgaacccaggaggtcaaggttgcagtgatgtgatcacacggctgcactccagcctgagcaagagagcaagaccttgtctcaaaaaaaaaaaaaagaaatgtcacggtgaaagggatgatggggcttggacaggatgctagcaaggaagtgacaagaagccctcagtttctacatagcgtttgaaaacaaagcaacagggttggatgagagattggatgtagtggatgagaaaaggcgaggaaaagaagacctctaggtttgcaccatattagaattctaagcaggggtgttgttaggcagtgcatatatgggtttgtagttgagagacgagctatgggcaagagataaagacttaagagtcatcagccttctagattatatttaaagcaatgaggctagtgagatcaccaagggagtgaaaataggagagaaaacagaacagaaactggaccctggctcactctgctgttgagacgttggggagatgaggaggaatacccagaaataaataaaactcccctggatgtgctatctcagtgcaatcatcagtatctctcttctcaacaaaaaaccgtgagcatgaacaactttcatttatgcactcagggactttcatttttatacatttattactgccaatcttgcaaggttttatttctgcttctaccacacaggaaaaacaacttaaattctatgtggcaggttatggatttcttgcaggccacgaacttctttgttcttttccatgaccctgactgcttcttgtttttctcttgcagcgtcaaaaagttcttccttgtcttttgtgctgagtcttcttcctctactcacccactgaatatcatgtttttcaagtttatgtgtgtggtgtttttttttttttttcctgaaaaaaggtatcttctactgtttgactttttccctacgattctttgttaaaatgctgtgttttagatgctattaatttgtcctctctcttaatgcccttggattttcctcttaattgtctgcaccattgctgttacccaagatgcctggctggagtagataaaaataagccgaagtccaaaaattggaatagaatggaaggaatggatcaaaggaaatcaggagtttttgtgcagtcagatatgggtcttatagatgagagcggtctagaaaagcagttctgggctcagattgcgtgactgtgctttgccggcatattcctaactatatcacatattctccactatacagtaagtagatgataataataagtgggtatgataataaatagatgatgtaaatggatgatataaccacagtgaaaatcctggaaaaagaaaagttaggttgctgtagaaaatccacgtttgtagctagttgtgttatgtaaaacaaaagctgatgctgagattgagatctggtttggctatattggcttgatcaggacacaggcagtagttcaagccatggaagtagatgagattctcagagagactgtgcagactaagaaaaaagaaagtaacatcagaaaatgccacaaatcctatggcttcattatctctgatgaatgtgagctttttttttttctggaaaatatacataccaacatttcgtgcagttcatgataaaccaatcccttttgaacattgcccagaaagcaaacagacttcccatggtgcacaaatgtagccatagggaatattgttcattcctcattgcactgagtatgcttcagtgttcacctcccttctggcccactacacctgtcaggggtattttatagactaaatagtgtcagttagtctaaatcactcatagacatgtactaggtggttttcctttttcagagattaaataaatcttcccaaggtaaccacggtttaaaatatagtaatccacaaaatatttattatcacttctatatgctaaaaaaaaataaatcaaaggttagaaacttaaagaaaaaacaaaatcaagcttcatctctagttcaaagtgaaagggagaaaagcaaaatgtttcataaacaatatatattgtctcactaataatattaatccaggtcactactgccaaagcaaacaataaatttttacttcatttgtatagatagtaattcaatgttatattttgggtaggttgtgaaagccagatcaatttatgcgatcagaaaaataaaggaagaaattgatgagtcggatgctaccggctacatgcctctccagcctcttctttttgaacctcctttgtacctgtttagagaaaaagcataaatagtgtactaccaacctaactaaggttattatagtctgtttgtttaaaataccatttttttctccttttgtctttttcccactctcgaaggtactcaagaaaattgaacagatgtaatagatcaaattaaaacattttatttcctgaaagccttttttgcctgttgtaatgtgcaggacccctctcctttaatgggagagacaggaagttacctgaatctaggctgaaaaggttatgtgaaaagaaagtataataataaaagggacacttggctttttaaatctttgttttctcttaacctaagtaaggcatattaaaaataaatgttaaggtgaaaaataaatgttgtctttatgaaaaattaaaactgctctcagttccatattgttcataccttcatgctttttaacatgatattttccatcctggaatgaccttaccccagattctgctcattttcaaaaccctgattcattgtcatcttttctgtattcctaccttgattacccacttccccaaaagagttaatcactcacttttgtactatgcctgtgccatatatatatatataattatatattatataataatataaatatatttaatattatatattgccaattctatgatatataaaatatataatatataatatatttgccaactaatataatatataatatattaacataatataaattacatataattatacatatatttatattatatattatataattgccaaatatatatggtattacatataatataattgggaaatatatatttataatatatgttatattaatatgataatatatttattatattatatattatatatattatatatttgcctattatataatatattatgtaatatattaacataatataaattatatattatataatgtatatataaatatgtattacatgttatagatgtaattatataatgaatatttatatctatatagttattcatctattcatatatgaatattcagcatattctatttattcagtatattcaatatttatttaatatattcaatgttccaggttgctttaggctgtagtgacataatgtggacaaaagcagacatggtccctactcgttcagagttcagagtgtaaagatgtttatcagattcaaaagtcttcagcttttttcacaaacggtcttacctggtagatagaataatctgagctgtttattttgcatttcagtaaaaatggaggcagaatatctcaaatgtgaggatcaaagccataatcaaacatgtggagaaggggccagtaggtagcctgaaaggaaagcttttctggttatagacatgcactacataataatgtttcagtcaacacaggaccatatgtatgatggtggtcccataagattataatggagctgaaaaattctatcacctattgacctcatagctgttctaagggaataggaaattgcattactcacatatttgtggtgatgctggtgtaaacaagcctactgctctgccagtcatttaaaagtatagcacatacagttacgtaagtatttaatacttgataataaatgttaatggtttatgtatttaccatattatacttcttaatcattattttggtgtgtactcctcctatttataaaaaaagattcaaccataaagcagcctcaggtatgtcctttaggaggtattctggaagaaggcaatgttatcataggagatgacagctccatgcctgttattgtttctgaagatctttcagtgggagaagatatggaggggaagacagtggcattgatgagcctgaccctgtgtaggcctaggctaatgtgtgtgtttgtgccttagttatcaacaaaaaagttaaagaagtagaaacattaaaaaaaaaaaaagttaaaatagcttataggataaagctgtttagaaagaaattatttttgtacagctacacaatttatggtttaagccaggtgttattataaaagagtaaaaatgttgtttaaaaaggtttctaaagtattaaaggtactgtaaactaaggctaatttattattgaacaaataaaattttttatacattcagtgtagcttaagtgtgcaatgtttataaagtctacagtgtttcacattcactcaccgctcactcactgactcacccagagcaacttccagtcctgcaagtttcatttatccaattgccctgtacaggtgcagaacttcgtatcttttataccatatttttactgcatttctctatgtgtagatatgttagaaacacacatacttgccattgtgttccaactgcctacaggattcagcacagtataacatgctatataggtgtgaatcctaggagcaataggctagaccacacagcctggggtgggtttgttgcctagcagcagtaggctagaccatctaggtttgtgtaaatgcactctatgatgttcacacagccatgaaattgactagcaatgcatttctcagaacgtatctttgtccttaattgacacatgtctatacataccaggtatacttgaacacaatttttgcgaatccatcttttacaaactgagttcaaagttaaaaagcattagtacatagttccaattgccttaaactatagggttttcgtttttcttttttttttttaaattatactttaagttctgggatacatgtgcaaaatgtgcaggtttgttacataggtatacacatgccatggtggtttggtgcacccatcaacccatcatttacattaggtatttctcttaatgctatccctccccttgcctcccaccccctgacaggccctagtgtgtgatgttcccctccctgggtccatgtgttctcattgttcagctcccacttatacgtgagatcatgtgatgttttgttttccgttcctgtgttagtttgcggagaattatggtttccagcttcatccatgtccctgcaaaggacatgaactcactcttttttatggctgcatagtattccatggtgtatatgtgccacattttctttatccaatctatcattgatgggcatttggattggttccaagaatggcgatcattaaaattcaagaaacaacagatgctggagaggatatggagaaataggaatgcttttacactgttggtggggtgtaaattagttcaaccattgtggaagacagtgtggcagttcctcaaggatttagaaccagaaatgccatttgacccagcaatcacattactgcgtatattcccaaaggattatgaattattcaactatattttaaagtgaattttgctaagttttattgtcatgtcagttttttttaattatttggtttttttgttcatttgttttgcttggtgagtaaaactgctctttaaatctaataaagggaggaaatagagaagagtgtggatctaaataatccagtttggcttcttacaatagttcattttcccagataattgtttatttattttgctttgcctctacctgagaaaggagaagatttgggttctatgcctacctcccttcattccctttctccacagtggtcagatccattaaagaacagagtccttggtcagatcaacatagcattcatgaaaaccaactctcagaaaggaggaatatgcaacgactgtcactgcaaacttccaaataaagaatcttcttagtgatattttcaaaatatattgacaggagttgagtcatatccttgcatgtcactgcctctccccacagtgggatgaacatttgcatctgaatgatcgcccttcatttcctgagctggatttgactttgctgtcctaaagatgccagtgcactcagttagaactgtgctgtgctaagtccattacacagcattcaagaaaataagaaatgatcagaagatgttggctttatgctaaatttgtcaatcacatgaacggaactgtgtccaacaaaagaagtcataatcaccttttatggaaaaggttcttaaaatgtggtcctcagaccaattgcatcacctcttgagaatttgttggaattgcaaattcttgagcccccaccccaaatatcagaaactctggtggtgaggcccatcagtttctttttatcaaacctttccaatgtttctgatacatgttaaagagacacaggaacatttttaaaagctgcttagtatgcacataaaatagagattatgctggaaaaggtacaaggacatatttatatggctgccaatgtaaaatgagaaaagctctggaaagtgaaagagtgaatgagagaagagagaagggagagagagagaaagaagggagagagaggagagagggagaaggggagagagagagagacagacagagagaaagagagagaccgggtacaatggctcacacctgcaatcacagcactttgggaggcagacttgaggtcaggagttcaagatcagcctggacaacatggtagcagtgagctgagattgcaccactgcactccagcctgggaaacagagtcagtgagactccgtctcaaaataagtaaataaataaataaatactttttttttttttttttttttttttgagacacagggtttcactcttcttgcccgggctagagttcagcggtgcaatgtcggctcactgcaagttctgtcttccgggtacaagcgattttactgcctcagcctcccgaatagctgggattacaggtgccaccatacctggctaattgttttgtatttttagtagagctgtgtttcaccatgttggccaggctggtctcgaaatcctgacctcaggtgattcacccatctcagcctcccaaagtgctgggattacaggcgtgagccactgtgcccggccaataaataattttcttaaaagatccaggaaatatttatttagtccaaatatgcaaaactatttgtcctaagggaaattattgttttttcagcaaatagagtaattaaaataatactaaggaaattccttatttggcagttcgcaatgacaatttgtatgtgcatcatttctgagaactgttttttctgaatcctatgttgatatggacaaggactatgttctctaatggatttaaacattgtggaggaagaggatggaggaaggcaggcatagttcccaaatcctctcttttgtcagatagaggcaaattaaaacaattatctgggaaaattgacttttgtaagaagtcaaatcagatcattcagatccagacatttctttatttccttccttttgactctattaaattactgattaaatcattttacaagttattttctgtcacctgtaaaaaacttttcagctaagaaagaagagatacctctttttccacactcaaaaaacacacctctaaaaatagacatacatgtttgtaaatagaaagatacatgagagggttccacatacatctgtctttttacgtgaaagttaaaacttatgggtaagtttaatacattgctgtatatgagagatatacaaatttaactaattatggtttttttgctaaaattaaatgttatttattacagattgtgtcatagaatatagattccgtttcatttttttttaaatgctcatcatcactggccatcagagaaatgctaatccaaaccacaatgagataccatctcacaccagttagaatggtgatcattaaaaagtcaggaaacaacagctgctggagaggatgtggagaaataggaacacttttacactgttggtgggactgtaaactagttcaacccttgtggaagtcagtgtggcaattcctcagggatttagaactagaaataccgtttgacccagccatcccattactgggtatatacccaaaggattataaatcatgctggtataaagacacatgcacacatatgtttattgcggcggcactattcacaatagcaaagacttggaaccaacccaaatgtccaacgatagcctggattaagaaaatgtggcacatgtacaccgtggagtactatgcagccacaaaaaaggatgagtttatgtcctttgtagggacatggatgaagctggaaaccatcattctcagcaaactatcgcaaggacaaaaacccaaacaccgcatgttctcactcataggtggaaattgaacaatgagaacacatggtcacaggaaggggaacgtcacacactggggcctgttgtggggtagggggaggggggagggatagctattaggagatatacctagtgttagatgacgagtttgtgggtgcagcacaccaacatggtacatgtataatatatgacagacctgcacgttgtgcacatgtaccctagagcttaaagtataattaaaaaaaaaaaagaaaaactgaatagattccatttcaaactgaaatttcagtttaaaacattatgcaaaagagccctagccatttcatgtggaattaatatatttttccattttgtttcatagaagtatggagcagtgggatcactttcacaatcaacaggaggacactgatagctgctccgaatctgtgaaatttgatgctcgctcaatgacagctttgcttcctccgagtaagtagagggggatgggctgcccatggaggttgttcttagagttattgacaaaatataaaattatagtcttgagacttaccttaaatgtaagtggatgttaaaataatacttatttgaccaacaggggtattcttgagacagaataaaaataagcttaaataaaagtaaggcagtattatatgaaattaaattaatctacaacattgattgagccttctggcttcccagctacaatattaggttctggagataaatatgatcctagcaccgtgagctaatattcgaaaatcatgggtggtaggtgcctgtattagttttctagagttgttgtaacaaatgggaggcttaaaacagaaatgtattcgctcacagttctgagatgcagaagtctaaaatgcaggtgtcagaaagaccatgtgccctttcgaaggctctagagaagaatcttcctgtgcctcctcccagcttctacgggctactggcagtccttagtgttccttgcctctgtagctgcaccactcatctttcccgccttcttcgtatggtcttctctctgtagctatttgttcttttcttacaaagacatcagtcattagattagggttcaccctaatccaatatcacttcattttaacttgattacatctccaaagaccctatttccaaataaacttactttcactggtacctatggttaaaactttaacatatctgttggtggcacagaattcaacccatatagcagtggtgaaacatgtttgcacaggttacgacaacagctaaaaagtagcaatactcagctgtatctcaacaggatcatttaagatgtcaggagaaagttacttataattctgctaaacctcaaaatataaatacatatcgctaaggggatgggtggaggcagaaaagaaagagaagatatttcagtgtgaagaagcagcatatacaaagttaaagcctcatatatgagttcttacatagcaaacctgaaatacagacctcaactccagggcacagtggatcttgtgctctgtgtaaaggatggatgggaggatatggcacaagtgagacacatgtaagaaaagataacagtgagggctgttacagacagaaatgatgagagtttgaagaaggaggagagagacatcgggagcagagaaaaagcaatcaaaatgtttgagagctatttaaaaggtagaatttacatttgtgatgataaattagagatgagaagatgactcctacttttcaggcttaatcaacctggcaggtggactatatctccacttgcttctattatgggttctttttcttttttccttccatcttttctttcctttccttttctctcttttcctttttttttttttctttttgagacagggtctcactttttcacctaggctggagtgcagtggtgcgatcatagcccattgcagcctcaacctcttgggctcaagcaattctcctacctcagcctcgtaagtatcttgggttacagggacatgctaccatgactggctaatttttgtagtttttgtagagccagggtttctccatgttgcccaggctggtctcaaactcctaggctcaagccatcctcccgccttggcctcccaaagtgctgggattacaggcgtgagccactgcatccagctcttctcttttctttactttttaaaaactgtctcttattttcttttcaataccttaaaataaaaaagtttgtttttaatttaacaatttgcaacctgaaagcaacatttactttttttaattgatcaatgaaagcaatgaccatagaaaataaatttttaatgaccattgtattcaactaatcagagaaatgacttcctcatctactgtttcccctttatattgatttgtctctactacaattaatatcccattatataaatcacagtgccatataaatgcatatgaataaaaggttactgttattaatatgttctgaaatatagagagagtgggcttcattgatccattctaaagattagtaaaaatgtgaatcactttatttcatttttcttaaatattgtttacactgtattcaaatcataagaggtatgcagatacaaaactattgagaaggaattgaacaagaaaattattttaacatcatagtcattgaaaataagtatttgccctatctgattttaaaatattaaaaaattgcatagttactttagaaaattttattgtcacccagaatattttcccatatgaacattgaataaaatttatgtttgtatatgtaagtgttgatattaaaatttaccagctgattccaaaagatcaaacaagcacaacttgtagagcacagtaactttcttgtagatgtttagtgagtggataagtcagtcaagtgcctataatgatacctggattggcttttcctgtgactgtccttttgctttctactgcaaagatgtggaacattttttcttcttttttattccaataggcttggtagtaagaatataattggagattaaaacaattttaattatggaagaagacaacactttctaacagtaggctgggcttttttgttttattagatcctaaaaacagcccttcccttcaagagaaactgaagtccttcaaagctgcactgattgccctttacctcctcgtgtttgcagttctcatccctctcattggaatagtggcaggtaacgtaacccagagttttgaaatttagtaactcgtcccgtgaattattcattgccaaagcaaaaaagaagcattcagtcttttgtatatggtacattcataaagaaaatactgcattacaaagtgtccttcaaatttgttaagttaaaaaacagattccgcaaagttaagtagaaaaaaatagtttttaaattagaaaaaacaaaatagaatggaaaaaaagaagtgcaagataaaaatacagatttgtaatagtaaaatgaaaaggacactctttcaaaaatatattatcctctagagtcctctccttctaatgtgggtgacaaattttaaaagtattcattttgccaatgtgaagaagtaagatgatcatttacattaacaatagctataatataaaaaaaaagcctgttgtccaggagaagctcttctattcttagtactgagagcagaaaaaatatttctgtcagtttttaaagagaggagactttgtagaataatggcctacaacttagtaaaatccagcttatatgaccacatttttcatagggatattatttaaaatatctctaaaaataacctgatagtatcttctcaaagaaaaaatatacaacgtgatacttgggctcaaaatgatgttcctgaggtatatatttctttggagggtctgacttgaaccggagatagatttgactgtttctacaagggtagatagcttgtatacaccgtaagcacttatgtaaatattattccccgcgtagcattttggatggatttgatgtatttcgattggcatttgaatttatatgccttatagctctcctcttctctatatgactgataaaatgtctgcccatgtgctctaataagagataggctgggaataagatacatttttatgtgcatactaagcagtttaacaacaacaacaaaaaagttcctaaagaccaggccaaagttcctctgctacagggcagtctaaggaagtattccaagacagagcaaaaattccactaagaaagaaataatgaaaacaataatacacccttacaattaacctctctacagagactgtaattattctcattatccacataagaaaattcagacagctcagtattggagctggagttcccatccaagacttccgaaccctagttactctggtctcttgtctcccagtttaatcaagtctttataaaacaacatggttggccaataaaaaaacaaaaaagtcagctgggcacggtggctcatgcctgtaatcccagcactttgggaggccgaggcgggcagatcacgaggtcaggagatcgagaccatcctggctaacatggtgaaaacccgtctctactaaaaatacaaaaaaattagccaggagtggtggcgggtgcctgtagtcccagctactcgggaggctgagccaggagaatggcgtgaacccaggaggtggaacttgcagtgagccgagatcgcgccactgtgctccagcctgaggggacagagcgagactccgtctcaaaaaaaaaagaaaaaacaaaaaagtcaccacaggaaaatattttccagaggtaacaattaacttctttttggccattaaaaatacactaaaacaaaaatccaaccataacaaccaaccaaccaaactattgttgtctgagtaaaaggacctgacacgtttggcattaaacaatttcctggtaaatcaaggttatctgtatgtttgtttatgtctatgcttatctgtaatttgaaatgtataactaaatgatgcttcattgttgggattattacatataaaccaattagaatttgagtagatttcatcacctttatgcaaatcactgcctgcagtaccagcaccagggaccgcagcttctgataggctcgtgcagagtgcagacaggagtcggaaaataattcaaggttctaaccaagttcaaagtccccgagctattagaaaatactaccaagtcaacacatttattctggagtttacaatgattgatttgaagtagtttgtttactgaaactacagtaggtaccgactaaaattgactagacactaagaatgttcaaattttataagtacacatcagtatcagattcaccagaatttggaaaaggcctcactatgtttattatgtattaacaataaacaattcacaatccacttacaactttaattaagttgtagatcagtatatttttcaaaaagaaactaaaaagcaatatatatctctacttggcataaaaaattacaaatgtagacagaatatatccctaaaatggtagaagtttggcaaatatgaattcatgggtgaaatagaatattatatataaaactctgtgaagtgaattatatattgaggggtattttcttaattataaggtttattccatttacaatcttttcttaaagaagctgctgaaatactgtcagagtgtaacaacataatactgtgtcagaacaataagataaaaatcaagaatttatgtatatatatataaattgttactgaaatactaaaaattctttagctgaaaacaatatccatttggggtatgaaaagataattccaatatgaaagagtagatatgatctgtagaatcaaatataaccctgtccgtaggttgttgcacagaccataaaattctgtctcctttcatatgtgaaacagaaaagtcacaaaatgccatctctccaataaaaataagtgaacttttgaaaatataaatcctggcattctttacctagatatatgataaaaagttaacattttatagaaaaattagttttcactcagggttcgatgaaacaggcaatttgtgtttttagatctattaacaaaatgtagcatttactgtcacctcatgtttaacttgttgtcaaattaaaaatagttggtcatatgaccttagtcacattggggcttctctttccatattgtgaaaaatattagctttactgatacaaaataaatcttatttccagtgaaagtaaaagtatatggttgagcaatcagagcaatgtgcatagtaaaataaagcagagagatgactgtgttcatatgaacatccaactccagaaaaagatttttatcacacaatgctacttccccatagttaatcaatattgggcatataggtacctgaatcacacatcttgaatccaaatattaatcatagcaaaaacctgaaacttttcaagtgcttattacatgccaggaagtggtctaagtattttacatatagttcatttaattatttggacactgactattagtaccccatttatacaggtggtgaaatagaggcaataacagattaagtaacttgtccaacgccatagtttataaagggcagagccagaattgctaacccaggcagttctattctagaatctaaattcttaactgctacttcaaaagaaataataatcaaaaaaggacaacgttagaggaaaattttgaagtaattttgataaaattgtttatttgggctcctcattgttacagtcaaattccattcccaattgttcttttattcccagagtaactcaagcaatactttccacatagtatataagaattaaatcatagaattaatgaatgcatggatgaggctgtcaacccaaaacttggtccccacaatgaatttaataaatgtgatgagatacagttaagaaatatacttttatttccaaggtattgatacgttaagacatgtagagtaacatactcaatacaaactctattgtagatcacatcaaaatattgtcatattttgttatttcacataagctaatattaaattaataaaacaaggaaaaatatggtatcatgtattttttgaaattagaatttaactgcatatttaggatgacactcttaatgtaataatagctacagtagtaatgcttatcaaacagcttctttttttttttttttttttttgagacagagtcttgctctgtcagccaggctggagtgcagtgcagtggcacaatctcggcacactgcaacctccgcctcccgggctcaagcaattctcctgcctcagcctcccgagcagctgggactgcaggcacccaccaccacgcctggctaatttttgtattcttagtagagacggggtttcaccatgtttgccaggctggtctcgaactcctgacctcaggtgatccacacacagcctctttaagtaaaggtagtaaatacggtggactctgtaactgagataatgtctctcatgtacaaggcactttagaggaatagatatgcctatttaattagtgttcagcaccactgttgaggtaattgttacttttacaaattgagaaaaccaaagcaaggagagcgataagtaacttgttcagagtagcctagttggtaatggaggagtgtaggaagattctagaatcagggaactagatcctatgtaaacaccaagctgttagttattgaacaaaatccttgagttaggggtagaactaaatgtttttcatgtgttgtttaattctcaaaaatctataaaaatggtactatcaccatatcacttttattagaaaattgatagactcaggtggagctgcatatatttttgagcaatatgaaattattctttttattgttccataattgtcaaatgcggaaaatcttatacaaccaatctaatatgaatatgactaacatacatgtagataaaaggtataaatagatacatatagagagatataggaaaacagaaaacctcagccatgactgaatagtgataagattgtgtttaacattttcctcattgtctataattattcatgttttgtttttttttttttgagatggaatctcactctgttgcccaggctggagtgcagtggcgtgatctcggctcactgcaacctctgcctcccaggttcaagtgattctcctgcctcagcctcctgagtagatgggcctgcaggcgcccgccaccacgcctggctaatttttgtatttttagcagagacggggtttcatcatgttggccaggatggtcttgatctcctgacctggggatccacctccctgcgcctcccaaagtgctgggattacaggcatgagccaacgcacccggcctatttttgcataaaaagttaatgtttaagccttttatttttttgaaactagaaaacatattgctttagattatttcagaatgataattagattgtttagagaacatatgcccatttggggatatctatcagcagctcagtatgttcctaaaatactattttagaatataatttttttttaatttgggaaataattaatcacaagattgttcatcaaaacattggctatattactgaaaacagaggcaaactaaatgcagctattttttaaataaatctggcagatccatacatatactacaatggagtttttaaaattatttttgtagaataatattaaataatataaaaaagtacttatgatagagcattacattaaaaagttgtttccagattgtttaaaaatgtcatattttaagataataatatgataagggttgagacacgtacaccaaaatcctagagtttaagctaggatggtgagattcatggtaaattgtttttccatattatgtatattttctaaattttctgctgtgaatatatattttataatagttaaaaaggagtcttatgagaatcgtacctttataaagtgaaaaaatgtatttgcccaatttcctgctccaccaactgtgaattaggtctgtattaactgaaaatgacgcttttctggcagctcaagtgaaagaatgaagaagataaaccaacaatttatccatattatgcatgacaccactatttcaccacttattgcttttgtcatcatcatgattatcactgccattgttaacatattcaacatgcttacttcagaaactgtattaagcattagtccactttattctaacagcagttctgtagacacatagcctttcataatctatagaatttttttttaattggcaaggccaaaatcaatggccaagaagattcatataagcagcaattcagaaagcatgatataatcctggaatcatcttaacgtaaaataggaaagggagaatgtatgcttctcagcaatatacgtagcgtagttcacacgttgtagattaaaaaaaaatactcgatttagcctagcattcaaaatgttggaatggaatggaataaaatgaacggaatggaatgatatgggatgggatcctgtatgcattcaaggatcaggccatgactggtttatttttacttaaatatacagctcaactcctgaagtgggaaacgaagaattgctcagttagttcaactaatgcaaatgatataactcaaagtctcacgggaaaaggaaatgacagcgaagaggaaatgagatttcaagaagtctttatggaacacatgagcaacatggagaagagaatccagcatattttagacatggaagccaacctcatggacacagagcatttccaaaatttcagcatgacaactgatcaaagatttaatgacattcttctgcagctaagtaccttgttttcctcagtccagggacatgggaatgcaatagatgaaatctccaagtccttaataagtttgaataccacattgcttgatttgcagctcaacatagaaaatctgaatggcaaaatccaagagaataccttcaaacaacaagaggtaagagtttgtggactgcaaggtcacttgctggaactgaatccatccaagtctcgtctccttaggcagtacaggaaagcaaaagttgcaaaccctgtttcatcatcctgtttaccctgatttctatggctaacttatccagattttaaacgaatgttaagggatttaaaatggattcgccttctctaaactcttagaaaaaggggaaatttttcccattgaatatagactccctttacatattttataaatactgttaaaatgtctttttagactgcctaaaccaatcataatttttaggttatcttagcagatcttgagaagtgaacactctgtatgtgtgaattttgcaacagacatatttgatatgcttagatttttttttttatttgtaagtttcactcagaacttttgaacttatacatggtcctcaccttaaggtgtcagaagacaatggtattacagtttttgtatggggagtctgttggtgaacctcatcccaacatgttgatattccgtttctattccatgtcacgtctaaaatctatcagtgtttcctacattgttaataagtaagcatatcaaagggtattgggatatcaaagccttgggctatagaaagattagagaaagtgtacaaagaagaaactgtccatagttttgaataatataagaaagacagaaagcgaaaatgttagttatcaggatagacattgattaagttgaggggaaagaagaatggagaagaaatactatttatgtagaaatagggtcagaagagcactgagatgaggtaaggacagagggaaggtggatgagatggaagaagaaggatacatttgattctggcagtgcattaaatcctgcagagaccatggaatgtttttgtttgtttgtttgtttgtttgtttttgagatggagtctcactctgttgcccaggctggagtgcaatggtgagatcatggctcactgcaacctctgcctcccaggttcaagtgattctcgtgccttagcctcccatgtagctgggatcaaaggtacgtgctacctcacccggctaatttctgtatttttagtggagacagagtttgcaccatgttggccaggctgatctcgaactcctggcctcaggtgatctgcccgtcttggcctcccaaggtgctgggattacaggcatgaaccactgcgcctggctgaccatcgaatgcttttgaacccaaacatgaggaattgaaagcaaattggaaactatctggaaggtggtagaaattttgaacctgtttgaagtgataattaatggaaacgatcaaaatctggtgatcagtgagctgtttgagtttcgatagattacacttaaattttggagggaattccagcattagaaaaggaaatgcaagggaatggtgaaagtttgaaagctatatacatctttaaaaacagtagtcactcacagagacttagaaactaggtcagtgccagtgcgtgcatgtgtgtgtgtgtgtgtgtgtgtgtgtgtgtactcctgtgtacactgaaaaacaacattgggacgctcatccccattgcttgaataattttattgacctttgaatctttagctcaatgtaggaataaataaattaaatgaatgcctgaatttgtaaatggcgtttgaggaaataggttataagtgacaccagcataacacttatcaaggacacaccaaaaattaatttgaaagaaagaggaagaacattggcaccaaatgaaagacaggggtggcatttatcatcatccatagaggtgaaaaggactgtacgactacaaaattaaatgcctgtttctaggagggtcactggtggtagcatgtggagggagtgtgtggatgctatataggattttttgaaattaaatacacttttcctcctcccagtgaaaataatttccactgaaatttgacaaatgtaaacaccatgtgcagttttcaaagaagggaataataaggcagcctcagctgccaggcgcagtgcctcacacctgtaatcccagcactttgggaggccgaggtgggtggaccacgaggtcaggagttcgagaccagtctggccaacatagtgaaaccccatctctacaaaattaaaaaaaaaaaaattagtcaggtgtggtagtgtgcacctgtaatcccagctactcgggagaaccacttgaacccaggaggtggaggttgcagggagccgagatcatgccattgcactccagcctgggtgacagtgcgagactccgtctcaaaaaaaaaaaaaaaaaaaaaaaagaaagaaaaagtagcctcagcttttaggtatgatgaaaaacctggatgattcctcgtttctaggaagcaaaatcactgtctagtcacttaacactttatgctgaatgtctggaactacccgacatacttgcagcaatttttagccccctaaattaagtcaagtgtatttatcatggcggtgtgccctacaaacatccatgctcactatttcacctttattgtaatgatggtattgtacagaaaatattaaatggtcaggggaggaggaggtgcaagatagagaaattctaatctagaataaggttttgtttgggagaaggcacagttagagcaataaaagctggtaagtctctctgcttcagtatagtgtcattgaagaggcaaatctagacgcacattcatttattttcgaaggtcctacactctgaccatcttgatcctctcacctaagcttgtctagtctagtccagctcaagagagtgtaatattctttttacttctggattaaagaaaaacataccactggcttatttccccatgtgcaaatcggaaatgagtatctatcaactttagaacataggagtacttaatacaataataaagcatacaatgaagacagaaaatgggataaaagtagaacagagagacaaaaattattaccagaatagatgagaacatttggttcatcaaaaataaaaagcccaatgctgaaagagaaaaccaagcaaatgatctaaaagaaaaattaataaacattaatcgtcagaaatttaatgactggatactttaacctcactataatttgaaaaacaagttaagtaataatgatttgctatgtacctactcttactatgcaaacttaaatatattaatggtacccagtattcagctgcaaaaagtggacgctgatacgcagtaagaggaagaaaaatggtagcatatatttggagagtagtacggcaatggttgaacaaaaatgctgtttaatgtttagtccctttggtcaaatccacttcaggaagatgttctatagaagtacttatatcaatatacaaatatatttaaaatgatgttcatggcagcattgtttagttgtagaaaagtgcacagctcaaaacactatgaataggaatcctaaataaattttgagaaatagattcaattccactaaattactgaaaatatcagtctctaaagtattttaatagataaatatccttaatatattattgagtaaaatataaaagcatattccaggatataggtagatcctctgtctttttcacactcttaagtatatgaatgtgtatgtataaatatacacaaaatatacgtgtatttgaaaacacaaaatactaatgcctcaaatacagaggcaatgcaaactgaaagtaaagcactgttaatatgcgagttcgaggttttattgagtatgaaaatctattgtcaatgatcatcaccactgaggattatgacattaaacttcacttattactataaaacaatttccaatataaatctatcaaattcacgaaatttgactatgttgccactgtaagtacagtacgaagacattttacttcagataaattaagaccttatggtgtttatttaattttattgttagaattttgacatctatatatataggaatagaaacatatcatagatacattaaattgatttttgaagggggttgtgattgtaaacattcagccattcagtcaaaagaggaaatgtttcacaattaaagaattactactttcaaaacagttttctaatttctatattcttattccataaaactcccataatatgtttttaaaaacctgaactccgagggtttcttgaactttcatatttgataattatgtatgtaacaaaggctgtgaatgctcacttatgttttacaggaaatcagtaaattagaggagcgtgtttacaatgtatcagcagaaattatggctatgaaagaagaacaagtgcatttggaacaggaaataaaaggagaagtgaaagtactgaataacatcactaatgatctcagactgaaagattgggaacattctcagaccttgagaaatatcactttaattcaaggtaaaatgtcttgtcatttctccagaaaatgatatatatattaaaatatactgatacatgcagagatttgatatttgaaatcctatggtttgaaataaatagtttctgagcttacatttactgcaaatacccaaaggaaagaatatgaaaatcagataaagacagggtacgataaccagtagcctggtatcacttaaatagaaagggaaaagcaaaatatatcttaaggtctaatgattttctcattgttaaaaactacctcataagtactgaatacaagttttttgtaattacaagtttcttcacatgttcacaaaccaagcttgttaatattgcttttccaaaacttccagtcttttttatttcttacttgactgtattattaattaaaaggatcttttgaactctccaaaataatgatggatttgtccatttcttctgcagtgcctgttagtgaaataaggtgaattggatcttacttatatatataaataaaatatatgtatatatgctttctttatatatataggctttcagttttagctttacattttagatattttagttttagctttacattatagattttttctatattttgattttttgatttctatattttgattttgattttctatattttgatttcaaccatttgcatgtatttttctatattttgattgcaaccttttgcctgttggtattctttgttttaggttagtctcttgtaatgaatacttaccttttcttttaaaaaaatatacaatctgaccatctctttgcactgtatttatttccactatcttatcatgtgctctggttttttccagtttattttatgtttcttttgctttgctgtattgccacttttggattgattaagatttttctcttgctgaatttttctctctaccaaaattaccaaacaggtttcagaaactttgtagtatatttctatttcttattgattgttgaccttaacatttatcttgaagtctaaagttgatcagtatcttaacattcatcctaaaatacacaaggaactgaaagtgctttgatgatcctcttccctagtttcctgctaatattttagtacagtttattctactttatttttttttaatcgagaacttagtcaatattatttttctttttttatacagacaatcttgtggagccttaattagggaaaagtagtcaggctggtaggaccagggaaagcaaagagaaagaagataagctataaatctgcctttcttcttggtccagaacatgtaggtccctcctgcaagaaacttgtcaccagatacctgcaagttaacccactctaaccttggtttatcagtactgcacaagctctcttcagcatacgttataaacactattctataaaatcttcagcaaacctttgtttcctggcaatcagtttctcttctgctggcctgctcattgcctccttgcaacgtattttcctgcttttgttaataaatctgcctttctttatctacaaccatcttggtaaattatttaaccctgcaccactggctcagatagtcatcgctcacccacaacaaatatttatttaaatttgcgcatgaatttaccaattgttctccgttctaaaagcacctcgggcatttcttctgggattattttccttctgcctgaagtatatcttttggaagttcatttagtgaaagtaaattgatcaagaaaccttctgatttcattttctctattttgacttgatctttgaaattgttttactatatacacacttattaggttgacagttattttgattccttctatcagtgtgctgaaaaaattggtcccctggcttcaagcttttcttgtggctcttaaaatgactgccaccaatctgtttgtcattctctttgtctttcatatctgcagttttacttatctgtggttttgtattgataatttatccatctaacatttgctgtacttcttatattagtggatttatgtctatcagtttgggaatataaccagcttcattcactttgactattgcttcttcacgattctttctctcctttcctctgtaacttacatgaaattcatattggatgttctcattccagcttccatgtctgttaagctctatttcatgattttaatattttgtctcattttatatcattagcaactagaaaaatagaactaagaacttcatgtgacttcatttcaaatacactagtttgagaaaattaagaagcctaataatcaagtgatgacaatgaaaaaaagaataaaaacaagtcccagaaaactatatatagacaatttttacttctaatgctcatagttagtaaaattatgtaaatttacagacacataaatatgtaatataatcattgttttaaaatttaagaaaatgataaacacaaaattcagggtaatatttatctatgaaaaggaaatagatgaatgagataggggaacatctaggtagataccgatttcttggattgtgatgttgcaagggtattctcattattgttgtactttatagcttgcttatacagaacacatatcatatatagtatttatcacaataaaacagatgataaagaaaaatttgaattaatcagatttttctctaacagttagatacctccactttggatttcaaataaatgtccgaagctttacaaattcaaaaccaaatccttgcttcttaactagccacccgcatctgcctccccaaatctgttgcgttttcagtctttttgttggttttgtcattttccaactacctgctcactgcctgatcttggaagctgtctttgacttccttgctctcattctctatgtaatccatttgtaagtcctactaattcttatttcatacaatatctcaaaccaaacttcttcttactctctactactactctaattcaagcaaccatatcccagtctggtgtattacatccgcttctcagttggtgtccctggctctgctcttagtccattctaaatagcaaaaaaaaaaaaaaaaaaatgctatttaagaaaacccacacaaattactggatgtgtgtggtttctctctttacactagatgtgtcttttctctctcttgcttaaatcctccaatgtcttctcattagtcttgggataaaatctaaacttctacttggtctgtcacctgtctacttctctgccctaattttctcaatcttccctctgtcatccttctgcctagcttggaaatgtggaagaatgaagtgccacgaacaagtaaaagttaatatagaaaaagtgcttgtttcatttcatgctgtccataatgaacactagacattttctctttctcttgaaaggttcttctctacgtctctactccttcttggctccacttgaagttacctcctccactttccaccattcttattctaaactcccccatctctctctaccatgatttgctttaatttcctcatagtttttaccactatatgaaatcatgtcatctctacatttgcttacttgtttagcttgtatcttctccagcagaatgtgagctctgtgaggttaagtcttctcctccttgtctacctctgcaatcccaatgcctgttagagtgcctggaaaatagtgggtgagcaattacatatgtgttgagtgaataagtgaaactaagacttttgtcttagcaagttacactctataatagcagtgtcattcttcctggtttccaagctatcaattttaattattttatatctcccaagaccaccattagttctcaacattctgtattctctgttcctttgtcatttctttatatcctcgtgtaaattattcttatgactctttgccagagttgcaattgtttcctgcccagactgtaatcctttttgcacccttgtagaatacagccttcctaaaggaagtcttagattgcataaagactctctgttgccccgtcattagacatacagttttgcctgtagcactcaaggtctttttcagtgtgtctcttaactagtcttgaatgcttcattccctcgcttgtcttttttgtatatcaaatatttcaactaatttgactgtgattctaatgtacccagtactttgtgcatcctgcctcatgtcttttcctttatttgaaatattttctctttgatttgtattcgaagatatcttgtttatcattcaaagtccatctaagatgccacctcttgcatgaagcctttgctggttctaccaatagtaaggcccagctgatacttatttctgtcttaatatggaacattaagtattctctcacaagagaatacttaatgtgatagttatgtataaaagtatctcatattctcttcgagaacagtgttcactcttcctggacacaagctacttccattagaaactgttctttatatctcttatagcacctagccataaaatatctattaattaaattataacttaagaaccatattttagaaattaatgagtgctttatcctttatcatgtgttgattgcagagttagtgtaattactttgtgttctcttttcccttatattaataatcactaaataattatacagttaaaagagacaaagattttttaatacatttctcaaatagttataataattagagccttaaagaactacataaaatttcattgtggaaatggtgaagtagagtttggtggagagttggggataacgtgatttaaagaagcaaagatgaactctagagaaaggtatttaagagaaataaaatataatatgactctgtggtgagaatagctaacattttgtttatttggaaacattttagatatattggcttcctaggatatgaaagcaccaaaaaagaaatattgatttttatagtagagaaaatgaaaaagcaactgagggcatttgaatttggagttttgtataattaattactgagattgtaacagctggactgtaggctagaagtggtggctcatgcctgtaatcccagcgctttgggaggctgagacaatataattccagcacttcaggagagtgagacatgagggccttttgagcccagaagttcaagaccagcctaggcaaagtagcaagaccctatctctgaaaaaaaaaaaaaaaaaaaaattaaccaaaggaaaaaaactgaattgtgagtttgtctaaccactatgtaaaggaaaaattcagctgaggaataatggaagaacagatgtggaaaatgaagtcaattaaatttagaacatggtagcataggatcaggaaagaaatgaaattcttctagttctgatttaacccaactagctttaagaccttgagcaactcactctctgaccctctataaatatgtttagttaaacaatgtttaaagtgtcttccagattaaacatatctaaatcaatgagcatgaaaactagagaaaaaaaaaagaagcaggtttaggcagcaatagactagaagatgtggcagatttttatgatgatctgaatatgagacaagattgaaaacggagtagaagattaatgctcataatgaataaaaactagagaagcatcgctctggaaacttagtcagatattattagtgctatgttatcgtctgaggattttaaatgatatgatacacctgggtttgtttttctagtaaattgtgtaattttgttctatgatattgatgattatcaaatattatatatcagtacttttttgtggttatatagaaatattacttttcctttttaagaagtaatcatggaggaagctacatagtagattttgtgcatgtgttgtataaaggtaattcttcatggcagattattgtgatagtatttatgaattattcctgtaactgtaattggaaatattaaagatgaaaaataatgtaaattctatggcttcttgaactagaataaatcatatattttggccaatattaacccattttttttgacatgtatcagcaagggagctgacaggtagcattttgtccatttattgatgcaacgaggcagttattatgtcagtatggaacaaaattttgaaaagactaaatggaaactacgaacaaaaggtgactacaagagactctaagtctttattcttttttccataatatgacagaataggttactgcatttccttaatttgatagagacattgcaaaacggattcttatcaaaaagaagaagaaagccaacactgagggaactaggaggtgaaacagataaaacacattcagactagattaaaaatctctagcaatagtccagctgtgtgatggtgaagacgtgagctacaatgggaatggagaggaggctagttttggaaggtggcaaggtagtggatagtgttcttaaaagttctgcatcagaaactaagagtaaagtggtatataatttgttattttattcccccaatgaatctaaaagacacttaaaacatttattgagatccttccaacattttgttagaaacagtaaaagatctataacaatgtacaaaaatgaaacataatgtgagattaatgttacatgaagaatagaatgacaataaaaaggtacattcaacatgcctagttagaactctaacaaaaatctttacctgtttttcttattgtaggattcgaataccaggtatcagtatttttatataaaaatacagagagggatctttaactccaaattttgtaaaataatactgatctattcgctgtgattgaactaatactccaaaattaagtatacagttcccataattacatgtaatataattgaaaggatagttagtaattaggagagttccttccatctcttacttaccaaagaaatggtgagaagtccatctcagaggctaagagtctagatctattctctgtgtcccttgtttcttcttgtttcatgttctagtttttcctggaatgtctgcgtcttgctttggatcctgagttactaaactgaaatctttgcttgcgcacttttttcaaaataccatccttgattactatccctgtgcttcccttcaattagctcaacaaaattcaggcataaattgagtgtctgtcctgcttgcccccctcccctgggattcattgctatgtagtgttgaatggatgcagctgcgttcatggttatggaagttaccataactccattttcttgggaagtactacattcttctgcagggaatagggggcacatagagattccctttgatacagaaatcttacatttcttgtgcagcatttaaatatatgtctcgcagcaattaagctataccttagaatataatacaccagttaatttctaaaagccctgtaacatgttgtttgcatgacgattatgtggaaaaaaaaaatacacgtacacacttaggaaagaaatggtaaagatctttagttaaaataacacaactacgaattatattcttcctcacgctttttctaggcttttatgtttcctataagtagagttgcttttataataaaaatacaattaaatgtgtgtccaatgttgcatatgaggagaaagggacattctattgagaagagtaataatgatatcttgggcctctaaaacccaaattgtaccttgaaaatgggacataccagaggaatagacagaagtagagtcaaggatgtcaaaataagcaacaacaaaatgtacaaaatatacttattcatgagataatctttatttatttatgtggttccccctcttagatttcttcgggtattatgtctcccacctgattaaaatttgtaaacaagtgcattctaaccagggatgctgtatatatttgttttccttggactatgtatgtgtccaaactagcaattgaaaatgcttcctttaaaatatcactatttccttattctgtggtgaatctatggaataatgtttctttctgtttctttcttctggtgttgaaaaggaaactaagtgctcttctttagataaagaagagattatttgtcctctgtactccatatggaacatggtgtttaggtaggattacctttgagttctaaagacatgctaggtataatcattttaaaggcatgatgagcaggtatctgttttgctggacacagaaaatacaaatggctaaatcagggttgtttagttacagctctcaggagagccacctgaaaaaaaatgatgagaccaaagttttccttgcaatgtctccattttgtttacagtatttatagcaacctagaaattctacttaatattttacttgaaaaaagaattcctctactcattttcaccttcctgcctttcctcatgcctttctcaatccctaggaattgtcttccttccccttcccttcattcttgaaagtacccctcatatcctactttctcaatgaagacttcaaccatcaccattcacgccgatctacagttcactgacaaatatctgagtttatggtcagttccaacaaagtgctttctggttgtctaccatgtgtgaattttcctttcccttgagggtatcacaaatgtcttttaagttcttacttatagattttccgtatagtagctaattctgtattatatctaactctatgtctaactgcctaggatgcgtacaacactaatgtgactttgtgccagcctgctgtcttttctctgcccccaggttctcagaacatagaaaagtgttaggcacactcacatttaatatactgttaggttgtttactttgaggcaatgtcatcctcattagtatagggcattatattcctgaatagcagaatactcctccattcatgaagttcagtattatacattctatattattgcacaacaaatagaagactttggatttccttatataagtaccttgacagatgactaacccatttttcctatgctttacaactatgatcagtaactgtaatttttttaaaggtcctcctggacccccgggtgaaaaaggagatcgaggtcccactggagaaagtggtccacgaggatttccaggtccaataggtatggtaattttagctatttaatcatatactgtgaagatagatgatatacatccaggtacatgtgtaggggaggattgctattttatttatatcctgcagaggatgtgtatgtgtgtgtgtgtgtgtatgcacgcacatgtgtgtatatgtgtgtgtgttttgggggattagtaaatgttctagtagcctaatcacataatacactgaatgataagcattactcatgactgttgaagaaaataaatgctttaaccagagtaaccaaatggaattgtttgtaagtctagatagtgacatgtatataatagacagcaaacagtataaggcagacctaaccgtagatcatatgtgaaggggagtacaacaattatctttgcgttgaataaatcatcttcacatttgcaagctatctcatttttaagacataaaaactcacactagtagtgagttatgaatcacaagcaaattggactatatttcttatatagtatttggaatatatctgtttaaactaatgaaatctgaatgtaaatattggctaaaatatggatgacacttaccttgctgacagtcactctctgtgctttactaagagcaaaactgtttcaaattattttcctctaagttgtaatcttgaaagaaatattttgaaagaagacacagaagagagaacatgaactttctttgcttgaaaaaataaaaaagataataacatgattgtcatgttagccttggcttgaaatcaaatatcctgcatgccgtttgatggtaggaagtatactgcaaggtctaattataagtagaatggtttgtgttaccaaaacatgtctaaataccatgtacttcatcttatttttctgtcttttgattatataaaaggttcttctttctgatcagtgtattgactagccctggtcacatcagaaaaatttttgaaaatgagaagcatgaacttgatacctgcctaagcacatatatgtatatatatgtatataaatatatatggcatattatatgtgaagatagatgatatacatccaggtacacatgttttatatatataaaatagcaatcctacccatatatataatatgccaagtcaggtggtattagtattgatgtgcttttgaatgccttgccaggaaagaatttttattcaggaaagtctttctacttgactaatgctaatcagatattaacaatgctgcattaatgtcataagcagaggaaataaccagtattaaatctgctgccagaactaccattgtcaagggtctatcaccccctccatacaggctgcaattgtcagagctttataactcaaccataaaaattcagtctgggctacatcttgccatacagtgcttcatcttgggagaatcttctgcagctgtttctgaactgtgaatgtatgaaatagaaggatttataaatttcagcttgtgttaatgttataaatagacaccattgcaaagaatctttgattttgttttttttttattgtaaattaacgatttgtcatggtttaaatttacagggtaaaaagtgatgtcataatttgttgcttttggtactgctcatttacacaaataggcattacccagttcctcataaaagacaggtcgagttcctggggtaatcaatgactcttctaggttatcaggttaccattttgtttggtgcactacaagaaaagtattcaaaataccaggcatctttcctaatgaattatttctggatgtcttgctgcattctgttcgtttctccaccagattgtctaattgccttatatttgatgccgaaatcaggaagcaaagagtatatgatggacaatcatactaattctgctttctaatctgagcaggtttattgcttccccatctctacatccatttgagcctactaaactcagcttgaccaagtcaaactcacctagactcacaatcatgatgcgaatatctgcaaaacctaagtggttgtcctagtagcctcaaataactaatacattaaatatagtagaattattattcatatactagggtggatattatgtttaaatatgctttattccccaaataataacaaatttattttagagggctatttccttgaaagcatgctagggagaatgacctatcacttttcactcaaaaactatgtgctgagcactttctccaggcctggtgttctacaataccctatagagtatgtgtaaacagatacagaatctctgaattcacagcgcttccaggatgataagtagtaatataagggaggcaaatgtcatgatcaaggattttttatctcatgtgagtttcttttaaggggctgattttacccatgacaacaatgttttgaaggagaagcaactttcttttctaaaggaaactttgtgtgggccatctaagaagctgtttatgcccaatgtgatcaataacaaggtagtttgacctgtaggcatgggtggggctacctacatgagatgccctcgagagaactgaaggcttctctggctgcaaacttttcatcatcaaccagtactatttacttccttacgtagtctgaattttccaccataggaatcgtgcttccagaagagaaaataaagctcatcttacccatagatattggaagagaggaaccatattttattaatgtttatatccacgtatatctttaccctggcccgccccttcccataggctatggccccaagaaggcccctccctaaagcttcagcaaggacaggatccttaaatatacacctgagtaaggaatgttgcctggctgcaggctgtcgctctacacctgagtattgaaagtgggttttttctggaagtaacaaattgtgccagtgaatcaaaaaatgtcactgctaactgtgtacgtatcatttaataaaactaaatttagaagcctttacaacaggctggtaaaaataatgattgtattactgaggaggaggatgaggaagagggggaggagaacaagaaaagctaacatttacaaagtagtcattacatgccaggcacttttctaagtgttttacgtgtatgagctcttttaactatcacatcagcctgatgatgcagaaacaaataatacacccattttacaggtgcaatgcacagtaaagttaaatgacttgcttgaggtcaatcagcaactggtaagtggcaaagctggtatttgaaccccaatgggcatgagtgcagagtccatgcccttaaccagtctgctactttgcaggaaggagcctgaatggagcaggacacctaggacatgtgaataattatcagaccagctttatgtaagtgatttgatcactctggtctcatggaactgtctctaaaatgatggattctgacttgatgatgtctaacgtctctttgaacatcccatggctgagattccatgtaactgtacttatattgtccatgagttagaagcaggtgccagaccctttcccattgccacagattattgtagaaaattagttaattgcctcctgaaagcctcagggtatctgatcttatggaataaagttcaacagctgtgcttacattttggggactacattttgaaccatcattaaacaaacaagtcacataactccataggccatatagagtctgcttaaccatctccaagaacagaggtctatgactgcctgatttctatgaaagtatctcatatgcttcatttacagagttatttgttcattcattgaaaatgtacttgatttgtagttgaacatccttgatttttagttgaacagctgtgttctgagcatcactgtgaggtacttgagaagtcagcattggaggggcttctctgatgctcttatggccccaagatgctcctgtctaaagcaggcaacatggcattctctgccatgggatcaagtgagactgggtgaacgagttctctctgaattgataatgacaaaataagatgcctaaactgttacaatagtttatcaagaactactgaactctaggataaaatattttatttcactggaatataacattttcttttatatacagttgttatgatcaccatagtaatattgggtaaaaaaaatagccattttcagttttcatttaagcatatgaaaccctggatttgtgtaagtatatagtacatactcataagtaaatctgtgtatcgcatgtgtgtgtgtgtgtgtgtgtgtgtgtgtgtgtgtttatgtttatgtttatttaccctgggattacaatgaaatatgtaagaacaggtccatgatagataaagtaatatatttcagagccaagacaccaatttattttataaaacactcgttgatactttacattgcttgagttgcatttttttctaaggcaaatcttaagaattcaattttcagcttatgcattttaaagttattatttcagctacagcaagatcctgccatttgatgattactggttgactacataagtcttttggttaaaactccaagatctatttttcctaatgtgcttttatttctaccaacaatatgttatttattgaatagctacaatgtgctgaatgtactaaggtttatatttatcgcttctattgtttttcaatgtcaaacattaaattttaggaaagatattattccttcatttgaagattctctaatttcatattcacttataaaactagatgttttcattatactctcaagtctgtatgaaaatgaattattaccttctttttttcttcgttaataatgtaggtcctccgggtcttaaaggtgatcggggagcaattggctttcctggaagtcgaggactcccaggatatgccggaaggccaggtattacaataatgtgtattttctttatagaatatgtagaagaaacaccagataattttatatatatatatatatatatatatatatatacacacacacacatacacacacacataatgttatatatgtagtatacatatttttaaattcttggatgataaaaagtggtcattgtgtgaatactagtattcacatgcagttattttgtggtctagaaatgatttctgaaatcagatttttgaaactgacttctgttcacccgaggaaagtctctatatcccaaaggaaaatcgtttaaaaaaacacacaggagttataaactcctcacaatcataaatcatcactaacaatgatatccgtctttgaacaaagagagttgaaagactggcaaagaaaaaaaaagaagcaaagtgtaaatacccgtttaaccacaactggccagactttgtgaagttactgttagcaaaatacagagaagtctgaaatcctatcctctgcaaaataaattgtctgccattatctactagtgcttaagaatcaaggttgctcagcattttgaaatctacacacatgatgatattatttccatcagctctgccagtagcctaagcttaaattgcaaactttgaacagcaatcttagaaagagctaggcttactgtctcctcatttcaaagtgaattatcatcaagagaatagagtcgggccaagtgcagaggtgagtacctgtagtcccagctatttgagacgctgaggtgggaggattgcttagctcaggagtttgagacgagcctgagcaacatagtgaggccctgtctctaaaaaaataagaaaaagaaaaaaaaggaatagggtccctatcattgaggtatttttaaactacattttatttttagaacagttttacatttatagaaaaactgcacagaaagcatagagagttcccataaaccacccatgcacacatggtctcctctactattaacatcttgcattagtgtggtatatatgtaaccattaataaaccaacactgacatattattacccaaaatctataatgtacattagtggccactctttctgttgtacattttatgtgtttcagcagatgtataatgtcatgtatccatcattacagtattagacagaatagtttcactgccctaaaggtcccctgtgctccaccaactctattcctccccaccacaatctcttggcagctgctgatctttttactgactccatagttttgccttttccagaatgtcatatagttggagtcagacagtatgtggccttgtcagactggcttctttcacttagcaatatgaatgtaaggtttctctatatctttccatggtctgattgctcatttctttttattactcaatagtattccattttatggatttaccacaatttgtttatccattcaactactgaaggacgctttggttgcttcaaagttttaggctgggcgtggtggctcacacctgtaatcgtagcacttttggaggccaaggcaggcagatcactgaggtgggcggatcacttgaggtcatcagttcaagaccagcctggccaacctggtgaaaccgtgtctctaccaaaagatacaaaaattagccaggcatggtggcatcctattcaggaggctgaggtgggaggatcacttgaacccaggaggcagaggttgcaatgaaccaagatcatgccactgcactccagcctgggtaacagagtgagaccctgactcaaaaaaaaaagttttagaaattctacgtaaagcagctataaacattaatgtgctggcttttctgtggacaggagtttacctaagagtgtgattgttggatcaaatggtaaacctatgtttagctttggagagtattatttcattcattcacccagttcacacaacttgatgaggggtcactgtgtgctggagataaatacagcacagctgcttttcttaaggagctggatacagaaaaaaaatgcataagcaattagctataatgccatgtggtaagtaaacaaccttggtgaggttggacaaattgctgtatggaagtagagagtaaggagtgattaattccatactgtaagaaaatgtgttagatagaaagtagtgtttgttagcgctggactaaaagaggcctagaatttctttaggtttgtatttctaaaactattgtaggtgttggaatcaccaggaggatgtgttaaaacagcttacaggactccaccccagagtttctgatgcagtaggtctgggattgggcttgcatcctcaccaatgtccaggtgacggtgatgctattggtccagggaccacattttgaaaaccattatgtttaggtggaaaaaaacagtgcagaaagagtaatcacgcacaaagaaaaacaacggcagaggtaataagtcccttgacaaaacatatccttaggacatcacttcttattaaaagacaccaatctggtagagatgtcagcagcagtgccaggtgctgttctagttgtactgcagagtaaaagaaggaacagtacagtctctcctctacaagagtctgaagaaggtgctaaaattagaaataagtccgataattgtcaaatatgaaataagtaaaaacaggtccgtgatagataaagtaatatatttcagagctaagaccccaatttgtgatataaacactctttgatactttacattgcttgagttgtaattttttcacagcctggactatgtgaatgatatcaaaaacattatcagattctgaagcaaaaagttcaaaaagaacatcctccatctattttcttctattctccctcccacactccttttcttctcaccttgccctttccttctacatggattaagtacacactgctcgtaagggtacagtgctagaaacagggaaatgaagggtgaataagacagtctacaactgaaaagatacacaaacatgagaagagaaagagaagacttcacactttctccatgcatagcagatctatagagtagtccatttataagacctgatatatttacttcagaaagtttggaggatttaattgatgtgaaaccttgcccgtcttcaaaatccgtagaaggttctgttctaccttgttcaacatagtagaactttcagcatgcaaataacgtacttctgtctgttttgcctcttgaagtccattcaaagacttattgtttccctcagggtaagttatggtcattttcaggattatctaaaatattacaccatatgtagttcatttattaattcaacacgtttactgaacattttctctctgtgattcatggagctatctacagacggttgaacacatgagtctgaagtttcgagtagaggccagagattaaaagacaaagtttatctatgattatataaatattattcagaaccactgattttaataatattttatgggtagagagtggaaaggtacaaagagaaggggcatagcataaagctttaagtagttccagaagtacaggctgagatgaacaaagtagcaaatggaagagaagtagcccaactgaagaagaaaacccagagaacagagcatgaaaaaaggcaaacacagagtttcaaaggtggtcaagtaaggtgaagtctacaaaaagccctttgcacctgctgctgtggggatgttgccattgttcagagcagattctgtggggtggggtgataaccagattagggtatgcggagaagggaatggttgataagggttggagatgtggtagactcaactctcaagctgcctcactatgcagaggaggaggaagagatgcattttttgttagttttgtttgtttcatatggttttttttttctttgaaggaaggatctgagtaccacttaaatgcttatggaaagataaaatagaggaggagtggctgaagacagaggaaagcaaagcaaaaaagatagtgtaaggttaatgagtggttataaggtgaggaattcagggaccaggaagaagcacaaggcttaggagagaggatgatcacatttgaaagtagcttgaaagaaacgggggatggaaaggcggcctacagctgcagaaatttggttagtgtaattaaggcatgtaagcagaaatgtctaacctagtatccggctcatataagaggctcacaaaaaatgcttgaaatcatgatgatgttattgaagacaccccctcttacatcctttcaagttagaatatcctcctacatatgacctggttcttacttttgaatggcttttagaaatataagttactttttattaaagagtaatacataggataggagatagttaactctaggtttggaccaagcccttgcattcatttttaaccaaaggtatcattctgaaggaccactacattcctctccattagaaaggatatttttgctgttttcaagtgtgagaaaagattttcaagtatcatcggtaagcaaatctctgaatcatgttaaaatgatacaaaacatttgtttgtttttttataaggagataaggcattttattttaccatctttaaaaggaaaagtcacagtggtataagaacaaaggcaaaataaaaacatgaaactaattttttatttatcatagaatctgagagctacaaggacctttcgtgggtcaagcatgtctctggcttaagcatgtctattctgaaatatctaagacaagttgctgtgtgaaaagacttctaagaacaatgcatagtttctttctcttttctcattgtgaagttaatgttgaaataatgaaattaagcttgcttattatgttctcttttatgaaaagagttagaactttgttttaactcctcccttccctaatttttaacaatttcttagagctttttcctcttggacaatctgaaaatttggcactatattttattaaagcatgctctcaaaatataggaaaggttttgggtgctttgtggtagcaacaatttttgccaatttagcagtacctgaaacaactcaattacaattaagaaatgaatttaatgatataaagtataatcacattatgcaaagcaattagagaattagaaatttgatattatgacctgatataaaatggttggcatttcattaaatcttcaaaatacaatttcaattgggaataatgtttactctttaagtgcctcaagtctcatgctactgattgtatatgttacattatatatatgtatttttttagctggtaaattaggatccaaaatcttctctaagaaatacataatgacacatgttcaaaataaagcacagatgaagacaatgtaaactagagaaatcaaaaataaatataaacactaaaattatatataattgtaccatataaaatgaactgcgatgaaaaagtttttctctcattctctgagaataaaatcacaaagagaagattccagctaagctttaggaggtgaagaataggaataagaagaactagatcttttatgtgtatcttttatgggcaaagtgcttaatgaacaggcaactctacaatgaaaagcgttatttttttattttatagaagaataaactttagctcagaaagatttaaagacttgtcccaagtcacatacccagtaagtagcagagcaaaataactcaacacaggggtttctaaattattactattattattttgaagtctatggttgttaaactacatcctctgagctctaggatgaaaaggttgaaggttctcagttttgctggagggaatcaaaaacattaacaaaggttttgactttgagacagagagcactaggatcagttctagatttatgtcaaggtagtaattacttgaagatctgattgtatctcatggctgttggaaaaaaaactcaataagcaggaacagcaccaatcttaagagatttcttggtactaaagaaagatctcctgcacacccctttaaaaatgggacagtgggtgaagtagcaatccgttggcaaaaaaaaagatctagcaatgtttctgcatccatttgaagccctgaccctcatatgaaatatttgtaccacacccctgtataaatgggtgaggtttctcaaaaccaaaggtgatcatcctggagatgtgaacgctccaaggatcttcctaccttccccatgagtaagaatctcaacactcccagaaagtcattggcagcccagtttttggggatggtacactctaaagaaatgaaaaccataaatgtaatgtgaatataagaacgggatgtgggagctcatggaaggcactggacttcctgggggtgtgagtaagacccagtcaaaggaagaggagaaaaggaggataaataagtacaaaacaaactccttattcttcagctttgcttgatttaggaaaatggggcatttagggccttgtaaataatttgaaatatcacaatattgagttcagaatggagcttcctaagtaataactattattattgttaacattatacaatgttattatacatttcaatatctgtccattctattatattttaattaccttgtgatgatctgtctccagttaaagcaaacattgtgaattgccctgattaaaaacaaatatttttcttcttttctcaaggaaattctggaccaaaaggccagaaaggggaaaaggggagtggaaacacattaagtaagtatatagtattttgttttctgtgtgaattcttgtaataagtaagtctgtgatactagagatctgggcttgaggcaaatgttcgcaacttcagcacagatccatacagactctatggaagccaaacataattttctacaaataagcatgctaattggggtaaaacaaatagattatattatacaactctttcaatctcattatccatttgtcttttgtttttgtgatgaatactattttctaaaaattccacaaagaaaattgttcaattttcaagtcaatttctatccactaagggaaaatcaagcttatgaatagaaacaattacaacctccttccttactaaatgaaaccttaaatataagaatttggacagtttaagaaccctgaaaaattaactatctgatgtctggggctcttcgtttatttttctaaaaacttgaaatgtggtattccatgttctaaacctttaaacctacaacagaatagatttcacaacaagaatatttgtcaatctactgccgacctcatgttgcaatatacacaacctgttaattggaccttaaatactaaatattagatgagatgtcttctatttgccatgctgtaagtcaattgttgtgtctaggctgaatgtatactgatataatgaaaggattatgaagaggagtgtggaatccccacttaacttctcagaatcagaaggctcctccctccctctgtattcccagtagaaactacatgtgatgtgtgtgtgtgtctgtgtgtccatgggataggtaacacaaacagggtgatcatatttaatcatcaggggtctgttttaggcagataatggcaaatccttttatgtaccaaaatctggcagtttttatttgtaatcattatctagaaatatacagtagcaatttatctgccctacaaaacctaattattttaacctaatattgtgtaggtatgacatatttagacaaagtagggcatggttgtgaataccagccattagagtagtcattagtgtaatcatgatgctttcaaagtacaacagagtattgtgtgtcttcggagtactttagtgttacttaatgagtattactgttatattaaaacaatagaaacattaatctgtctgtcttttctccattctatccattcgttctttaatgtggtcacttttgaatgctgtatacttttttgtttttttgtttgtttgtttgtttgttttgagatggagtctcgctctgtcgccaggatggagtgcagtggcaccatctcggctcactgcaacctccacctcccgggttgaaatgattcttctcccacctcagcctcctgagtagctgggattacaggcacatgccaccacacccagctaatttttgttatttagtagagacggggtttcaccattttgaccaggctggtctcgatcccctgacctcatgatctgcccacctcagcctcccaaagtgctgggattacaggcatgagccaccaagcctggcccacctgctgtgtactttttactcgacttacttctttctttctccttttcactccatttactttcagctgagttcctcttaaaaagttctccttcttatccttatgttatctttatctctgcctttattttatcttttgtttttatctccttttcctgaggctttctctgagcttcttaacattgactttagtcaagttttgcaaataagaaactattttttttttatttttacactgcaaacagcaccccactgtcttccattacctaaggttatcaaatgctttgaacattttcttcagatatgttcagaaatgttttcagttacagtattttcatggctattttggagtttatgcacatgctttctttgaggaaggagtaagagagatgtttgtatacagcctctgcattctccaccatgccctccctcctcatgcagagtatataacaactgcataatgctttaaaaacaaagaatgatatacataaacatctaatgtggtatattctgcttttcgcttatgttaatatgtcagtcatctgtccatatcattatatatgtcactacctcttttctctcaatggctacacattattctattattcagctacaccataatcaccataatatagccattcactcctctagtcctgaacactaaatgatttttgtttgctttggtcagactttaataaacaatgctacattcaacactctcacatgtaatcttgtgggaatactttttaatagggaatttgctagaagtagaatcaatggttcaaaggttacatacattttaccatttgatgaattattgtaaatggctgctaaaagcttgtaccaatttattctgtatgaaagtgcctgattccccacatctgtagttaatggtggtatgtgaaaatttatattgaatgttttcatatgcatctttaaaattttgtaaggctttctgaaaatatgttaaaaataattaatttcctcctttatatatgtgtcaggaccagtacaactcactgatcatattagggcagggccctcttaagatcaggtgggttgggcgggacatcctctgctaccatctcattaaaaggcccttcacctctggacaagtcatctgcacaactgacttccaagatccttttgtgactcctccaaatgactttggttcccgtgttgtacctgacttccacatggccttctctcctggtccctggtgctgtttgggcctctgctcccatgctcatacctcttcttactccaattactccaccatcacctctctcccctatcacccccagcctggacacctctcatgcacggactggagggctgctccaaccagtcctcagttctctgccacccattgacctagagtcttgaacccaatttaatttattgggttctaggggaactgctgtgttctcaccctaacttggaagagtgatgtttcagtcaagcaaagcgattcctaccatacaatataacacttgtgtgaggctctgtcctaaatatctcaattaccaatatgtggtttggtagtatttctcgccatgctttgctcatgcgcaatgagactacaactagggtgtaaattttaagtatcccatctaaaactcatacaatgataggaaaaatccatttgtttttcatttgatttttactgaggaatcagctcaatcttcaatgaatactggtctctttccaaagcatttttgatcaaagtaaagactgagtcaagggctttttttttttctttttcttgttttaagagacagagccttgctctattgcacaggctggactacacgcattcaactagagtctagaacacaatttaatttattgggttctaggagaactgtcatgagtattgataatatgagagttctttatattcaaacattattctcaaccagagatagggatgtcatagaagaaaatccattcattcaatcattaattcattaattcacatgtccattatgtacctccatgagctggacataacagctaataagagataattgtctctggttttacagagctaattgtccctaagagatgtagacaaatgaacaagcaattacaatacatctaagctatactgggggaggaacagggctggataggtatgcagaggagataaaaaaattttaattccttagaatattttttaaaaattgattcttattttaccttctcatcttcttattttccaaattacagcatatatatatatatatatatatatatatatggatatcctgaacagccaaaataaggcccatagccagatggattccacgctgaattctaccataggtacaacgcagagctggtaccattcctactgaaactattccaaaaagttgaaaaggagggattccttcctaactcattctatgaggccagcatcatcttaaacaaaacctggtacagatacaacaccaaggacaaccccagtgatccccgtttaacacacagcttcaggccaatatccttactgaacattaatgcaaaaatcctcaactaagtactggcaacccaatccaaaagcacactaaaaatcttatccaccatgaacgagtaggcttcatccctgggatgcaagtttggttcaacatacagaaattattaaaagtgatccatcacataacagaagtaatgacaaagaccacttgatcnnnnnnnnnnnnnnnnnnnnttttgaagtgtagtcgagcttgggcaatttatccaacccatttaaaccaaaaataaaacttttcatgtattacctggtcatttcaaacaaaaatattttgatcatgaaaaagaataccaatattcttttgttctaaaaatctcttatgggattacatgttatatttttggtttctctctactgatcaacagactacattttcacaactcttctttcctttacgttttaacacacagacccaagattcatactattaagattctagtagaactctagatggtatgcctctgtgtatctcagcatttttattcccactcttgtataatgaacatgttaacacctacctcacagggttgttgtgaggatcaagtaagatattgtgtgtgtgaagatgctctgtgaaatcataaagtcctttaaagatgtaaggtatgcttcgcagtgatctctctgaaccggaatagcttttccccgctggtataatgcagacatttttaatctgtaatcagaataggagtgaaagcaaaatgaaaatgcaagaagctgaataaatgtcatggc

SEQ ID NO: 15130 - DNA, 21831 bp, Human
  misc_feature (1)...(21831): n = A,T,C or G
gtgtcctacagcttttgtatattctgttcttttatttttttttttttttttagtgattgttctctttgcctttcacttttggaaatttctattgagctatcctcaagctcagaggctttttcctcagctgtgtccagtctcctaatgagcctatcaaaggcagtcttcatttctgttgccgtgttttctatctttatgtttctttttggttccttcctagactttccatctgtctgcttacattgtccatctgttcctgtgtgctgtctactttacccactagagctcttggcatcttaatcattgctgttttaaattcctggtctgataattccaacataactgccttgtctggttttaatggttgttttggctcctcaaattctggtatgggttttttttttttttttttttttttttttgccttttagtatgtcttgtaatattttcttgatagccagacatgatgtacagagtataaagacctgccgtaaagatgcctttagtgatgtggttgtaagatgtggggggaggggaagcattctaaaaccttctaaccaggcctcagtctttagtgaaactgtgcattgggctgtgagcttcacaagggtttctcagccgcccacccctcactttcttagatgagacaggatggctcgagggggcggaagttggatatttctcttcccctggcaggttatagtctagctgaacagtttctcctgagggcagctcttgttaaggacagaatgttctggtgtgtttcaaaatgattccattttccatcctcctacctgcagaatgagatttttctgatattcactgtgagaatgtggtagaactcctggggtaaaactcacatacgtgcggtgtccaccatgactgggtccccctgccgtggtgtcccccatgactgggtccccccgccatgatgtccgccacgactgggtccccccgtggtgtcccccatgactgggtgcccccgtggtgtccccatgactgggtccccccgtggtgtcccccaggactgggtccccccatggtgtcccccatgactggatccccccgtggtgtctgccatgactgggtccccggaggagtttggagttgcccacactgagcctccagggatctatcagctacagttcgggtttccccgccctggaacaggctcctgaggtggtttccacggatgcgtctctgctccggcaaaccatggccccgtcattgacaggccagcgcccgtcagcccctcaagtcttgggtgtaccaggtacctacgtcttcaccgctgttttgggtgtgggaagaattgttgattttcagtctgctcagctgacttgttgttagggtggagcagcggctcctgagctcctcacatgaggtaccagaggctggaagtccagtttgggcaatggcaggtgtagactcagaatgttccacgcgcaggggctcccccgaaaggcgttctttccccagggctcctccgagcctggctagtacggtctcgaactgcagtctgaggctggtcctgcccagccacctaccttccctctccttccacaggtgccacaaccacacccccacctggggttccccacctgcccctccttcatctcccttctacccctcgcagggagcccccatcccataaatccacttcctattctgccttggcatctgcaggacaagtcccaggtggccttggaatgaacaagcccctcccttctcacgcgtacttctcgagaatacctgaagaatgtgccaggaatgcaaccacctggtctagggaaggaccggccggacagccctggctctgctcctgtgcctcctagggcaggatgtcccacacactgtagccctatgagtcacccctggctatggaacccagagcagagtgcacctttgggatctctcagctgtggtgtgaagcgggacacacatagacaaggctccattcgttctgggcagctttcccgagcctcggggacccgctcaccatggatcctaagcttctgctgttccctgctgcctgcctgtgagtaataaagttgctttcataactggttgtgtgtgtgttctgtctccctggactcttgcacgtgggttgatgctggttcatggtattgggagttctctagagtcctcccctgaagctgagtccagggcatgctggagtccagggcgtcagtcaggtgtccaggttgagtccagggcatgctgtcttagtccagctgtgttgctgtaaagcatcacctggggctggctcatttgtaaagaaagaggtttctctggcttacggttctgaaggctgtacaggaagtctggcaccagggtctgcttctggtgacagcttcaggagcttccactcgtgggggaggtgaaggggacccatcatgccagggtgggagaagaggggggtgggggccaggctctaacaacctgagctcacaggaggtgagagggagaactcagcccgacaagaggggtaccagggatcacatttcaacatgaggcttggaggggaccaacgtccaaacaaatcaacagtgaacctgcttcccagtgtctgcttcctggggagtgccaactgacaccagccccagggtctgaatctcttggtcctctggagctgtggggtgaatcagtgcttctcacgggggagcttcctgtggcttttttttttttttttttttgagacagagtctcactctgttgcccaggctggagtgcagtggtgtgatctcagctcactgcaacctccgcttcccggttcaagcaactcttgtgcctgagccatcgaagtagctgggattacaggcacccaccaccacacccaaccaattgttgtatttttaatagagacgggatttcaccacattggccaggatggtctcgaactcctgtcctcaggtgatccacccacctcggcctcccaaagtgctgggattacaggcacgcaccaccacacccaaccaatttctgtgtttttagtagagacggggttttaccatgttggccaggctggtctcgatctcctgacctcaggtgatccgcccgcctcagcctcccaaagtgctgggattacaggcgcgcaccaccacacccaaccaatttctgtatttttagtagagatggggtttcaccatgttggccaggctggcctgtggcctttttggtgggcctcccctggccttttaaatcaggcagccatagctctcatctgctggtaatcctcttctgttcaactgtttctttataatttcattcctttctaccagttcagtgattgtttctccagagagttgccattcttttttttttttttttttttttgggggggacggagtcttgctctgttgcccaggctggagtgcagtggcacgatcccagctcactgcaagctctgcctcctgggttcacaccattctcctgccccagcctcccgagcagccaggactacaggcacctgccaccatgcccggctaattttttctattttttagtagagacggggtttcactgtgttaaccaggatggtctcaatctccgaacctcatgatccgcccgccttggcctcccaaagcgctgggattacaggcgtgagccaccgcacccagcccagagagttgccattctaacattcatacccatgacatctacattttaaatattttattgatgatcactatgggataataaaggagaaaataatttttaaaaagactctgcaaaattacattagttctcctaatcatgagatgcttgcttcagagtttcaggatccacccaacatgggaagtcaaagcctctctgggatactacggggctaaggtgcacagtcgctcaggttgtgcacaacacaagggcaccccattcacatgaaaacatcttcattattttgaaaatctgcagagcactgtgtagacacattagggattaccttacatgaggctatactaatttatgatagcaattatttatgtgttgttatggaaaactgggagacaaaaatgaattactgttttgagatcttacgaagcttggaagacagattggccctggggaggcagcggtggccgcagtttgcagggaagattgctgccgaggaggaatctgtgcacacgacaggctccaacgatctgcacagggccacatggggctttggctgaggactaagcttcgcacgcactgcacaaaaccccaagagctgagcaaaagtggccacctgggagccccctgaaagctgcaccaggacaaggcccgtctgaccaggtcaagtgcagagccccgaggaacctgggttggtgatggagacctcagaaagtcccggccactagaaaagaagcatttacatgattgaaaaaaacgtttgcagaaaagaggtgaaatgacagaacgagggaaagactcagcagaatgtagcccagagacatcgcgatggagacatgagctcactttctgtctcctcatcaaccaagaaccccataaacaagggcagaatgctccctgcgtccagcactgagaccgagacccaagatgcaccaagagattgagaaactgagatccacagatgcacaaagacccacagacgcacaaagaccctcagacacacaaagcaaaacgcgttctgatgccccgtgtcagacgcgtcctgaaggatgagcgatggtttctgcccgctgagaagtatccatctggagctgagatttaagcccctccactcaacggcagcaggagtctctccccacgctggtgtgacccacatgcagggcacccacacatgtgaggggcgcccgctgcgaggaggtggtgcctgcgccccctccaagctgcacctcaacctgtcccaccctaaagtgagacggactggatcccccaccggccagggctgcttcgcatcacaccggttccccctgctctctgtgccatcgtcccctccatgtggcttcccaaaccacggacacctggcatctccatcagccttggccctgggcacagtgagtgttttccatgcatttgtgggatttttaaaataaacttctgttgccctcgttagattataggccttgtgagaacagggaccaagtcttttatggatgaggggcgggtgtccggagtttcaacatggcacttccagggctacaaggaggtgaatggatgaagagctcctgttgagtggagacagaggagccctgaggcctctttatgaaaaagcaaaaataagcaccatggagcaggtggtggtcgtgccactggtgggagtgggatcatcctgctaggcaccaaccatccccaaccaacagaggaacacaggctctgcctcctgctccgcatctcctcattacacacagaaacgtcctcggctcgaggacaaaagcccatctgtattctgatctgagcaggactgggtgccgccctcacatctggagggagcctgagactacccgacaggagccacaggtaccacacggtgaggacccccttccagacacccccctgcccagctcctgtggaccctcccccaacctttgccaggggggaccgtggtcctctgtggcgtgtcgtctgcacccgtcttcatcgggggcactagcacctgccacacactcaacagcatcacttcccactggaaaaacaatgccacaagattcttcttggcgagaacaaaccagaaaatgggacctgaagaagccgagagcctcgcctgtggtcagacagcagctgagcatgggcagaggacagagcccaggccgagggccgcggccgcccccacccacaaagacccctgtcctgtcctgggtggaattcccacaccagctcaggaggagccccacctcctcacccttccttgtcctcattccagggaaatggtctggaagagcaccagctccccacggagctgactgtttctctgcttgcaaatttcatgagatttctgattctgagctcgaatcttctctccactttcacctcttgccattcctcatgaccggtccatttcaacatcagggccaattgttccttgtacaattgcatcttttccacagtttagtacaagaaactaggattctcttcatgtaaaagctatttgatgacaaacaccttgttctaagtgactgccaggaagtgcttgctaattttaaattctacattatgatgaggcaaagttagtaggagccaagggacagagcactcccatatctcctcagacactcgccaggtgcatctgtggagaagccgcccagtgagtccttgcatctcacaggtgcttctcacaggtgcgtctcacaggtgcacctcacaggtgcatctcacatgtgcatctcacaggtgcatctcacaggtgcgtctcacagctatgtctcacaggtgtgcctcataggtgcgtctcacgtgtgtctcacgtgtgtctcacaggtgcgtctcaggtgcgtctcacgtgtgtctcacaggtgcatctcacaggtgcatgtcacaggtgtgtctcacaggtgcatgtcacaggtgcgtctcacatgtgtgtctcacaggtgcatctcacgtgtttctcacaggtgcgtctcaggtgcatgtcacaggtgtgtctcacaggtgcatgtcacaggtgcgtctcacatgtgtgtctcacaggtgcgtctcacgtgtgtctcacaggtgcgtctcacaggtgtgtctcaggtgcatgtcacaggtgagcctcacaggtgcgtctcacaggtgcgtctcacaggtgtgtctcacaggtgtgtctcacaggtgcatctcacaggtgcatgtcacaggtgcatctcacaggtaagccttacaggtgcgtctcacagctgtgtctcacaggtgtgtctcacaggtgtgcctcacaggtgtgtctttttgactgtgtcaagtccaacccaatcagggtcccccagcatcatcagtaggtatgtagggaagtgagatggggaaaagatagaaccaatagtgtgccatggagcagttacctctgggcccctgcaggtaagggagctgcggtgttcacacacaactcccatggtcatggctcagggttccccagaggctgtggactccttgccgccctgaacctactcacctacaatcacgacgggctcctggggcaggacaaagccacaggtgaggaacgcggtgctgcgggtggaagctgctgtcacagtcgtgttagggtgagtggactatggccgcagactgtgggctcctcccagccaaccctcactcccgctagcgccccaaatcttcagtccagcaccccttccccgtcccacccactctccacactgagccctcccagccaaccctcactcccgctagcaccacaaatcctcagcccagcaccccttccctgtcccacctgctctccacactgagcccagccactccacgctcccttgggcaggtggcaaggcagagcctgaggtcagctgccatccccagccccaccccagggccctcatgcccccagcaaggcctctccagctctgcggtcccactcaagatgcgcttagctcatttcacacgcaggtgagtgtctcagttctgcgggcacggaggcccctgtgggagggaggttggcaggcccctcgctgacggaggggagcaaggggcaaagtgggggtgtccagaagggggttgtgaggaactgggggacgggaaagagcccggagaggaaaaaggaggtggggaggggctgcgtgtgcatagacctcagggtggggcaaccgaggacctgaaggctggtttccggccgccatcctcacatccaggcgcaatgtgagctcatccctgggagttgggaaatgcacccggcaggctctggaggctgttctgggactgaatgcaagccaggccgaccctccccccggccccaaaccnnnnnnnnnnnnnnnnnnnnnnnnnnnnnnncagccactcttctcccgcctcaaccttggacaccagagtcccagttcccggcagcaaggacctgagttgtggcccctgttaacagcgtgcccccttaggagatgaggacccccagccttgccagccagtatttcagggtcaggaagcaccaggccccaagggtcattgccgccacccacatcccccactcccccgtccccagtgagaattcactatttttaggaaaaaggggaagcctctcagcagatccttgaaaggaagtgactttgtgactaagtggaggcaggaacatcatggcacaagggcacacgtcgcacacccagctgggcccactgtggacggcgcagatgctgcctcagagcagcctccgagacaggcagctgcagcggtgcagcccagggccctcgcagaagcttccccggggcctggcctcgtgctgagagaactctgcgctcctgagggcacctggctgtcatgcacacgtgctcacacgaacacacacacctacacgtgcgcacactcacactccgtgcacacacgtatgtgcacactcatgcacgcgtgcacacacgtctaccagctgagtgcagtaaaagaaccacatgaaaaccttgcatcctggttaaaagtatggtgacaacatggacagataaactggaaaagatgggaagaaaccttaagcccaggatctggcagcacaaaggtgcctggaaagcgacaatcagcgtttttatattcagggaaatcaggaacactgccacccgcccgccaggccggcgcccatgccagacccagccaaggtgcttctggccacatcacccctgctggcctgcagggagctggcccaggagccgagaggcctatgggagcaggcaaggcttgctgaggtgacagcggagaggagaggtcgggctttgttgccaggcagccccccaacattcaggtcctctttccaccgaaagccatgtggcctcagagcggcgtcaccccgaagcttgtcccagccggggcctgacagcaggtaaaggctgactagcaactctgcatccctcagagtgtgggggaaggtggatgtggtcccacctccacatccagggtccccttgctggcctctgggcatttgggtcctggtgtgattacccagccccctctccctgcacaggggtgaactgcatctcctggaggcagggccagtgccccaccacctccccagcacacccgagcccaggtctgggctcccaggagggcctggggccacctgtgggaccaacccaaaccctcaggcagctccaccagcagaaagcgtcatgctgtgtgtgggataacctcctcaggggattagttctcagggcctggtccgctagaagccaaatgcctgtgcccagccacccgtgacgcctgcaacaggcaggagatcccccaacagttactcccagccttcattccacagggtctggttttcctggaaggtgggaagtcccagggtctgaggagagggagcgcaggcccccatttgtaggagtgagtcagctgacccgcccccggggttcctaatctcactaagaaagactttgctgatgacagggtttcctgggagtccatgcgtgcctggagcagcagcgtctccagggacaggcagccaccatgagcctcagtgaggagcaggcccggagctttctggaccagaaccccgattttgcccgccagtactttgggaagaaactgagccctgagaatgtggccgcggcctgcgaggacgggtgcccgccggactgcgacagcctccgggacctctgccaggtggaggagagcacggcgctgctggagctggtgcaggatatgcaggagagcatcaacatggagcgcgtggtcttcaaggtcctgcggcgcctctgcaccctcctgcaggccgaccgctgcagcctcttcatgtaccgccagcgcaacggcgtggccgagctggccaccaggcttttcagcgtgcagccggacagcgtcctggaggactgcctggtgccccccgactccgagatcgtcttcccactggacatcggggtcgtgggccacgtggctcagaccaaaaagatggtgaacgtcgaggacgtggccgaggtgggtctgtgcggagcctcagggaggcggctgtgtgcatctcttgcacctgtcccaggtgtctaagggtcagctcggatcctcaggcctccagggaggcctcttgtcagggcacaggctagttctgtgctgaggagcaagtacctagagccccctcccggcactgtgccctggccgcctgcctctccgactcggcttctggctcaagctgacatcgcatggccactgagttggttagacctgagtctaggagcctcggctgaagcagactcaggctcaaaccggggtgcccctgattctgcatccacatcccatggtggggaccatgtagtccctgtgaggacccctggcttccaggaagactgaccagatgggggcttcagggctctctgggctgggagggaggccctgccttgggatttgggaagaagaggtcacagtcgaaggtggtgcagacgcccacagggagggagagccaggggaaccccaaacttccactgtggcagaagcagctttatcccatgggagcccacgccagccgccaggggagaacaaacctggtagccactgagcacaggggtccagggtgggactggggagggacaagagacagaatcgagacaggctcactggagtcactgaaggagggaagggcagggcctgttcatgcaaagcctgggctagggcagacgcttcccgaggacagaggcggtcctggcgggactggagaacaagaggggtgtgaggtgcctgccagactgggtgagggcagcggccagcagagacctggaaaggccctgaggagctgcccggcaagggggctctgaggaagaaggggaggggggaagccccttctccctgtcctgcacccgtcccagcttcctctccccttttctgtccccacagctaaggaggctgcaagaggcccaggcagcctccgctcttgctggatgagccttgggaattacccaccaggctgccagcccaggggcaggtgtggtccctccttcccaggcagctggggagtggcaatcctggtttgttttcgtttgtgggttttttttttttttgagacagagtcttgctctgtcaccaggctggagtacagtggcatgatgtcagctcactgcaacctccgtctcccacgttcaagcgattctcctgccttggcctcctgagtagctaggactagaggtgcccgccaccacacccggctaatttttgtatttttaatagagacagagtttcgtcatgttggtcaggctgttctcgaactcctgacctcaggtgatcaacctgcctcagatttccaaagtgctgggataacaggcgtgagccaccgcaccaggccggaagtggcaatcctcttatcccaatggcagtaagcaagcagcaaggcagtgacctagattcagtaatccccgggttaccttcatctccacctccctcctaagaagtggggcacccacaaatcaatcgtgcatcaggagcatgagttaccaggaagccaggaaacttcacagcagtggggcctggggtggacaccagctgctcctccctccccccgttccctcctccctcctcccctcactctcctgccaccctcctccctccttttctgccatcctccccctctcccttccttcctcctgcacacaatccccaagacaacttctcatccccaccctgtcccaaatctgggctgtgtctttcttgcccccaggagtttgtcccccgctgccaccaccccttcacccctttgtccccacccggctgatggtgtctcttccctgctctgcgggtccccctcaaactgctgggctgtcctaggtccgtccctcggcctggcctgttccccagggctgttctaggtcctgccacccccacccccagtgccatggccgcacctgccccaggactgacctccgaggcctctcccctgcccagtgtagctggtgccattccaaggggctgggcatggtgtctgtccctccattctgtggagtcttagttatctcagactaagggaacagaaacttgagtctgaattgccaccaaaaaaagcaaatcttcatgaagtgcaaatcctcatgaagtgcaaagcctcatgaagtgcatctcagcaccctaagcactgccaagtggcttctgggttcatgtctcagtttacagaaggggggactgaggcagagcacacctcagtctggcccactgcaccctctttggagggcgtgagccgcaccggccagttcaggagagcagctcgtggctgtggtggaagagtccctcagacggggcgtgggtggccagcacgcaacacccgggccacccggagtctcaccctcctgcccgggccacccggagtctcgccctcctgagccttgtctccctgtttacattggggaactaatgtctgcctctcaagggtgctgcagcggctaaaccagcctgctcctgagcacagcgggccctgagtctgcagggcaggcaggccccgggtaacccgctcctccctgagctgcaagcgtccatcctcctggagctgagggtgccagcccagggtgaaggctgcagtagcctggcctgtgggccctcctgtccccaggggtctgtcccaggagccaccatggagggaggggctgcccagggctcacactctcgggcctacagggagcccaggcggtgccaggccacgtgggaccagcttctgggaggtgcagggcttcagctgatggctccaagtccctgtctgctcccagaaccccacgactacacatgttgtgtgtcacggcagccccttggggagacacagcgaatcccagggcctgcacaaggggggccctgccgggactcaggactgagcacaaccttcctggagcctggcccaggcctgggcatggattgtgaaccctaaaaccttgggctcaggaaccacaggtcccagaaggcggacaccaggcccccctccatccctcccaacatgtcagaagccaatgggccagccgggtgagaggccctgcccagctacccagtgttcatggctcctagacaagcctcttggcaggaaggaagcacaggtcgggtgcagagagggaggagcgagtgggcctgtgaggtggcatggccttccccatcccccgctgtgcaccccgggcagggacgccgcccacacctgaagagggggaagccaccagcccccccatcacccctttgtggctcctcagacctgcaagagttcacagcgagggcagctgggatggacgatcctggtgggctggtggggctcggccacggccaccaagtggcggggcaggactcacaccccagctctgactgtgcagcggtttctgagcccagccccagccgaacagccacggaccccgcagtgctgtgcatgcagcctcagcctccaccaccttccagctcctctccctgggaccgtcatgggaacccatcccaaaggcccgtcccgggaccctggtgggtcccctgccccctgccccaaaacacctcatcacggggtcctgcacgtcgccagcagtcaagacccttcgactcagtcctatggtggtctctacaaggctggacagagcaggggcgttgagaacacgggctgggtgggaatccggagatagagggaggagggtggcaggaccggccgtcagccatgctgagcacagacggcagaggaggtgtggggcttgggcagttggaggtgctttggagaagccacagtgggtgtgaaggccccagagcgaggcccagctgctcggctatgtgagcacacacagcccccaggcctgctagaggcagagcaaatgcagggggttcccaggagcctgagagtccacagctgccacctgctcccagacaaggctcctggcatgtctgaccaggagcctctggggaagtagggaagcccagactggacagtggagaggaagagaccagcaggcaaggaccccccggccaggcatcactacaggggacacagaacccagagggcaccagagaggagagacggggggccagcaggggccacgtgttaatcttcaccgacagacacacgatggtgtggctgcatttcacaatgggtggggcagctggcagtcggacagggaggccgagggatccatccctgtggccgaggggagtttgcagggctgtcatctcaggaagtgaaggctgggctggggtcgggctgctgggccacgaggggcagcgggagggagccgctgaggctggaagctgcaccagccaggctgggaccagggtggctgtggcccggctggtaccgagtgcccatccatgcaagggcagcagagtgaccagacgctggggaaaggagagcaggtgtcagtgagagagtggccggatgtttccgcgtgggactctttgcagtctcgatggcagacttacaaaaaagtaaacattcccctgtggtgttagggaagctgaggagggcagagggcagagtgcaagccagggtttggagcagatgttcctggggagcccctgggctgggccagctgctcgcagaagcctgacaaggtacagggaaggaggaacgaggggcaacctcactcaaaaccagctgctcagaggagcatagcttctggcagaacctccgcggtggccaagccccaattccggctgcctgctctggacctctaaggagctgttcctctcggtcctaagggtgtgggggctggtgagacacaaagaggctgcagtcacaaagcctcagcgtgaaggtctcagtgctgggaccaagggtgtatctggcacaggcctggaaggaccagggagtgaatggggccagtggtgaaggagagaagctgtcggcataaggatggtaacggcagcccacctcagctgggacagctgaaatggagccaggtgcctgctgagaccagtgacgcagccaggaaggcaggggacccaggagcagctgtgaaggagaaaagacggcagacgaacgggctgagagagcattttacagagtcctgagtgcgcttaaatcccaggatggggagagactatgaagaagagaaggtgacaaatagggtgaggttcttgggtggagggtaggccacaagagagaggcaggaaggctctgtggctgttcccatactttctttgtgaaacaagagctgtgaaaacgtgtggggcagagagaagtgacagagtcaggtctgagatccaggaagaaactggtagagacaaagctggcaagagaagtgaggctgaacattgatcaaccatagcctgtgtgactatggggcaccatctgagggtcactttgtgtggatctgtgtggctccatctaagagtcacattgtgtggatcctgtggcactgtctgagggttacattgtgtggatccctgtggcgctgtctgaaggtcatgttatgtggatctgtgtgacaccgtctgagggttacattgtgtggatccttgtggcactgtctgagggttatgttgcgtggatctgtgtggcaccatctgagggtcacattgtatggatttgtgtttgggaccatctaagggtcatgaggatcacgttgcgtggatccatgtggctccatctgagggtcacgttgtgtggatttatgtgtgggaccatcaaagggtcatgagggtcacattgtgtgggtccatgtggcaccatctgagggtcacattgtggggatttgtgtgtgggaccatcaaagggtcatgagggtcatgttgtgtgggtccatgtggcaccatctgagggtcacgttgtgtggatctgtgtgacaccatctgctatctcagggtcacattgcatggattcatgtgtcaccatctgagggtcatcctgtgtggaactgtgtggcaccatctgctatctcagggtcacattgcatggattcatgtggcaccatctgagggtcatgttgtgtggatctgcatggcaccatctgaggtcatcctgtgtggatctgtgtggcaccatctgctatctcagggtcacattgcatggattcatgtggcaccatctgagggtcatgttgtgctctttccagaatcactggtatatgtccaggtgtcatgctgtgatctgtgtggcaccatctgagtgtcacgttatgtgaatccatgtggtatcagctgagagacatgctgtgtggatccgtgtggcactgtctgggggtcacgttgtgtggatttgtgtgtggcaccatctaagggtcatcttgtgtgatgccatctgaggatcacatgtggatccatgaggcaccgtctgaggatcatgttgtgtggatccatgtggtgccgtctgagggttatgagggtcacattgtggggatctgtgtggtgccatctcagggtcacgttgtgtggatctgcgtggcagcatctctggatcacgttttgtggatccatgtggcaccatctctggatcatgttgtgtggatctgcatggtgccgtctgggggtcacatggtggggatctgtgtggtgctgtctcagggtcacgttgtgtggatccgtgtggcaccatctctggatcacctgtggatctgcgtggtgctgtctgggggtcacattgtggggatctgtgtggtgctgtctcagggtcacgttgtgtgggtccgtgtggcaccatctctggatcacgttgtgtggatccatgtggcaccatctctggatcacgttgtgtggatctgcatggtgccgagggtcacattgtgtggatctgtgtggtgccgtctgagggtcatgttgtgctctttccataatcactggtatatgtccaggtgtcatgctgtgaagatcagcaaccagggaaggaccccaggtgagggtgtcagtgaggttggcaagggatgggtaaaaggatgggctccaggtagaaagggagggaaacagtaacagagactctgaattcatcagggagcacacatggtggccactgtagcactgacggctggtggaggagacactgtccaaactgccacaggcacaacaggcaccacgacaagcaggcaggagtgtgctgtgcttggcctcaggggacacaggtgcagagatgagccctcgggggacgcaggtgcagagatgagccctcaggggttgcaggtggtgagatgagccctccctcagggcccatccctgtttcagatccaataaagggatgctggctccactgcccacgctgccacccctgccagggctcactcacccgtcttcctgctccaccatcttttaaatgctggttttccttcaatgccagcccacatggctatgggcagcagctgtatctccaagaatcaggaaatgaggagcaggaagggtgggtgccatttaggagcacgctagcacctcggccagcccccagcaggcttcctctgacctctcaaccttgctgcaggggaagggggtggaggggagttgcgaggagtctgccctctgctgctgcagggccaccgtccctagaaacagcaggagatgtgaggcgcatcccaggagctcccattcagctggcgcagtggctgagggcagagcctgttatttttgccccattgactggtgaggagaaggccacagaaccaccctgtgcccactgcaggtcgcacaggtgggaagtcctgaccccagcagggctgactccggagccgtccacctgggtcactgccccagggcaccctggcctcatgtaaacaaatgtcagaaccaggaagtaagaggagggtctggggtcacatccaactctctgaaggacagaatcccagtcaccggggggtgtctggtctcagtaaccctcgctgtgtctgagctgaggcagagctcagctgacctgttccttgaggggccggaacctaagagccaagagaggaggggctgctctaaatctggtgggagtgagggtaggagtgagggtgggtgggtaccccctgggagccagaggcaggcaaagttctcatcacggtgggccccagaccccagggggcagacccctgggagtgtgtgcctgggaggccagaggggtggaggacagaccccaggagtgaaaggactcccaccccggcctgccagctgcacctgccctggttaaagtgtccgacgaacaagcccccaattagaatgggcccatcccacaccctaccaatggctgtctctcagggaagagtgtaggagtgtcctgcagggggctgaaggcaggagagggtggcgggcaccaggaggcttcagggacaaggcgagcaggcaggctcaacaggcatccaggaagcccgacgtggccggagggcggcaggtgcgtgaggtgccaggcagggcggggccccccatgaggcctgtccaagtctgctggactgagcactggggggcaccagcatcctccgcacaggggtgcatggagccaggctggagccacagggacaggcccagctttcaccgcccggtggccacatcccagtgcccagcagggcccctgggcacctcacacctggagggcagcagcccccacagagcttgacgacaaccccagtggtgcgggctccaggcccacggtgcgacagcctctttagcctctttcctctcttgcggcagtgccctcacttcagctcatttgctgacgagctcactgactacaagacaaagaatatgctggccacacccatcatgaatggcaaagacgtcgtggcggtgatcatggcagtgaacaagctcaacggcccattcttcaccagcgaagacgaagatgtgagtgtggggggcacctgggcagccgcgcgtctgcctccctgcctgcctgcccgcccgcctgttctgtgctgcgcatccacctctttacctgcctgcccgcctgcccgtgtgttctctgctgcgtgtctgcctccttacctgcctgcccgcgtgttctgtgctgcgtgtctgcctccttacctgcctgcccgcgtgttctgtgctgcgcgtccacctccttacctgcctgcccgcctgcccgtgtgttctctgctgcgtgtctgcctccttacctgcctgcccgcgtgttctgtgctgcgtgtctgcctccttacctgcctgcccgcgtgttctgtgctgcgcgtccacctccttacctgcctgcccgcctgcccgcgtgttctgtgctgcgtgtccacctccttacctgcctgcccgcctgcctgcgtgttctgtgctgcgcgtctgcctccctgcctgcctccctgcccgcctgcccgcgtgttctgtgctgtgcgtccacctccttacctgcctgcctgcctgcccgcgtgttctgtgccacgcgtctgcctccctgcctgcctgcccgtgtgttctgtgctgtgcgtccacctccttacctgcctgcctgcctgcccgcgtgttctgtgccacgcgtctgcctccctgcctgcctgcccgcgtgttctgtgctgcgcgtctgctgggctgctgggctccacgtgctcatctgcacatcgctgtgctcctgtgtgtctgtgcacacctgtctgtgtgtaagagagagagatagcttgcgtgcccaccctgtgcacctgagcttgtgtgtgccaatccatgtctgcctgtggggcacagcttcctggcgtgtctgggcaccctcaggcgagcatgtttctcctgcaaaatacccacgggggcacatgtctgaaaactggaattttaattcctcttgttgcaattcctgtttcaggtgttcttgaagtacctgaattttgccacgttgtacctgaagatctatcacctgagctacctccacaactgcgagacgcgccgcggccaggtacccacacgctgagcacagctctgcccacgagggccagggtccctccgcccatctcgctgcctgcacagaggcgggtggtggcaggtggtcttgtgctcacctgggtaggtcctggggtgggcattgctcaggggagaggagggctccatggcttctgtggctgtgctgagctgcaatggccagacccatctgccacctgcctgccatctggccagagtgggtgtgaggcacctgcagagggggaaaggggcacctttcctagaggctgcccccaacctccttgggagaagccagtatgagtgacgagtgagcagggagcagaggggctccctggcaggtccagccctggttgagagagggtgcaggggcaggtccggccctgactgagagagggtgtaggggcaggtccggccctggctgagagagggtacgggggcaggtctggccctggccgagacgctggggagggaggcctgaggaccttaaggagtcaggtgtgccgaggtgcgtgggaaaacgcagggggatgacctccagggcaggtggtcctcccgtctgagaccctggctcaggggagacctggatggatagtgagtgggctgggggagggaggctctatgttggggctgggaagccgtccatgcaatggcctgggggctgagccacaaaggagaactgtgaagacggcggtcacctcctgccttctccgtgtcttgttctgcctgcggatgctgcctggccctggtcacctgctgcgagcctgctgaacgtggcgagaggctgaggtctttatctcagcatctggaggaaggctgggtttaggggcctcctcctggccccagggctgcctcaggggcagtctggaaaggcggtcagggcccctggggcatccagccatccagccagtggacacctgtgagaaaaccccccggagggaagtctcagccccaatccaagcaggcctctcacggccagggccgtgggaaccagggaccagggagagcatctgtgtaatgtatctggaattcttttgcgtgagagatttgtctcttctcctcatttactaatttattcaatcatttatttatgtcagtgtggacttatgagtattgtatgcttaggttataattcaatatgattttatttattttcttgctcacgtgagtccagctttggccactggaagctcttttacttggcttctgtgccctttttacgtgaccccatcactgtggggttttgctttgctttgttttttgtttttttttttatgtttttggtttttgttttgttttgtttttgagacagggtccatctgggctcgctacaacctctgcccccccggttcaaacgatttcctgcctcagcctcccgagtagctgggatcacagacatgtgcctccaggcctggctaatttttgtatttctagtagagacggggtttcaccatgttggccaggctggtctccaacttctgacctcaagtgatctgcccacctcagcctcccagagtgctgggattactggtttgaggcaccgcaccgagcctggcttggttttgaaatggatgcccctgtctcattgtgtatttcctgccctggtcttgccatcagccacttctccagggagcctggttccttctgttggaaagcagtaacaggagccgcggcctgggggccggctgtgcttgttgccggggtcactgcttccaggccctctcgtccggcacagcgagaggcagccgtgctctgccagccctcgctcgtcccctgcgtgtgcgcagagctgcaaatgttcctgcacgtgaccatcgcgctcgagctgacgtctccaaccctggtccacgacagcgcgacacattctggcttcttcctcttgctgctgtgtgaattcccatgcaacagtgggatgcctgggagctgtcctccgcacaggcacttaattgtctgataccagcgcaggggaatagccgcgtcaggactgttcacccacaccccgtggagaacagtgtt

SEQ ID NO: 15131 - DNA, 19253 bp, Human
  misc_feature (1)...(19253): n = A,T,C or G
ctggcagccagagccccttccactgatgaagcctcgacccctagattgagcgccacgacagctgtgcctacgactatctggaggtgcgcgacgggcacagtgagagcagcaccctcatcgggcgctactgtggctatgagaagcctgatgacatcaagagcacgtccagccgcctctggctcaagttcgtctctgacgggtccattaacaaagcgggctttgccgtcaactttttcaaaggtgcctcctctgttactctcccctgccccaaggtgcctcgtgaccttcatcccttcttcactcactcattcaacacggagactccaggaggcatattgataccagtgagaccccagggctgtgcccttaaggagctctgggctagctggggagaagaggtcccccaatgtggattagaggcaggacctgctgtatgattcagggaggaaaaaaggcagttggaggttttttttacctgtgtgaccttgggcaggatattctccctgaacctcagtttctcatctgtaaaatgggcacagtaacagtccctccgccacaggcttcacatgaggattgaaggagaaatgaaagaggggtccttagtcagggaacagcacgtgagagacaccagcccagtccatgtgctctgaaggaaggctctgtggggttccagccatcggggagctgggtgggtcttggggctgagtggacaagtgaggctcacagccagcttcttcccttgaatgcctggagtctgtgacaccctttccttcccaccacagaggtggacgagtgctctcggcccaaccgcgggggctgtgagcagcggtgcctcaacaccctgggcagctacaagtgcagctgtgaccccgggtacgagctggccccagacaagcgccgctgtgagggtgagtgcccccagactgcctctgaccctgttctttccctggcaccagcccacctgcccagaattttttttttttttagacaggcttttgctctgtcacccaggctggaagtacagtggctcaatcttagctcaccatagcctcccattcctgggctcaagcaatcctcccacctcagcctcccaagtagctgggactacaggtgcacatcaccttgcctggctaattttaaaattttttttgtagcaatgaggtcttactttgttgccgaggcttgtctcaaactcctggcctcaagtactcctcctgcctcggcctcccaaagtgctgggatcacaggcttgagtcactgccaagatttcttatgcccttggacagaccccttcttggaaaagctagatggataccccaacactcttttcatagctcatggataagaaacacatgtcacattgcaaccccgagaacacactgtccccccgtaggccgcattctggctttgggtttgttttgttttttcattcttggggtgttttcgggttttttttgtaaatgaccatcttgacttgctaactgatatcaccacccaccagggtgttatgatctacaggttgggaaacccctgttgtgggacagacactgtttccgcctctccacgcatggtcccgagatgctggggacagcactccgaggctaatggctccagctcactaggccgatcctgctgtgcccccgagctgctccctttcctgcacctcccaggaccgcccctccctgaactgctttccctgagccccttattcccgctcactccctcttggaggaccttggcctgttcatttgcagagaagatagaaatggccacacttatgaccccttagctcccccactcctccctacaggcccacccctgaggacacccaggccaccctgcctcctcccgtccgccccagagggaccagacacaggtccctgagccttggggagtccacaggctccccatcttctccttactgcatcccagcccacatctcagcccttccccatggcaggggctccccgcagacgatgccaccttccttgtccccgcagctgcttgtggcggattcctcaccaagctcaacggctccatcaccagcccgggctggcccaaggagtacccccccaacaagaactgcatctggcagctggtggcccccacccagtaccgcatctccctgcagtttgacttctttgagacagagggcaatgatgtaagtgcccaccaggggctgaggtggggcaggaagctgtgaggcgtgggcattcagctcagtgcctgcttcctgtcctctgagagggggcccggcagaaacactctgcaaatatcgaggagagactgctcccagctcacgaagcacaggaggcccagcagggagggccccaaagggggcggggggacatgtagcaagtgggaggaaggacatggagttagggaggcgtgtggagcaagggaaggcttagggctggcttggcgagtacaggaggatccagtgagggggcgtagctaagtcaaggctaaaggatgtgcagaacagagagcttcccgagggcaggagtagtcaagagaggcttcctggaggaggcgggcctggagctgggcttccctgcaggtgtgcaagtacgacttcgtggaggtgcgcagtggactcacagctgactccaagctgcatggcaagttctgtggttctgagaagcccgaggtcatcacctcccagtacaacaacatgcgcgtggagttcaagtccgacaacaccgtgtccaaaaagggcttcaaggcccacttcttctcaggtatccctggactgcccagctcctagccccacctctcctcggagaacagggctccctttctccctgcccctgcacccctgtactccccagccctccctggtgccaggcaggcagagtctgccccctgctccccaccacttcactctcccatcaagccagcccttccagtatccaaatctcattattcctgagccctcaggactgtaatgactggggcctgaggatgggcagaacataagcattcagaaatcagcacccagaagtgaagaaggggatattccaggtgtcaggagctatgcaagccaaggcctgggagagggcaggtcctaggaacaggcagttcaagaacgtgggtggatggaggagagacaggtgtttgccttggactgtgtggagcagagtctctggcagtggtggacttctaatcagaccctgcacacgccaaataggttcacactggggccttcagaaagatgagtcgtggccgggcgcggtggctcacgcctgtaatcccagcactcaggaaggccgaggcaggaggatcacttgagcccaggagttcaagaccagcctagacaacatagcgagaccccatctctataaaaaagtttaaaattagcagggtgtagtcgtgtgtgcctgtagtctcaactacttaggaggctgaggtaggaggattgcttgagcccaggagtttgaggctgtagtgaacgatgatctcgtcactcactccagacgctgtttctaaaaatttttttaaaaaggagaaagatgagtcacctgcttccttcaataccaaagccttggggctcccctgaaccggtgggcgggaactcagatccaattagcacatgctgattgacagctgccccacctaaggcctgggctccagtcccttggcctcatttgagcctttgatggccccatcttcaggtggtctcaatggtgatcagcagcccctggcccagcctctctcagctgatcctccgggtccaggagatctccccttctttgtgaatcactcagcccttcaccctggggtgaggctgtaaggtagctggtggtctccagaggtaacaggacccaggcccatgcagtgaagggcaggagtggagttgagcaggggagacagggaggtcagagtctggctggagcaggcccatggatcctcactcccggcctgcctgctgggccggacaggggataggcaggaaggcaggatgcccacggccgagtccatgctgccttccttctcccctccttcgcccagggtcctgcatcctcaagccccctctgtggctgccctgcacccctgcctgacccccggatgccatgcacctgcccctgcactggctccctgcttggcactgccagccaccctgctctgcttacagtggcccgttgacctcctgcccccaacccccgcttgctgagaccctccccatgccaggccaatttcttccttccctgtgcccacctgggactcctaagaggtgctcaccagagggttgagaggatgtaacacccactcggggcaggctctgccccgggaaaccattacctgcttactctcgtctcttcctgcccttctgttgctccagtcttggagggggcaggggaccgacactcacatctatcaggcctggagttactgctctgcccccatgccctggtcgacactgtgcccgccccaccctcagccctgcacggagacacacacgcccacacgcacacacatgtgcacacacattgccccatcgcacaagaaacctgcagaggacccccactgggggcatcgaggctcagccctcagggcccggggcatctgactctggccccccaggaggggagctatttggacttttgggacacccaccgaggagaccctaagccaagaaggagaagaaagagcctgaagaccttcagtctgacccctgccaccttccggggcatttgggcactgtagggtgagtgccatctccttgcctgggcccatgcccactttcttcaaccccacccccctgcaacctgctccccccagctcccaggtgaggctgcccactcctgccccggacactgaagcagccttcctcaggactcactttcccccactcattcatccagccattcacttacgcgttcactcgcatttggcaggtgtaattttacccctgctgtgtaccaggcactggactaggtttctagggcacaaatgtgaggaaggggtggagcgaaggctttgctcagtccgtaagctgggccccccaaagcttctagcacagtcactggagatgttgtccttagtgaaccccaggatggctcatagggtgcccttcacccccacattttctgcagggctgattcaaaggcagctcatggagggctctcgatcaggccccctctgatgtgttaactgagcaagaaaccttgggaaggacttggggactccacctcttggcctggttcccatggcccctaggggtctaacctacctgatcctgggttggagaagcagggccttctggaagcccatgttccagcgcttgggccccagtcctgatggggatcaggaataggcccccttgcacagacccccacctggccagctcagtgccagcagacatctttctacctcatggttcatctatggaattctgggggtccactggatccctcatcttccctggctatgcctgcttctatgccaggcacaccatcctccaagtgaccacagacagacctgagtgtatgtggctgcggcacacacacccctgtgaccaagtgcacttctgtgcattggggcacagattgtgtgttcatcgtgtgagtgcatgtgtgggtctgtgacacgtggccgttgctcctctgtgagccatctgctgatgagctacatctctgcctttacgcgtgactttgtatccatgtccaggtgtccatgcgcctgtgtgtgcagatgtgtcctgtccctgggtgtgtctgtgcctgtgtgtgcgttgatatctgtgcctgcctcttcacacataggtgggaatgcagagtgtgtattctttgtatgcacctgtacacaggctgggcgggcaagtgaggatgcgtatgtggttggctgtgtctgtatctgcatttgcatggtgtattggagattggagctgtgtgtctgtgcgtgtgtgggtagtgtgtaccgtgtgcacatgtatgtgtgtgcctgtggaccagcacctgtgttgccacatttgggtgacggtacatccatgcactgggtctgcaggtgtatttgcgagtgcgtgtgtctgtctaacacactctgtagatgtcgccgcctgaatgagagccagagcagagctctccccagcccttcccaagtactgttcccctctaccgacgactccccagttctctccttccctgatgcaatgcacgcctagtgggctacgtgtgccaaccctccaggccttctcctgccacaggctctgtctctgtcccgtcgctgtgcctcctgcccctgctaacccagccctccgtgccctggatgcgcccggacatggccaccctgcatgtgtgtccgcctgccctcccgccccaccctgcccctcagatccacctcagaggccctgggtctggttttcactgctgtccctccctggtccctgccctccacccccaccccttggtcccttttctccttctctctctcgtttcagaaaagaggccagctctgcagccccctcggggacgcccccaccagctcaaattccgagtgcagaaaagaaaccggaccccccagtgaggcctgccaggcctcccggaccccttgttactcaggaacctcaccttggacggaatgggatgggggcttcggtgcccaccaaccccccacctccactctgccattccggcccacctccctctggccggacagaactggtgctctcttctccccactgtgcccgtccgcggaccggggacccttccccatgccctaccccctcccattttgatggtgtctgtgacatttcctgttgtgaagtaaaagagggacccctgcgtcctgctcctttctcttgcagtctgcttgtccatgtgtctatttttccacttgtccatctgtccagtaagcaggtaatggtgacccatgctggtccgctcggacccccatcctcctctccccacagctgggccctgctcagctggtcctgctggatgcagtgcccctttggacccccttgtcgcctggcctcccactcccggccacctggcctggccagctctgccagctgttgctctgtcccggtgggagaaagtccagccaggcctccacttcccctggggcatcccaacctcagccctgcacagacccagcgtctgcccttatttgctcccctgcagacaaggacgagtgctccaaggataacggcggctgccagcaggactgcgtcaacacgttcggcagttatgagtgccaatgccgcagtggcttcgtcctccatgacaacaagcacgactgcaaagaaggtacgggctgcatgccaggggcatctgggcttgaaggacctgctgctgggagtggaagcccagaggatcatctccatcagcctccgtttagattctggggcctgtatgatctctaaggccccctcattcccccacccacctggtacatagatcctcctcccgcaatgtcggagccacacgctcacttctgttgcccacattaggagaggaggagctcacggctgctctgaggcttcattttcagacttttctagtttgtgcttcttaaaaccatgtccaagtctctttgtgacttcctaccggcacagaggcgagaaaggatagtgggtaagagcacagcctccagagccaggtggcctggcccagccctgccgcttcactagctgtgtgcctttgagtgactccttgaccctctctgtgccttggtttgctcctgggtaaaatgtagataataataatagtacccacctcagagaggcattgggagcttgaagggccccaagcagggcctggctcaccgcaagcacaatggcatctgttaccactatcagtcacacttataacccctggggatggtcagaacagggccactgccttcctggcagtgaagccctgcacacatttaaaaatagctctaggccgggcacggtggctcatgcctgtaatcccagcactttgggaggccgaggcaggaggatcgcttgagctcaggcattcaagaccagcctgagcaacatagtgagactctgtctctattttacttttaaacaggtttttaaactagaaataaagtaaaataggccagtgcggtggttcacacctgtaatcccagcactttgggaggctgaggtgggcagattgcgtcagcccaggagtttaagaccaacctgggcaacatggcgaaaccccatctctacaataaatacaaaaaattagctggatgtggtggtgcatgcctatagtcccagctaccctggaggctgaggtgggagaatcacctgagtctggggaggctgaggctgcatgagccgagatcacaccactgtactccagcctgggtgacagagtgggaaaaaacaaataaaaatataaataaataaataaagcaaaataaaaacagctctcatggcatcaccagtatcccctaatacctcctgggacttgatacctcacaggcccgctctaagtcagggattccactgtggcccttgcctgctgggtgtgtccaatcccagcagcacaacacagacttgcctctaccattgaacatctgtgtgactttgggtgagtcactcaacctctctgtgtttcagtttcctcatccatgaaacgataaaaaatgataggccaggtgcagtggctcacgcctgtaatcccagtactttgggaggccaaggcgatcggatcacttgaggtcaggaattcaagaccagcctggccagcgtgatgaaaacccgtctctactagaaatacaaaaaattagccaggcgtggtgggacgcacctgtaatcccagctactcaggaggttgaggcaggagaattgcttgaacctggaaggcggaggttgcagtgagccgagatcatgccattgcactccagcctgggcaacacagcaagactccgtttcaaaaaataaaaaataataaaaatgatacctaccttgcagggtactaagctttatagacatggctctgagccattagcaccatgcttggcaagtgactcttcccaccctggttaggttgacaacccaggtttaaacagatgagctgctcacaagcagaaacagaaccgaagccctcaacagtgaaccagtggacagtcgagggcttccaaccctgtgacctcaggcttcccaaatacacagttcctgagtcatggaactagctagaggggaccttatactgatattgtctaaactgcattctgtctctgtactcccctgtgtaaaaagatggtttgataaagaacagaatccacaagatagccaggacaggggtgaagctcctggagaagatggcctgtttacctttccatctgctgattcaccttagaagcatgtgtggtttcttactcaggtgataggttaattacagatctgtaagcatttcctgattcctatggaggacccagcactatgcaaagatctgtaggggattcaagacaggaacccctctgttcccacggagattgcagcctagctggggagagacatgggcgtgcaaggaacacagggggcgtggaaggccagagcgcaaagagggagggcagggggctgtgtgaacccaccgatgggtaatggtgacagctcacggttcaagtgtgggtagacgggagcttcacctgcctctaccagggacttgagagggccctgttttccgggccctcgtgctgtatcttgcccatccttctccccaccagtcatagtgcctggccgcctgtttcccccagtgaaagctgtccaataatgtcatcatgaataatgatcatcagcttgtaaatctgagtcggggcagggcgtggtggctcatgcctgtaatcccagcactttgggaagctgatgggggcagattgcctgagctcaggagctcaagaccagcctgggcaacatggcaacacccgtctccactaaaaatacaaaaaattagccaggcgtggtggcgcaagcctatagtcccaactgcttgggaggctgaggcacaagaatcgcttgaacctgggaggcagaggttgcagtgagccaggatcgcgccacttcactccagcctgggcaacagagcaagaccctgtccccccccaccccgcccgcccccgcaaaaagaaattgagttggggaagccatgcttttcagaggcagaagtcagattgccgtggattgaggagacctgccgtgagagtgtggccatagcgagtgttctcgaaggctagctggaaacaaaaggagagcgatgggctgtagctggaggggcctgggagagctctttcaggatgtgtgaaggttccgaggctgcagagctgagtgagagcgtgaggctggatcatttgtggtgtgagggttcccacgcgtgggcagcaatgagctgcacctcccagaagggcagtccatcctgacggggaggagggacacttgctctgaggcttcagggcagcagggtagcagggtaggtgggtttgcaggtcggagtccagaggttgaagccattcatggtggaaggccctggctttgtcaggaggtaggagagaggtggtctgccactgggagctgacacagtggcttgaggagggggctggatgtttgcagcagttactaaggaggtgagagatggagctggtaaaggccaatccaaagagtatcaagtggtctgggggcccaggtgaggctggagccacaggtggagttttctaagatagtgctgtgcagagccggggatgcagggccacgcagggtgcagaggagcaggctgggtggtcagccctgcagtcagttaagtcaatcgaggaggaaatagtgggagagaatagaaagatcaagaccctggaggtctctctaaaattaagaggccagccaggcacagtggctcatgcctgtgaccctagcactttgggaagctgaggcaggaggatcgcttgaatccaggagtttgacatcagcctgggcaacatagtgagaccccatctctacaacaagcaaaaatgaaaaaaattacccaggtggcatgcctgtagtcccagctacttgggaggctgaggcgggaggatcaattgagcctaggagctcaaggctatggtgagctatgatcgcactactgtactccagcctgggtagcaaagtgaggacccatttttgtttttgttttttaattttaataaagccaaatgaccatgatcaggaaggtgaggtcctgagcaccccgaaggaacaggaggtggccacagaggggtgatgtgtttgtgatgtgaagaaacagtggatgatgacaaagccctcaaggaaccgagaggccgtcttgggtggaccgttatatgtctgttgacttcacctgggagggtagcaggagtgggggtggggagaactgagtcaggtgtcaaagtcccctgtgactgtccaggctgctggagatcagtggatgacagcttcaaggaggggcacaggtcagccgggtgcagtggctcacgcctgtaatcccagcactttggaaggcctaggcaggtggatcacttggggccaggagttcgagaccagcctggccaacatggtgaaactctgtctctactaaaaatacaaaaattagccaggcatagtggctcacgcctgtaatcccagcactttgggaggccaaggtgggtagatctcctgaggtcgggagtttgagactagcctggccaacatggcgaaaccccgtctctactaaaaatacaaaaattagccagagatggtggcgcacgtctgtaatccaagatactgaggaggctaaggcaggagaatcacttaaacctgggaggtggaggttgcagtgagccgagatcacaccactgcactccagcctgggcaacagagcgagactccatctcaaaaaaaaaaaaaagaaagaaagaaaagaaaaatggagaggcacaggtgatatgacccctgtggcccaacacctacaaaggtctgggggttgtccagggagcctgcgatggctgcttcatgagtgctgccatgtgaggcctcactcaaggcttttgtaggaatcgggcagctagattttccccagacgcagtaacctcatgaaaaagaaacgatgcctgcctgccatccagttcataagtgggacaagagatggaagaaaggagggggggcaggagggaagggccttccccacaggaggcatcggagcttggggtccctctctatccccttccgtcactcgcttccctgcagccggctgtgaccacaaggtgacatccaccagtggtaccatcaccagccccaactggcctgacaagtatcccagcaagaaggagtgcacgtgggccatctccagcacccccgggcaccgggtcaagctggtaaggggtcccctccccactccttatgcggtgtggctgcccccggtcagaggcactgcccagagccacacaggctgcaggctgagcccagaggtctgccatccccaggagaccccaagtctggcctggacagaggcccctttcccagtataaattaggggcgtccctgccttcgccctattcctgggccctccttcactgtcatccccagctgtggctgctcccatgggtatctgtgaggcctaggtttggggccctcatccttgccccacctgccttccagccaaatttttaatctgtgctccttcctcatccccctagaccttcatggagatggacatcgagtcccagcctgagtgtgcctacgaccacctagaggtgttcgacgggcgagacgccaaggcccccgtcctcggccgcttctgtgggagcaagaagcccgagcccgtcctggccacaggcagccgcatgttcctgcgcttctactcagataactcggtccagcgaaagggcttccaggcctcccacgccacaggtactgtccccggttgtgggagtgttcactgagcctggtctccaagactggggtagagtcgggggtttcaatgcgggtatgaaggtacagagggactgagccctgcgacccagggccagggttgtgggtgatgcaaacattgtgtcctgagaaccaggcctggggggcagggataggagggtgtggttaggggttaggatggcagtgatgacgatggacaggagaggtgagggaactcagggacagagaggaaagcccccagaggtccccctgagcgtacgcgggccaccgcagcagcccagccacacaccaaccctgaaatatactctattcattctctgatatttattttttttttttatttttatttattttttattttttgagatggagtcttgctctgtcgcccaggctggagtgcagtggttcgatcttggttcactgcaacctccacttcctgggttcaagcgattcccctgcctcagcctcccgtgtagctgggattacaggagcctgccaccatgcccagctaatttttgtatttttagtagagacagggtttcgccatgttggccaggccagtctcaaactcctgacctcaggtgatccgcccgccttggcctcccaaagtgctgagattacaggcgtgagccaccgtgcccagcccattctcctgatacttattgacatgtaacatggatgaggcggcatcctaaatgcaggtcccagaaacagaccaagcaaagatcccagcccttgaggggcttgctcggctttcacttgcttgtttatttagcagccatgaactgagctccgctctgcgagaggactaaggggcacgtggcctgaatcaggcatgagcccttcactcctgccccccaccccatactaggaactcgcagtccaggagagagacaaggcaggcaccgcccgtgacagcatgagcccaagcgggagccaggcaggaagaaaggcaccccggcctaactgggcatgtgttggtagaggcattcgaggcagggggaggtgcccaggcagagacacaaccccagcccagcccagagtgtgcccaggtgacagcaggtcatttactttggccgaagcaatgggtgtgtgaggacagcaggttgtgggaatgatgtggctgcagagaaaggctggagtccagggggatgccttgagtgccagaccaaggatgccacgagggagcttttgcagtctcctcctgggtcctaagccacctgtcagggcatccccagagctgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacagggtcacaaaccggaggcccggaactccatctggccctcagacctgctatgtttggcccacactgtgttttttttaaaaatgtgagccaacacttaaaagttaggagttttcacataaaacccagatgtacggcttctctcttgaaaatggaagctgtggcgacactgggcccacattcttccatgacagccatcagctggagaaaatgagcaatgccctctttagacaaagtgtgtggtgcctcgtgccaccgctccatgctgtcttcctctcggtgagcctcactgcctgttcccctcagcctagggccaaggtccctctatttagagatggggcagcacagcaatgttctgggccaggcccccacccacccatcactggcctcgtggccttcatccaggcctccatcctgccgtgagggcacgccatggcatagtgtgccatggggcctggcacctgcggtgctcagggctggttggcccctcttgtcccctacagagtgcgggggccaggtacgggcagacgtgaagaccaaggacctttactcccacgcccagtttggcgacaacaactaccctgggggtgtggactgtgagtgggtcattgtggccgaggaaggctacggcgtggagctcgtgttccagacctttgaggtggaggaggagaccgactgcggctatgactacatggagctcttcgacggctacgacagcacagcccccaggctggggcgctactgtggctcaggggtgaggcccccacccctcgccctcctggccccatgccccacgccccacactgtcctccacccttctcagcccagtctccaagacctagcgcccacacaggccccggaagttgagtgcagcacgcgtgtggccctgtgtgggagcccagaagcccagccttgttggggctactcagagacactgccccatccccgacgtaggaaaccaagtcctttctgggcaacctagaagttcctgcggcctctgacccaggcctgcctcagaaccagttggccacggcctggagcggatggagcttcctctgtccctcctttccttacccctcccccaaggcagcccaccagggcctggaatggggggcagaggttggcaccagagccggggacagggcgcctgagcggagtggccctcaccagtccttttgccggaggcataaacactcttgtcatttcctctaccagtttctcctcctgatgaaaggccagcttgtcccaaagctcttgctgctgctgtcccagtggcccctgggcactgcttcttggtccataaaatggcacgttaagagtcaatgagcaaaagtaggcttgatgggcttttccctaaggacatgggctagcctcgtggggaggatttattttcctccctgtaagagcttgcagctgcctcttcttctttttttttttttttttttgtcctttcctgagggcttcaaagagacagactgtcttcctacccatctctctctctttccctctctctctctctctctcacacacatacacacacactggcacacccacttgcatgcactttcaaatacactggccctcctgtcacctccctgtccccttgcctatctcatggctgtatcccaggcagcctgggtgccccaggaagggttaaagctcctggaagctgcagcagctgctggacccagcattggctgaacctcccccaggagcagagcttcagccctcgtgtggctggcaggggctgggacaaggtggagcctgaagcagcttggctgccctggtgtcccctggctgccaggctagtgtcccctcccctctttgctctttcttctgaatcacacaccaaatcggatgtccccaggtgtcttcttccagagacctcccccaggctgagttgaccggaaggaacttggggaaggatcagggcctcctggcacaactactcggaatgtcctcaaggttctcagaaatgatttcttctgtgcctggaaggccagggcgttgacgtccgatgctctgagggctgacctcactcagtaggcttgcaggaggcacctaagaagggctcgggagcagaccttggccaggtgccagaggagaggcggggcaaggggtagggatggcagagtccaggcctggggggcactgtgcttctctccaaaacttcctccacactccagcagagaagtggctgtgccgtcttccctaagagtccactgggacagcaggaagtgatgccattcaaagaactccctccctttgcaaaatactttgacatcggtgcagtcctttgtttttccccagcacccctcctaggcatggagagcagagaccttttgctcctgtttgtggctgagggaagtgaggcccagagatgggaggtggcttgcctgagactacacaactcatttagtagttatagcagagctgggtttacgggaacttagttctcttcggcccacgcctcctcccctccccaggttcctcattaaaccagcaagaagccctatgcttcaaggggcggggagaatctggtggctgcctgggagcctcctgcccttcaaagctggggatcttggggaggcaggacagcagccccagcccctcttcctccaccttaccccatctcttttctctgccagcctcctgaggaggtgtactcggcgggagattctgtcctggtgaagttccactcggatgacaccatcaccaaaaaaggtttccacctgcgatacaccagcaccaagttccaggacacactccacagcaggaagtgaccactgcctgagcaggggcggggactggagcctgctgcccttggtcgcctagactggatagtgggggtgggcggaaggcaacgcaccatccctctcccccaggccccaggacctgcagggccaatggcctggtgagactgtccacaggaggtgggggaactggactccggcataagccacttccccacaaacccccaccagcaaggggctggggccagggagcagagcttccacaagacatttcgaagtcatcattcctctcttagggggccctgcctggtggcaagagggaatgtcagcaggaccccatcgccatccctgtgtctctacacgctgtattgtgtatcaccgggggcattattttcattgtaatgttcatttcccacccctgctccagcctcgatttggttttattttgagcccccattccaccaccccagtttcctggggcacaagtgtctgtgcatgtcccccaggagccaccgtggggagccgatggggaggggatggagaaacaagacagggcttctctcaggcccagtggccggtcagccacaccagggcaccgcagccaataaaccgaaagtgttacagccaatatcctgtgccagatgctgtctgggccatgggggcggggccatcatgttccagatgtatgggcttgctgtggaggctggcacgtagccagggcacctggcatcacgggctgcccttccctcccctgatcccaggctgccaagggtgtaatttcacactcaggcacagatactcgcaggcacccatcacagcgcgcacacacaccacacgcactgctcgcggtcctcccacatgaggggaggggtggaacattccataaagtggctgtttggtggggagggaagaaggatgtgaaaggggtcaggggtgtctgtccgtctgggttttctgtctctgcatctagggaaggagtaggtgggctgcaagggtgtccacctaggtgagcacacgggggccagaaaacccacatcggctgggacaggtccagttggcccctggtgcctgtcttcctgccggtcagatgctgagtgctggtccccatggatccccctgtcttcgtggagacaagagccagaactcagcggccactgagcaaacatcccagctctggccccacttcccaggtgacccaaatctatgtcttgtctggcctccttcttcctgccatcgcacaccccgcttccccatcccagacctgtacctcccagaggccaggaggagaaaccacatctcagttccctctctcccctctctctacatggatctcaaaaggaaagaaagcccagggcagccccggctcttacgcccgggctgggcgctcccagggtccggggagagctgggcggcctgctctctggacccgcaggggcccccacccccaggaagcagcctggcatgggggactccatcttggccctctaagcagaaggtatcagtggaaagcaggcacactgcgagtgttggatgtgtacgcagggccctcttcttccaggaagcccacctgctctactgctcaggctgtagctgtctcctcgaggcctgaccaccagtgtggccccagggccctgagagagagctagaggtgcccagaggggttactgcttgttgcaccagtagagtcacaggctgtgatgtcacagccactcctccctgctgctgcttcctctgaaagggaggcttaggacagcctggagggccatgacagaatggaaaaacctctacactggtggagctgcctgggcatctcacccagacactgcccacccacttggcatgagctctgccacggagttggtggtcagtggccatagatctccttaccagccctctgggtccttcggaagctcaaaggaccacagtcccagctcacaggccagggtcataaccctgtccaggcaggggcttcagcccacagagatacattgggtcccccaccccaaacagggtccttatggacagcaaccc

SEQ ID NO: 15132 - DNA, 78491 bp, Human
  misc_feature (1)...(78491): n = A,T,C or G
agacgtgtttaggggtggggaatggggacgggaaggactgtcggaagcgagttgcgctcgctctagccgctcgtgtactttccgggagttaagatccgaggctgcaggcgcttgactttccgaagacctggagactgatgacaatcccgactggaaagacaatgagtgactgtcactcattcttttacctgcgaagcttagtcaattaggacgttcgttcccagcttgttaaactcaggatgtagcttctcatttagtttagacttaatatctgtataatgagcttacttggagtaatgatactctgatttctatcctcttgagaccctcaccaaattgaagcatgattctcccagggggcttctttttaggcagctgatttaaaaacaaatcttggctcaggtttgaatgtttgcttcactcttttctttcctatcagagttaatagtaatatctctttcctagtgtgtattagttttccgtttgattttaatgtcactaccaagaatagttgctgtgggagccatttgtctagcattgtttatattgtaatgcaaatgatctccagaatgagagcagaagttctaaaaaacacttcagttaaacttatttttggaggcaaaagagttagattcagaattcagtactttagtgattaaacaagattgcatctaccagattcttttatagggatactgactttgattcagagagacagtacatttctgtttatgttttattaatgttcgtttcaggacagcaatcttgaatttatatctttattatttgggcttctctttagtcctacaagtagccagtgtatttctttttctgtaccgtccgtttgatatgtagtatgtgcgttgaccccagtgattctgggccttcctcatttctagttttcctgtctgaattacttacacgcagtttgacagttgtgactctcttcagcatatgaatagaaacatcttagtttgggttaggagaagctatcagcatgtaattcttaaaatttgaatgaaagtggattattgttaaattcagtaagcacttttactctaggctattttcaatagtatttttgtttccattaggagagattaaggtaatactgtacttaaattataaactgggtgtgcatattgtattcattcttttcatgtaagaactaaaattttctcagtcgttttctgccttattgactgtttttgtctactctgaatgtctagaattttgaaagatgaaagattcacttttactttcattgcaggattctttctactaatccagatacttgttgaagtgctgactagtttcttggggaaagatgtcaaggaagagttgaaattcctagactggtgagcagagattgcggagtacagaatagccatcacccactctggttagtggtagcttaaaggtcattcttagaacatgtcatcgtgtttcctcattgtatcctaattactcatcttttttttttcttttctttttttttcttttttatcccaatggtttacatacatgattgttttggaatattaatagataagtttggaaattcttaagggtgcctagtaaacacttgctgtttgattgctttatgatgaggatgcttattttcattcgaaataggtcttggtagaaaactgaccttattttcattgcttttcaggcataagatgcacatttttctgctctggagccgggaatgaaatattcttgagttcttacaactttatgacgagacccatgtgtggtgctattgagaaattcattgggaagttggaagacatttcaaacaacaggttgttttggtttctatagtacaattggggtggcattctgttttgtgaaaggaggaaggacttaggccagaaaactcatatgctatggttaactggttcccagcctccgagaatcttgttttccatggtgtaaaacttactcagcatcaggataagggataacgactctatggatatacagaatccttcaccatggtaaaactcgcaaacccgctttatactgagtggattttggaggccatcaaaaaagtgaaaaagcagaaacagcgtccttcagaagaaaggatatgcaatgctgtgtcttcatcccatggcttggatcgtaaaactgttttagaacaattggagttgagtgttaaagatggaacaattttaaaagtctcaaataaaggactcaattcctataaagatcctgataatcctgggcgaatagcacttcctaagcctcggaaccatggaaaattggataataaacaaaatgtggattggaataaactgataaagcgggcagttgagggcttggcagagtctggtggctcaactttgaaaagcattgaacgttttttgaaaggtcagaaggatgtgtctgcattattcggaggcagtgctgcctctggctttcaccagcagttacgattggctatcaaacgtgccattggccacggcagactccttaaagatggacctctttatcggctcaacactaaagcaaccaacgtggatgggaaagagagttgtgagtctctttcctgtttacctccagtgtcccttcttccacatgaaaaggataaggtaagaatggcatatgcttcggggtttatagagctgatgatataggatgctacaaattcacatttctgggaagttatattcaagttttttgtttggggacttctgtggagtgatcacctctggttttttattggtgagttgtagctatgagagcttcatagatttgttctggtactttgaaatatttgaagcctaagattaaaaatgtagaatgttaatctgactaaaagaacttatttacattacaatgaaaaagtgacatatgagtttaaaacttttttttaaatttttttttattattttgcttgaggagtactccagcgtgagactttaaaactttaactaaaggttcttagaacaccttactactggaagttgatgagcagccaaatcatggagacttgaatttgaaacaagcagatgactctgagaacatttttctgttttccattttgttgcagattactcgttagacagaaatgagacagattctcatgacccataggcgcaactaagcaaacttagcaattcttgtttctgctgtttgtattatagctttctgtcatgtattatggctttgcatatgatgaagtcctaaatgctatttatgacagctgtagttgcatgggacaggaatacagtatcctaaactagaaaagttctggagggtctggaacagtagttcatgcctgtaatcccagcgctttgggaggctgggacaggaggatgtcttgagcctaggagtttgagcccagcctgagcaatatagcgagaccccacgtccaccaaaaatagaaaaattagccaggtatgggcgcgcctgtagtcctagctacttgggaggctgtgtcggggaggattgcttgagtacaggtgtctgaggctccagtgagctatgctgtcaccactgcactccagcctggacaactgagaccctgttctaaaaacaaaaagaaaggtaaagttctggagagttgggagttttgatgcccagatgtgtactttactctgttgtgttttaggatgttattgtatatagttgaaattatgacttcttaaacagtaaattttggtgcttaaatagatatttggagattaggagaattttgttagtacctgttttttacattgacctagtatcttagctgtaaatttacttaaggtgctctgaattatagttccttggagagcagtgatgctttaagttgctgcacaccttggtagacataagtaaaatgatcttcattttgcttaagatgatggaggatactcctagggtggaaagatggtaaagttaacattgaatgtattttgaaaattggagatttgatctcaatttgttgtattattagcagcccactgaatacctgtagatttttctttaacaattgaaaattaacggtatttttctttgatgaaatttttagagatctatttcagggttcaattttccctgtgaacattgaaataaaacataatcttactgttattacccttgaaatgattctcatacagtcatgaattgatagagaatctcattcataaaatggctctatgtaatttgagcatttattaaaagtatatattaaaaattcagggtagacaagtaattaaaatgctttattctatatttaagtgctgtaagaactcttacctgtagaaactttatcacatgtggctgaatttaaatacagttatcggatttctacaattattaaatgatctaacaggttaactgcctggaaacaggaaataatttatagttagatcagttcagtgccatacctgtgaattggatgttataagttcctgttaggccacctgtttgcttttatttatttatttttgagacagaatctcgttctgtcacnnnnnnnnnnnnnnnnnnnnatgcaacctccgcctcccaggttcaagcgattctcttgcctcagcctcccaagtagctgggattacagacatgcaccaccacgcccggctaatttttgtatttttagtagagacggggtttcaccttgttggccaggctggtctcgaactcctgacctcgagtgatccacccgcctctgcctcccaaagtgttgggattacaggcttgagccaccgtgcctggcctgttgtttgcttttattgtaattacacttgcttgaattatcaatagataattttaaaaaatattagctatataaaaatgtcatttgagcatatttttaaaaggtagtaaatatagtacagtgcaagacaaatccaagtcctagaaccctgagattttacttttggaagggaccctgagaaccgtctaatccaagtccttattttgcagctgagctaaggacctttgttgagaccatttcatagcacctttgcattaagaaaagtttaattcagtagagatgtgctgttttgctttgactggagtgcagtggtgtgatctcagctcactgcaaccttcgcctcccgggttcaagcgattcttctgcctcaacctcctgagtagctgggattataggtttgcgccaccacgtgtggctacttttttttttttttttttgtatttttagtagagacagggtttcaccatgttggctaggctggtctcaactcctgacctcaagcgacctgcccacctcggtctctcaaagtgccaagattataggaatgatccaccgcacctggccacatttgattttggagaaataaagcaagaaaaacaaaagtgatttaataattgaaaaaatgaaaaagaaatgcccatttgcttacatagctttcatatatagtgtttttttgttttttttttttttttgagatggaatttcgctcttgttgcccaggctggagtgcagtggcacgatcttggcttactgcagcctccgctgcccaggttcaagcaattcttccttctcagcctcccatgtagctgggattacaggcatgctgaccaccatgcctggctaattttgtatttttagtagagacggggtttctccctgttggtcaggctcatctcgaactcccaacctcaggtgatccgcccaccttggcctcccaaagtgctggcattacaggcatgagccaccctgcctatagtgttaactgaagtaactaaatttagacatgttggaaaatagagtttgtttcttcaggtagacttgtatatgtactaatctcattggaaaactaatttcatgatagtatctattcaattagagttggtgagctctgttctatatttttaaatggagtcttattttcagtagtgaatttcctgtgtgacttcccccaaagatatgaaaagtttacattaaaaatcgtaatacagtgaactctaggatgagagattattcctttgaacagattatgtctgctccttttattgtattttaactattttctttcctctccttcgaactacgcagtcagttgctatgcagaattgatagtttgctgttacgaacctagatgttctcaaaaaaagaaaagaattatccagagtttatttgacagtgatggagaaaggaaggtgtataggtcaggagtagtttcacttttaggaattaattggttcagcatatagtcattgagcacctactgtgggccaggcactctgcttggaacagaaacagttctgtcttctctgggatgctaatgcaggtatttctattgacctggccaactgtaaggtgaagatgaaattcaaagactgcgtggagtaacccgagcaagttcctctttactttttctggtatcaattctaactttttgtttttttttggtgatattaacctttggaaggaactgtatgttagattttcggcagctgagtggttttgatccttttgggagatcaactgtgttggaatacgtttaagaggagtttttgtgaagacattggaactttagtgtgttcttttcacattgataagtactgaggagaatccatgggatactgtgattaaaagtttttaggccaggcctggtggctcaggcctgtaatcccagcactttgggatgccgaggggggggtggatcacctgaggtcaggagttcaggaccagcctggccaatatggtgaaaccccatctctacagaatacaaaaatcagcccggcatgatggtgggtgcctgtaatcccagctactcggtaggctgaggcaggataatcgcttgaacccaggaggcggaggttgtagcgagcctagattgtgccactgcactccagcctgggcaacagagcaagactccatctcaaaaaaaaaaaaaaaaaaaagtttttacccatgttataagggaaatttttgagctaactttagagtgtggtagttaatggtgagtttatttattaaagtgtttatttactatgtgccaggcgttattttaatgctgtatatatattaactcatttaatcctctaacataactagctactgttaggttagttagttattaataacataacagtaccagcagtgaaatagctactgttattttacaggtgaagaaactgaggcataaaagagatttcagtaacttgctgaagtcacacaaatattaggtggcagagctgggatttgaatttgggcagtctggctccagagtctttgtaatagccatactgaccacctcttaggagcagtaatgtatgatggctatcactgcactcaagtacagaatcgtgaatgtccttggtgttaacttcatagcacatttcctaattgttaaaggacaaattcccgcccgtcttcattgtgtccatttttctttttttgcagaacagatttgaaaattcactttggaccagtgataagaatgtgttaggaaccaaagattaggagtaatctagttttgtatatctgaggtccattaaaaaaaagtttcacctacatgccatttttttcccttaaagataatttctgtgctaactaattttcatttcagttgtcactaacattttctgataggcaaggtagggatcagttgtattgctataccagagtgctttaatttgggacagaaatactgttttccttgaatcatgggattataggtgaggagaagagtgtgtaactggcttaaatagcatcttcctctttgtaaatttctttttgaaatatagatattactgtaaggtaatttgttccatttacttcagttattcattatttatttagcaaacatttgaatgcctgccatgaacagtggatttaagatttaggtcctgtgaggggattaaagcagacagaatagagatacaaaataaattttttgaaagccttttttagtttatgaactgtaatttttttacattattattttttcataacaattaagtatcatgactcagaaataataatatgtttagtgggcaaggcaattatttgagactgtgatggtccatttaaaaaattatctttatatagtgagtcttggaaagattcaatttcctttcaagaatagttttcaccttgatttcaaacttctgagttcatttttacacactgacataatttacttgaatatatatagtttgtgttctgtattactagcccagaaaaatattctctttcatggtaatcagccagatcattaaaagtattgttatttggtggcatagtattttggaacagaattataatttgctaaagcgttcagttggacagggaagagtaggtattgtcaactaatgttattgttcaggttactcccagctgggtaacctggagcagaaagatccaatgataaatctcttgccttctactctaagttacatctcaatttggtcaactcttagtagagtccaaattattttgttttattggaatttatattttaaattatagaggaagtagagctttgacaggaatttagaatttaaattttcgatgtagagatactgattaaaatggggattttttttttttttttgagagatggagtcttgctttgttgcccaggctggagtgcagtggtgcaacctccacctcctgggttcaagcgattctcctgcctcagcctcccgagtaagctgggattataggcgcatgccaccatgcccggctaatttttatatttttagtagagatggggtttcaccaggttggccaggctggtctcgaactcctgacctcatgatccgcctgcctcggcctcccagagtgctgggattataggcgtgagccaccgtgcccggccagggatatgtttttaagttactgaaagttaagagtgatgaagttttgatttagctatttggaaatgacctttatagtagaatagttgcacattttatatgttagaatggtggtattttataagaaaattgttaaccaatataagcttggaaatttcaatttcaattactctgttgcgttgatactgtataaaaaggcaataaatagttgtccatgctattaaattcagggctatgtggactgcttgacagaatgattgttcactttggaaaaacaaaaaaaacaaaaaatcttctgaaggcaaaagataaaatattgaggatacagtgacgtggaaaatgtagctattatcaagtgtgaaatggattgatctcagtaattgttatatttaataatttaaacattttttatgacatgcatttcttttcttttttttttttgagatggagtcttgctctgttgcttaggctggagtgcggtggcccagtttcagctcactgcaacctccgccttccaggttgaagcaattctactgcctctcccctcctgctgtctgcgattacaggcgtgtgccaccatacctacctaatttttgtatttttaatagaaatggggtttcaccatgttggccagttgtgttctcgaactcctgacctcaggtgatccgcccacctccgcctcccaaagtgctaggattacaggcgtcagccaccatgcccggcccatgccgtacatttctgacatcattgtttataccatttgtttgtgactccaaatgtaccaggagcagtggcctagaaataaaaatttgttactaacaagtcattgaggtggattaattgtaaatctggttaggaattaattttgtcttagcagatttattcttcaaaaattcagaaatttaaaaataactcagagatatgtttgtaaaatagtatctgtttaagtacaatcagctgcacagtttttttttttttttttttttgagacggaatctcactcttgcccagactggagtgcagtggcgcaaccttggctcactgcaacctctgcctcccaggttcaagtgattctcctgcctcagtctcccaaatagctgggattacaggcatgcgccaccatgcctggctaatttttgtatttttagtaaagatggggcttcactgtgttggccagacgaatctcaaactcctgattggcttcccaaagtgctgggattataggtgtgagccactgtacctggccaactgtgcagatttttttgatcttctggttcacctatgagcacaatgatttttggtaattttcagtgcatgacatacctcgaaataaagctactgagctactaaagcttgggttagccattactaatccaaagttctataccaaaccaatttttcttttctttctttctttcttttttttttttttttttttttttttgagacagagtcttgctcttgtcacttaggctggagtgcaatggtgcgatctcggctcactgcagcctccgcctcctgggttcaggcgattctcctgcctcagcctcccgagtagctgggtttacatgcacccgccaccacgcctggctaattttttgtatttttagtagagacagggttttgccacgttggccaggctggtctcgaactcctgacctcaggtgatccacccgccttggcctcccaaagtgctgggattacaggtgtgagccaccatgcccagccaccaatttttcttatgcttacaacctagacatttttctagcgaataagtactttactctttcttggtctaccttccaattggtgaaataaagggaaggaattaatgaagacatcgggtaccacaaatggcttcaggaatagaaatccagaggttctaatggtcttaacctcgttttttctttgctctgtatcaataggctaagggaacgtaaagagttgcttatagaaacctattaatagctaacatttgttaagggctgatgatgtgttagggacttttttttttaagtgttttaacatgtactttcttattgaagtctcaaaagaattctatatgattaaattttataggcataatatatttatataataggtatttaatagtatttaatcatacaaattttcggcagggcgcggtggctcacgcctataatcccagcactttgggaagccgaggcaggcggatctcgaggtcaggagatcgagaccatcctggctaacgtggtgaaagcccgtctccactaaaaaatacaaaagaaaaaaaaaaaatattagccaggcattgtggcgggcgcctgtagtcccagctacttgggaggctaaggcaggagaatggcgtgaacccgggaggtggagcttgcagtgagccgagattgcgctactgcactccagcctgggtgacagagtgagactccgtctcaaaaaaaaacaaaaattaataataataatacaagttttcattatgtcttatagaaaaccaaatggaaaatgaatataaggaaatgcaaaatacattaaatttctttttacccttgctgcctgttttttctttagttcatcctggacttgtgggccaatacttttttgttatgtttaatactaggagagcaaatacataacaggaactgtgatgaatctggaaagaaaatttatatcattcagtcttcctgaagctgtaagaatctccttaacatctattagatttattttctctttgcatttaaagttttggagaaaatatctttgtcatactgacttggttcttagctatgtaagaggactaaatctaggtgcggagtttgctggtttaaatagaattaaaaatttatttttttctggtgacctggagagtgtttcttaaaattataataatgaatacttttcatgctctgatttatgtataggaattattaagagcttcactctgataaagttatttaccacttggctactcaggggtggagtcatttcacaaaggatctgcagcgaatgaattagaccaggagtaacttcacccttctgcttgtcccagctggagcaggattaggactcattcagctgcagctggttcccaggaaaatgaaagcagttccttctggttttttcctttcatatgaaagtcatagttcccagcagatggctttcatcagccctgtacatgtatctgtaaattcaaggccaaggaattattttcaacttcattagggaacaggtgaagaaaccatttgtagtgtggcactattttattaggagttgaaattaagcatagagattatagtagtatgccattctgggtcaaaatagtttttaactgtcagcaatttaaagaaaaaaaaagactgctaaggaaaagtaagtctggctgtagtgttgattgaggtatcttttatggttgaattgtattatgcttacgaaacatagattattagaaaaaaagacttgtatcttctgcattgtgtagaatgttcagccagtagcaatcttggatcacagtgattctaatctgatttcacaaataatagggaaatttgagagccaaagaggttgaagtgtcttgtccagtgccacacagccagttaataccatctggaagaattggtcaggcccttctcaattttgtgcttttttcattatgctgtagtactgctttatagtattagagagcagtgagcctaaaataatttagttagaattctcttccttaatggaaaccatagaataaaccttgtctagagaatattggtggtatcgtaaaccacaaatatataaatctgctatttcagtgtgtgaaaatagctatacactcttgttagagttttgaaacaactttttgggaaaagactgctttcttatggcccaagttagaggaatcaaggttttcttatgttgttggctaaatattagaaggggaacatgttgagctaccttaatgctggaagaaaaagtactccttgagttttgggaaaaaaagtccatttaaaggtaagtctaattttcagtaggtctgcaacacaaatgacctctgagtgacttggatcattggttagaatttaaaattcttgagactgagctagagatagcaaggtacaaacctttctattaattaatgaagtaatttttaccaaagacattaaatatgggtggaccaaaagtgtatagtctagcacttctataaacatagtgtctgggaggagcttgagagatttgtaatgttacttgtaaacagaccgtgtggggaagaccgcagacagcacatcattttttgtctttattggtctttatgactaacacttcatctctgcatcacttctgctttgctgtaaaacttagcaagtacattaggatagtggcaaataaagattaagattgaggacagatgtttgtaaaataactgggcgattttaagattataggtgtaacttgttaagaagaagataactggtgtggaaataaaatctggcagccaaaaaaaaaaaaaaagctttcaatgtgttaaagaagatagttgcttcttttgccgtttaccttttatgtagaataggtgattccgcagatctagaggtgttgtcagacttgtactatgggctgcgttttcctccagggaattgtgaactgtagttgacctgaagagctgctaagtgttggtttttaattctttgagcttagtaaagtctaggttccttttttcttagtcattgggtacagtgaagcatttaactcctgagttttctagaacctttaacagaactctcagaaacattattactatttttgtgtgtggagtgtgattctgtactttaatagtttcccaatttttctattcagggcatctttaaatatctaacttactatttaaaccctctttcaccattttcctgccttacttttttccatgccactcagtttttctttaattctgtaacataaatccaaagccttattctttggaaagcagtggtacttggcactaaattcactttagcattacctgaggaagcttaaaaaataaataccaaactaattaaatttgactagtagtgaggcccaggtttcagttttttttattttttatttttttaagaatgtttatctgatgtgcagctggggttgagaaccattgctctaatgcttagaaccaacatctctgtagtggggactggctaagagagtcagaagacagaagaagcaggtactttttaacctcataattgacattcaaacaaatgatgaaatagcatgcttcacacacaccctcatgaacacactttggacccaggacagtgtacttctggaaatgtacattctgttttattgtcctccctggctataactactctaatcttccacctttctttctccttaccctcactgctttatctcaagaagatcttgtgtggtatatagttgcgagaaagttacctgcatgattccgacaggtgccctgccatcactctaatgctgttctcattgcttggccttatggcacattctcactcactcactactcctgcatcatgttggcaaactccagccatttaccaccttctccttttttttttgagttggagtcttgctctgtcacccaggctggagtgcagtggtgcgatctctgctcactgcaacctccatctcctgggttcaagcgattcttctgcctcagcctcccaagcagctgggattacaggtgcctgctaccacccctggctaatttttgtatttttttagtggagacggggtttcatcatgttggctaggctggtcttgaactcctgacctcaggtgatctgcccaccttggcctcccaaagtgctgggattacaggcatgagccatcgtgcccaacctctctgctttaactttggggaaaatctcatgaccatgtggtgggatgccacttacaaatttgtggcctccaatctgagctctgccctctgcttgaagatgtatgtctgtgtatagtctgttctgtctgcagaaattcagtatttcttcccacctttttttctcattttcagtagatactcccatatgctacatcatagagataatggaatctgtccaattgagctcattgagtttatacccctctcatgccatcctaaatacatctgtgcttatttctgcccgctttgctaccttgtcataggacagtgaaagaagtgtgaaaggctcatctctccattctttttcaggaccccattctctgctacctcaggggccgtgtgccatcaaaaatagtcccattttttgactctatcatctttctcgctcactttttagtccttagcaggcagaagactctcccgttagagtaaaaacaaccaaaaaaccactgcagatccttctttctatgtataccctgtctgtttccattcatttttaaacttcttgaaaaaagtctatattcattccacgtctgctgcaatctggcttttggccctagagcagcactatttgaaactgctcttgtggacagttttcagtcttattttacctgagttctcagctgcatttagcatttgttgaccattcttccctttcctctgggcataattcttagatgtctcccccttcctcccatctttctggtaattccttttcagtttattggcattttatcttttgcctgtatctagatgttggattccctaaggttctgttcttcactcatttcttactgttttctagagagttatctagagataactttcctgagttatttctagacctctgtgttctttactgatgactctaatttcatatcttaatttgagagctctcttctgatctctggacttgtatattccattgtgtagtattttatgtcagtctcttcagattcacaatggctcagatggaatttatcaacttcctttaaccggctgtcatttcttacagtggtaagagccattgccatcgattctgatgcttaaaatggaaactttggtgtcatcttccatacctcacttgtctgtcttttggattcagttctattccatcccatgtcttctctcttacactttttaacatctcttatttaacctcttctgtattcgaggtcctctgttagagcaggtcctcatcatttctctcctgattaccttagtagtttcttcattgattttccttcctccagtatcatcttcgtctagtccacattattgccaaaatgatcttactaagaaatgattaagaacacaagcgcaaagaccagaccatctgggctttctatcccacactgggactacttgctttatgaccttgggtaatttgcttaaccattctttgccacattttcttctataaaatggggataatacagtgcttatctcatagtgaagttgtgagaatttaatgagttaatatacatctgggctgacagaactttgtgcaatgatggaaatgttctatatctgtactgccctctgtgatagccagagccatgtgtagctattgagctcttgcaatatggccagttgagtgaggagctgaattttaaattttatttagttataatttaattgaaatagccacatgtggctagtagctgctataatggacagtacagaatatgtaaagtccttagaaatagtgtttagcacataagtgctccataaatgttaactgttattaccatctttctaaaattaaacttctctgcttaaaatccttcagtaccaaattctgcgatatagtatatatgagttgtaacccattcccgtgcgttgctccaaacttgtcaattgccacttcttcataatgccctctgtgttccactgtaccagttctcaaagtgtggatgtagaggacagcaccagcaatagtatcccccaaaaacttgtttaaaatgcagattcttgagccatatttcaggcctattcaatcagaaactgaatttggggctttgcaacccgtatgttagtaagtcctccaggcgattctgatgcacgcttgagttcgagagccattgtactgcatcagtctccctgcagttcctcagatctatcttgttttcccttgcccctatatttttctcctgtctggaatgattgttatccattttttcttcctcataaattagctcttcaaccttgcagacttagtttagtcaagtttctttctgtttcttcctccttatcacccaccctgctcccaggctgacttcaagacctgtcttaatctccatgctgcatatgtccgtacacacttgcatcatagaccattttacatagtacttttttagcctgtctcctattagtgaatttaggttcttgtttttcgtctttgtatttccatctatctggcagtatctgattgttttgtttatttttaatttttttaattaaaaaatttttaactgttttgtttgggttgtttcatatgtattaagcatcttccaggggccggcacagtgattaggagtgacagagtaggtaaagcagacatcgtctctgtaataaatacacatggtgataagtgctctgatgaagtaaaatagagcactgtggaaacacagaggagggggtggaaaaagtcagggaagtctgttcagaggaagtcacatgtgaagttagtgaagtggggaagcaaatgggtgcggtgggaaagagagtagttcctgaaaagggaacagcatgtacaaaggcctagaagcaaaacattgtatgcacatagtaactgtttaattggatatgaattttaaaaatcacatgtctaacttagctcttggtttcgaagacatcacccttcccagcaaacattgcattttatatgcttctgtatttttaaagcagttttcatacttgatatcacactttgagtagatggttatggtgtgatagggtaacttccaagccagcaggatacatctttttacttactgccttttaaagcagaaaaaaggatttgttttgtctgaaaattattccacagggccaggaacacatcagtggtgacagaggtaaacacattactcttattgagtaagaatagccaaggtttggccaggcacagtggctcacgcctgtaatcccagcactttgggaggccgagacaggcagatcatgaggtcaggagttcgagaccaccctggccaacatggtgaacgtctctactaaaaatacaaaaattagccgagtgtggtggtaggtgcctgtaatcccagctacttggaggctgaggcagaagaatcacttgaacctgggaggcagagtttgcagtgagctgagatgaccaccactgcactccagcctgggcaacagagcaagactccatctcaaaaaaaaaaaaaaaaaaaaaaaaagccaaggttttaaataagcattagaccattgagaaagcatatcattaggaaggctgaaggcagccagtgtgccagccacaactgttgtcacttttttagcctcactgtgtattggctctttttgctcttgttgatgccatcccacttcctgttctcattagccctccattgtaagagtaacgtggcattcgttaatgtgctgtgtaagctccaactattaatttgctactgaatatttgcttttgtctttttgagactttatataatttttagtaaaataaaaactcaccttttgctctctttgattgctttgcaaatgggttgtcttcataatttattaactttgaaagaagactgataaaaatacagttttgtttctcataactttagccaatcgggacaaacctagagaagaaggaaaaagggaaataaaatctgttcccctaaaactttatatggatggtaatattgaaatatttcagatattgaagaattttgctttcacatacatatattttttgatataacaattttgtacataggtacaaaagataggcagtccaggtgctatgattgccaagttttacttagtcagaattatatagttaaggtaataaatggaactagagcctaggtctgttcaatcttagtactccttgagccacatcaagctgcctgttgtgcaagactacagttcatgaaaatgacaagcattaaaaaacaagtactcctggctaacacggcaaaaccctgtctctactaaaaatacagaaaattagccaggcatggtggcaggcgcctgtagtcccagctactcgggaggctgaggcaggagaacggcgtgaacccgggaggtgaagcttgcagtgagctgagatcgggccactgcattctagcctgggcgatagagtgagactccgtctcaaaaaaaaaaaaagtacgaccaggcatggtggctcacgcctgtaatcctaggactttgggaggctgaggtgggtggatcacctgaggtcaggagttcaagaccagcctggccaacatgacaaaaccctatctctactaaaaatacaaaaattagccagttgtgatgatgggtgtctgtaatcccagctacttgggaggctgaggcagggagaattgcttgaacccgggaggtggaggttgcggtgagccaagatcacaccactgcacttcagcctgggcgacagagctagactccgtctccaaaaaaaaaaaaaaaaaaaaaaaaaaaaagtgaatgctccttcaatatttatttcatagatctgtgaaaccatttatcaaatcataggtattattcatctttggatccagcttgcagcactttctaacgatgcccatagagtgtttttataattgaaaccatcatgtttgaactagaagggggatgatagaaattaggttgattaaaaaaattattcagctctctttatcctctcaaaatttatagcctctagatgaaaaggagaaaatagggtatcagatgtattctagaaatgcttgatacctcagctgaaaagtaccatttgccacttccttcaagatagtatttgttttgtattacccatataatatttttaaaagttaaaaacacttttctgaataggtaatgtattcatcactgtgtaaaattcaaaaagtacaaaaacgagaattctgtgaaaagtattattctaagtcttattccctagctacttggctcccctctgggaggcagccggtgagctgtatgtttcttttgtaccttttgaaatgattgtatgtgtatacaaatgatcactttatgtatacatttctcctgtccccccccccctttttttttttttgcatttggcagcataccttaacatactcttttgcatcttactttttttttctcaccacttaacaatatatgctcatgcacttcataacaatgttgcagtcaacagtagaccacatatacaaaagttgtcccataagattttaacggagaggcggagcacagtggttaacccctgtaattccagcactttgtgagactgaggcaagcagatcacttgaggtcaggagttcaagtccagcctgaccaacatggtgaaaccctgtctctactaaaaatacaacaacaacaacaaaaaatttgtcaggtgtggtggcaggcttctgtaatcccagctccttgagaagctgaggcacgagtatcactggaacctgggaggcagagtttgcggtgaaccaagatcccgccactgcactccagcctgggtgacagaacaaaactgtgtctcaaaaaaaaaataataataaaataaaataaaattttaatggagagaggtgaaattaaggaggcttaaagatgggtgactagaggaccccaacattcaccttctccacaaaggtggaccaaaacagccagtagataatcacattttgaatgcagcatttaagagagaacactgaaattaaacacggaaaggatgaggaacctctgaggcacaggaagagagggaagtgaacagctggcctggctgggattggcttggagccgggagaaagtccccagtgtggagaacaggtaagagacagatccccagtgatctgtgttcccaccatggactcctgtaatctggcctcaggagagcttcttggccttcatgggccctgatactagaataggaaaatagggagctgcctggagcccccttgtccgagacccaatgagctgcagcagggtgccattttgacagtccagcccctattagaccacatctttctctggcgcccaattgcccttgaatctccatatccgtagtgctctgatgacatgttcctgtgtccatccagagggctgcagcatcacaatgccagctggacccagcagtgcagagcatattaattctccagaaagagtccaatggaaaaaaagaaaaatgcctgagaaacagttcaaaataatattaaagaagctcagtgaaatacaagggtacacaatgtaaagaaatcagaaaaataattcatgatctgaatgagaaatttaacagataacataaacaagaaacagaaattgtagaactgaagaattcaactaatgaaataaaagctataattgaggtggtcatggtggctcatgcctgtaatcaatcccagcattttgggagaccaaggcgggaggatcgcttgaacccaggagtttgagatcagcctgggcaacatggtgagacccctgtctcttgaactgtgatcatgccactgcactccagtctgggcaacagagtgagaacctgtttcaaaaaaaaaaaaacaaaaaaaaactacaactgtgagtgcttttaactatagactagatcaagcagaagaaaggacatctgaatttgaagacagatcttttgaaataattgtcatacaaaaaaataagaaagcatatgtgacatatgggagggacaccataatgtgaccaaatatttgagtgttgggtattccagaagaatagaggggcaaaggcatagaattattactgaaataataactgaaaagttttcgaatcttacaaaagatacagacatacagatttagaaaactaaaagatttcaaaatagattcagtccataaggtgttctccatggcacattatagtcaaactgtcacaaagacagagaattctaaaaatagcaggaggaaagcagtgaatcacaatataagggaagccccatcagactaacagcagaaatcttataggccaggagagaatgggatgatatattcaaaatactggaagaatgaaactactggccaagaatactacacctaacaaagctgtctttttagaatgaaagataaataaattctttcccagataagaaaaaaatcaagggaatttatcaacactagatggccctacaagaaatgcttaagggagttctaaatctgaaagtgaaagggcaatatgtaccgccatgaaaacatgcaaatacataaaactcactagaagagcagacatacaaatgaaaaagagaaaggacccaaatattaccacaggaaattaccaaactgcagtgacaaccaatgagagaggaagaaaggaacaaggatacacaaaacaaccagaaggttaacaaaatacaggataagtcttcagctgtcaataataatcttgaatcagattaaattccacacttaaaatatgtagataaactgattttttttaagacccaattatatactgcctacaagaaacttacttcacctatgaagacatatagaccgaaagtgaagggatggaacaagatattttatgcaaatggaaaccaaaagtgattaggagtactatacttctattagataaagtggacattaagtcgaaaactgcaaaaagagataacatgggtcattacatagtgataaagggatcagtacagcaagaggatataacaatggtaaatatatacgcacccaatataggagcacccagatacataaagcaaatgttattacatctaaagggagagaacaactccaatatggtaatagttggggacttcaacacttcacgctcagaattgggcaggtcagctgtgcagaaaatcagcaaaaactgtggatttaaaccacactttacaccaaatggacctgactggtatttacagaacattttatccagcagccagagaatacacattcttctcatcagcacatggatcattctctaggatagaccaaacaagtctcaacaaattttttaaaaccaaaatcatatcatgtattttcttagaccaaaatggaataaaactagatatccagaagaagaggaactttggaaactatataaatacaaggaaattaaacagcatgctcccgaacaatcactgggtcaatgaagatactaagaatgaaataaaaaaaatttcttacaacaaatgggatatagcaaaagcagagttaagagggaagtttacagccaataagtgcctccattaaaaaagtagaaagatatcacataaactacctaatgctgcacctcagggaactagaaaagttaagaacaaactaaatcctcaaattagtagaaagaaagaaataataaaggcaggagcagaaataaaatagaaactgaaaaaatacaaagaatcaacaaaatgaaaagttttttaaaaagacaaaattgataaactgctagcgaggcaaaccaagaaaaaagagagaagacccaaataaattagaaatgaaaaaggagacattacaactgataccacagaagtacaaaggatcgtcagcaactattatgaacaactgtatgctaacaaattggaaaaccagaggaaatggatacattactggacacgtacaacctaccaaaattgaatcaggaagaaacaatacctgaacacccaataatgagtaacacaattgaatcagaaataaaaagtttccaaaaagagaaaagcctaggaccagatggctttcctctcaattctacctgctgaattttaccaaacttaagaagaagaactaacaccagtttttctcaaactattccaaaaaattaaagaggagggaattcttcctaactcactctacaaggccagcattatcccaataccaaatccagataagaatacaacaacaacaacaaaagaaaactacaggccaatagtcctgatgaacatacatgcaaaaatcctcaacaaaatactgatagacaatccaaacaatccagcaacaatcaaaaagataacacaccatgattaattggggtttatcctagggatgcatattcaaatatgttcatgttcaacctatgcaaatcaataaatgtgatacattgcatcaatagagtggacaaatatcttgataatttcaatagatgcagaaaaagcatttgataaaattcaacatcttttcatgataaaacctctcaacaaattaggcataaaaggagcatacttcaacattaataagggccatccatgacaaacccacagctaacgttatactaagtggggaaaagctgaaagccttttctctaagaattggaataaggcaaggttacccactctcacaactcgtattcagcgtagtactggaaatcccaaccggagcattcaggcaagagaaagaaaaaaaaggcatccagattggaaaagaggaagtcagattgtccctctttgcagacaacatgatctcatatgtagaaaaacatgaaggctctacaaaaaaacttttagaactgataacacaaattcaataaagttgcaggatacaaaatcaacatacaaaaatcagtagtgtttccatacaccaataacaaaagaatggaaaaataaagcaatcccacttacaaagctaccaagacaatcacacaaaacctagttataaatttaaccaaggaggtggaagacctctataagggaaactgtaacagtgattaaaaaaaaattggaggacacaaacaaatgggaagacatcccctgttcatggattggaagaattactgttgttgaaatgaccatattacccaaagcaatctacagattaaatgtaatccccataaaaataccatcaacattgttcacagaaatagaaaaaacaatcctaaaatttttacggaaccacaaaagaccctgagtagccaaagcaatcctgatcaaaaagaacaaagctgggggcatcacactacttgacttgaaaatatattacaaagctgtagtaaccaattcagcaaggtattggtataaaaacagacagaccactgggacagaatagagaactcagaaataaatccatgtatttacagccaactgtttcagtaaaggtgccaagagcatacactggtgaaaggacaatctctttaataaatgatgctgggaaagctggatgtccataagcagaagaatgaaactagacccctatttctcactttatgcaaaagtcagctcagaatggattaaagacttaaatgtaaggtctgaaactgtaaaactacttgaagaaaacataagacaagaagctacaagaaaacaagaaagcttaaggacattgatacaggcaaagattttatggttaagacctcgaaagcatggataacaaaaacaaacaatagacaaatgggaatatattaaactaaggagctactgcccaacaaagaaaacaatcagcagaatgaagagacaacctgtagattgggagaaaatatttgcaaactattcatccaacaagggactaatatctagaatgtacaaggaactcaactcaaagacaagaaaaccaaataatcctattaacaagttggcaaaggatctgaatagacatttctcaaaagaatacatacaaatggccaacaggtgtataaaaaaatgcccagccaaaagtgcagtggctcacacctgtaatcccagcactttgggaggctgaggagggcggatcacctgaggtgtaggagttcgagaccagcctacccaacatggcgaaaccccgtctctactaaaaatacaaaaaattagccaggcatggtggtgggcacctgtaatcccagctactcggaaggctgaggctggagaatcacttgaacctgggaggtggaggttgcagtgagccgagatcatgccactgcactccagcctgggcaacaagagggaaactccatctcaaaaacaaaacaaaacaaaaaaaaacctcagcatcactaatcatctgggaaatacaaatcaaaactataataagataccattctaccttgttagaatggctgttgtcaaaaagacaaaaaataagtgctggtgaggatagggagaaaagggaactcttatacatcgttgtgagaatgtaaattagtacagccattatggagaacagtatggagatttctcaaaaactgaaagtagaattgccatatgatccagcagttccactattaggtgtttatctaaaggaaggagaatcagcatatcaaagggatacttatacccccatatttattgcaacaccattcacaatagccaagatatggaatcaacctaagtatctatgagttgttaaatggataaagaaaattttataaatgtatatgtatatatacacaccatggaatactactcagctatcaaaaaagaatgaaactctatcatttgcagcaacacggatggaactgaaagccattattttaaatgatataagccagccacagaatgacagctgtcacgttctcacttatatgtgggagtaaaaacagttgactcatggaggtagagaatagaatgatagttaccaaagtctgagatgggcgaggggtggggtggatgaagagaggttaatgggtacaaacatacagttagaaggaataagttctaatttcattgcttagtggggtaactgtagttaacagcaatatattgcatatttcaaaatagttagaagatttcaagtgttaaccaacacaaatgataaatgtttgaggtgatggatatcctaaataccctgatttgatcattacgcattgtatgcaggtatcaaaatatcacgtgtacctcataaagatgtacaattatgaatatattaaaaattattacagtggcgctgaacagtttctacacctagtgatgtcatagacattatagtgtacatagtgtgcactactcagcatgtttgtggtgatattggtgtaaacctgtgctgccagtcttatgagagcttagcacatactattatgtatactacataatacttgattataagcaactacctgttactgctttatgtatttattatagttgttatcattattttagagtgtactccttcttattaaaaagagtttacggtaaaacagtcccagacaggtccctcaggaagtattccaaaagaaggcattgttaccacaggagatgacagctccatatgtggtatcaccccactttccagtggggaaagatggggacagtggaatacagtgatattgatgatcctgaccctgtgtaggcttaggctaatgtttaatgtttgttttttaatgcttaacaaaaagtaaaagaaaatttttttttttttttttggatagagaaaagtttgtagaataaggatataaagtaagtaggctgggcgtggtggctcacacctgtagttgcagcagtttgggaggccaaggcaggtggatcactggagcccaggagtttgcaaccaacttgggcaacatgacaaaaccccgtctttacaaaaatacaaaaattagctggacatggtggcgcgcgcctatagtcccagctacttgggaggctgaggtgggaggatcacttgagcctggaaggttgaggctgcagtgagccaagatcatgccactgcactccagcctgggcaacagagtgtgaccctgtcttaaaaaaaaaaagtaaatatatttgtacagctgtactgtacaatgtgtgttttgagtgaagtgttattacaaaagaatttttaaagtaaaagaaattaaaaagtttataatgtaaaaagttacattgtggtaaggttaacattattgaagatagaaatttttttccaaatttagtgtagcctaggtgttcagtgtttataaagtttgtattagtgtatagtaatgtgctaggcttttgtgttcactcaccactcattcactgactttcttggggcaacttctagtcctgcaagctccatttgtggtaagtgccccatacaggtgtactaatttaaaaaaatcttatatattgtatttttactgttccttttctatgtttagatactcaaaatcttaccattgtgttacaattgccttcaatattcagtatagtaacatgttgtacaggtttgtagctaggagctgtagcctataccatatagcctaggtgtgtagtaagctatacagtctaggtatgtgtaagtacactttatgatgttgcacaatgatgaaattgtctaatgacatatttctcagcatgaatccccatcattaagcgacacatgactgtatcttaaaggatgtttcatatcagtacattaggcttagtaatgtttcattgtatgagtgtatcataatttatacatttttatatgtagccccttgttaatggacatttgtttctaattttttttgtgatgacaaatagtgctgcattaataacctcatttgtatatcatttcacttataagtccctagaagtggaattattgggttaaagagtgttatggcgttataattttgatattcctgtatttttctccatagagagtcatcaccagtatgtgagagtaactgcttccctataccctttgcaacacactgtaaatttttttatttttggcagtctgacaagtgaaaaatcgttacccacttttgactacatgctttcactcacaggggagtttgctcttccagcctaatgaccaaagacaacatctaatttgtatttgtactgttaggctattttaaccctgattttccaaaaaaaatgtacagttcttagaggtaatcaaattttttttttaaactgttactatgttgctttagaaatatctaggtttttttgctgggtctgatttgaaagcagtgacctgatagatttctgttaaccttaccacagtgtaactttttacgtacagtattttacaaacctgatacagtatcaggtttgatactgataggtttgtcagtctttttaagtgcccattatgtagtacctgtatttgaaaacctgtataattttgaatacatattatatgctaggtattatatttagatcacagcaactctttaaagaagattgtctgtgttgaaggctcatagaggtcaaacgatttgccgtagtatattagaatgtagatgctggtagagtcattaaaagagaaaaatacacatttggagttgagataaactgaaattgttaaacttgtgcaataattaaaagtattaactgagttttgttttgttttgttttgtttttgagacagagtcttactctgttcaggttagagtgcagtggcacgatctctgctcactgcagcctctgcctcccaggttcaagcgattcttgtacttcaatctgcagagtagctgggactacaggtgtctaattagccagcctaatttttgtatttttagtagagatggggtttctccacgttggccaggctggtcttgaactcctggcttcaaacaatctacctgccttggcctcccaaagtgctgggattacaggtgtgtgccactgtgcctggtctaaagtactccctgagttttttacaacacaaattctcattagtttaggacttgagttaagagtattaagagcagagattccagtctcaccatttacttgttatttgatctttaaattacttaattctccatgagcttcagtttccttttctgtaaaagagggatagtattataatagtacctaaattacaaaattcataaagcaaccttacctttttaaagattgtgtttagcctgatcatgtcattgttgcagtggttttttagcctgtttcaaaaatagagagcaagaaatagtgctgacttccttctcttttctccagtaaaacaagacaaaacaaagtatcagtttgttaactcacaaaatattgccatcacattttaagaccatttgaaattttcatgaacacataaattttaatatgacatagaagtagacagataacataaaaccatttgtcacgttttataatctatttaaattaggatggattttttggatcatattcctttgggaaaggcaaaatatttaaacaatattcctattccccctcagtttggccctatttggaagtaacagtatatctctctttcctcaataaaagaacagtaacaaggacagcaaacttcctcataaaaaacaacaacaacaacaacaagcagagtaccccccccattgttaagttgttaaaataagtctttattttatatcttgaaagctcaagattagggtaaggatcacgttacagagctgttttttccccatgcaaagtggcctggttcatattaggaatgaaactagtgactgtaatgtaattaagcactgtgttgtatagcactgcttctcaagttttcctttggggattttgctaaaatgaagttccagatttttggtgaggtctgagattttgcatttttaaaaagctccccagtattacagtgctgcacaaaacacagttttgagtagcacgtttctgtagcactaacccatcttttactcttgagtaattatcttaaatcatatgcttattttcagacattcattcagcagatttctgctgaacgtctatgtccctggcactatgctaggtactggggttactagggatgctgggtagatagtctgctgtcaggcaagtggggaagccaaagaaataacaacaaagtatatgtaactggtgatgggaaagtccagggagctgataatcttaagcacaaaaattgctttttgacagatttatgaagacagtgaacctagtttatctgataccgtgacatctaggttcccaatagacgtagaatgggggatattcattggatatcagtctagaatggttgttggcaaactctttctgtaaataaaaggcagggtagtaaatattttaggctttgcgggccatacagtctctgctgattactcaagtctgcgaaccaggtaacatgtaaatgattgtgtgttccagaaagactttatttacaaaaccaggtggtagactggatttggcttgcaggctatagttctagattggcagcatatcactcttcacttataagatatgaaaatagtttaaaggaatgatttatttaaaaaaagaaggtaattacattgataacatcactgcatcactgattcatttgcatttgaatatgctatcttggaacattagttgtttatatacctaaggatacccctgagaatatattatacatgtgattgtcatttgtcttgtatatcattggaggaaaaaaaagggttaaggtctattgcttggaactttagttagaactcctaaagagctgcacaaatgcccatttttcccttctattatatgggggaaagaaaccatgatatatagaaggagttatagaatttgagtataggtatgcagtgaagcatatctgtaaattgctttttctggacaatattgaaaactgtgtaatccccagaccagaagaggacatccctggatactcaatcagttaccatcatttagggtaatgaatataatttgggctctggagtttaccttttggtttcatcacttaactcgtgtgaatttggcagagtagttaacctctttgccctcagtttcttcatgggataatgatactgcaacatacttttgaaaattataaaaaacacactatatttgatagcaactagtatagcactagaaaatagtgagccttctatagatgttacttttcttctcttctgacctgcctgcagagcagtttactaatgtactgaaggaaactgaggaaaaaaatgttcctggcacataagaatcttaaaattgagcaatatactaatgtactgaaggaaattgaggaaaaaaatgttcctggcacataagaatcttaaaattttcttggagttgtatataaaaataaagaggaacactttcaaaataacatgcaaaccaatgtaaggcctctcaatagaggtatctcaaacaggtaaaaatatcatttagttgtagaactaaaagtcttaggacttctttaaattcaaacccttatttttacagatgagatcaaatgactttccctaaatgctgatatgttgcctttttgtgtggagaatttattctctaacattcattgattaaccagatgctgttgcctcttggttaggaatttaagttaaattcatccgtttcagtttaagcaccgaacaacttgttctacatggtttttttgtttgtttgtttttgtttttttttaatttgaggcagagtctcgctctgtcgccaggctggagtgcagtggtgcgatcttggctcactgcaacctctgcctccccagttcaggctattctccggcctcagcctcccgagtagctgggattataggggtggccaccacgcccagctaattttgtaattttagtagagatggggtttcaccatgttggccaggcgggtctcgaacttctgacctcaggtgatccatccacctcggcctctcaaagtgttgggattacaggcatgagccacctcgcccagcctgttctatgtgtttttaatacttaggaagtgttgatacatataattttctggccttaacagagatggttagtagctattcataggtctgactgtaaattaaataatttttatttatttatttactcttttgagatagttttgctcttgttgcccaggctggagtgcagtggcacaatctcggcttactgcagcctccacctcctgggttcaagcgattctcctacttcagcctctcaagtagctggaattaacaggcatgtgccaccacacctggctaatttttgtattttagtagagactgggtttgaactcctgaccacaggtgatccgcccacctcagcctcccaaagtgcaaggattacaggtgtgagccaccgtgcctggcctaataatttttatttctttaatattgccactaggaacaattttctgtgacatttttgtagctctgtagttaaactaacttggaatttctttacagagcttagaatttacaatactgttagtctctttgagttgtattagtagaaaggaaaggtgacattaaatactgacaagcaaaaaatataaagtaattgctctttggcagctttagtcatgcctcctatatctgtctcattttgccttggttcatgccctcgtcttttctttcttgggttattgtagttgtctttcagatggtttccctttagtcattcaataaataagtggtgacacatgataggtacttctaagtgcggtgagttcagcagtaaacagatggatcaacctccctgccctcgtggagcttattatttagcagactctagctctgtactttgagagcttccctctctacttttgtctgagtgctatctctaaaatatgtcctcccagtgttcagaatcctcaagtgcaagtggagtgggtttctattgtcttttggacaaggttcgggcttccttgcctttattgcaacttcatctcttgccatgctcttcttaaccctctgccttccagcacactgtagtcccttgttggcaccacactgtcttaacatttttatacatatatttctgtctgcaaattcattcctttagatccccccaccccaacaaacaaaaacaaaaatagcgaatattcatcttttaagcctctttgacttacccactactacctctctgctttggtgccatgactcccttcctttataaacaaatatattctcatggtccattaggcatactgatactatgacgtttttctccctgtattatgatagtctgttcatttatctgcctgtcctactagaattaaaggcaaaggctgcttttttgtttatttttcagtgtctctcaaggggcctggctcatagtggtttgaaatattaattgaacaaatgaatgaatagcccagacttctactatctcaatgctgtcaacctgacaacgtgcgggggattcattcagtaaccctttaaattagtggagtgcttattactatgtgccagtgatagagatacatagataatctgtcctcagatgagtccactgtaaggctgacagcttccttattttcacagcatacagtcttttaaattttttatatatttattagaaaactaataagtagtctctatcaagtatctaaacaagtgttgagagtatctttttattgaagtagtggcttaaactattgaagagatattgataaaaatttggggaaaataaaagtgtatgtagtgctaatttttttttgcatccctcagagatccagagtcatttggatagtttagtaatatataaaatatattttgaaaaactgtgtttgttaagtttttagtatctttaaaaatgtgaaggctgataaaattttatttttctaattaagaacaaagttttgacctgtaagtgctacccttggagaaaaatttcttctatctccctcctctctttatagtaaagccatctacttgtatatctctgtatcatatatgtcccccttttttaaacagtagatttagttgttctcacattacagttctctttgacccttattttatggatattacagtttgacttttgtatttacaactgttaatctctcaacctgttttatgtttatgtggacatgttaagtgttttgtgtacttcatgatggtttttcaaatatgattatacaaatatccttggatataccaaatataaatatattattttgaaaacaactgttagaatatacattgtgtgcaaatttgttataagggaaaggtttaactaattgaaatgaactttgctattaatttttatattgcctgcatttaatagtaattttaaaacagtaagaagagagttgtgtttctcaaattgcttccttggcacgcagttcctgaatgtgttcagagaacagtggattccaaggcagaataagcatagcaaatggtacatattcatatttcacataaacatagcgaaggaactgtggaattcccacctctacacctgtttaactttgctaacttaacttatttgtgtaagggaggacaacctcccttccctcatctcttgcctcccttaagacctgtttgggaagcactgctgttaacgtgcagtttctggggctctgatgtcctggtaccttgccttttggttatttaatgggagttaagagtctttgcctcatctgcatttgcattaaaatgtctgtgggagttacttcaaggggaaaaatgagctagtctgtttcaattggaaaagtctatgtctagagtgtgtctatatgcatgagcaaactttgctatttttaaatccctgtgtgaacgtcagattttttggctgttttggcttattgcagtaggaatagataaattgatgttcagctcagttgttcatagcattgcatgggacaaaaagatggttactacaaaattatgaaatcaaaatgctttttgaaaacctaaattttcaaatgaaaaatatccttcaacatacatatttagctcaccctttattacctgtttctctgctgaaaggatagaatagtacatatgccaggagttgaaatttatctatacattgaaatttatacgactgtataggaggttgtggtttggcagcaaaagctttctagatcactaatttgtaagcgccttgaaggtaagtgttcagtgtctcttacatctttgtattgcccacaggcaaatgctgttttatgagtggcagtaatttgtattctgaacttaaggcaagaaagactttgtataggatctgcttttaagtgctgtcgtggtatctggaaagttgtttgcatagttacctccttatctgtctgtcctcttggcttcctagttctgctttccccccagctcatccatgttgaagggatctggctatagattgcaactctgcttactgtagcatagggctgccagcttggtagtccggattctttttagcacagaaggggcatgagaccacattggacatattacttgtgagctttgagaagtttttgtggataacattggcagacaacctctgactttgacattatagcctactctgttatattgttctcctctcttctgccttactatctcccttcatgcactggttatcccatttgaaatagtgtttctggaggcttaaagatgaggagtagttgaacagttatggacagtgatttctcagctccttagagaactgaacccataatctatcctttcctagcgtaatcctgaacctgtaactacatttaataactgcatgtaccgaagtatttcaagtaatcctgaacctgtaactacatgtaataactgcatgtaccgaagtatttcattggatcacatactgctccagcttctacttcagtttctacctcccttgtatatgaggtcacttattctagttgagtaatatctctgaatttcttcctttatttattaaaaaagtgctaatatgctgtcctccgagccccatttaatctttttctgttttcttattttccttgcttctctttagccccccgatctgtccttgtcttattgctgtaacctgctgccccttattgatcatacagtggattgaaggtatatttgttgacttaattatctatgtgttttaagaaactggttgcctgaggcatttctgcgtgtgtgttttaaaagagagcatagcctcttgatctcaagccaaaaatgtggttcatttaactggtattttatcttcaattgatttttctgtggagtttggccttggatatatatagtatgggtatagatgattgtgaatggcttataatagctgattacagagtatggcccagaaattcttttgctttgtactgtgtatggaacagtttggtatgaaaattaactgtagcaaaagcatagttaactttaatagcatatctggcatctcttttctcacacatcacgtctagtacagtagcaaatccttttggctctgccccttagaacaggggttagcaaattatggcccccacctctttatagttcatgagctaaaaatgttttttttttaacaattctaaatggttgaaaaatattaaaataatatttcaaacacatgcaaatcatatgtaattcagatttcagtgtccataagtaaagttgtattggagcacagccacacttgttttcgtttctgtgttgtccaaggcttctttcacggtaccgcggcagacttgagtggttttaacagagaccctgtgacctcagaactgaatatatttactgtctggtctttacaaacagtttgccaaaccctgctctgttgtatatccagaatctagcactttttacttccctcttgactaagtcattgttcttgcctcctaattgaactccttgcttctgttcttgtccctttaaatctgcagtcagtggagtgatctttttagaaagtaaaccaccctctgtttagataaaataggttaataaataagtaaatatcaaggacagttttgaatgaaaattatagaaggaccattaatcttggttaggataggagcaaggaaccccatatattgtgtttaaatgctgatgaatacagaagtgaccatacatatgtgtgcatgagcatttgtaattgaaaaaaagcagagccaaggccgggcgtggtggcttacgcctgtaatcccagcactttgggaggccaaggcgggtggatcatgaggtcaagagatggagaccatcctggccaacatggtgaaaccccaactctactaaaaaatacaaaaattagctgggtttggtggcatgcgcggctgagacaggagaatcgcttgaacccgggaggcggaggttgcagtgagccaagatcgcgccactgcactccagcctggcaacagagcgagactccatctaaaaaaaaaaaaaaagaaagaaagaaaaatgacagagccacctccctctgtattgctatatttatttatctataaatttacatgcaataatgcattcttttctgtgtctacttttatgagttttgataaatggatagagttatataaccaatcaccacaatcaagatataggaaagatccattatccactaaaaaaaaaaaaaaacttgacttttgtagtcatcaccctcccccaaccctggcaaaccactgagctattattctccctataatattacattttccagactgtcatataaatggaatcaagtatagttttttaagtttggcttatttcatttggcatcatgcatttgggattcatccatgtagttgtcaatagtttgttcctttttgttgctgagtagtactccatggtgtggtaggtacaccatagtttgtttatctcttcccctattgagggacatttggtttcagtttttggcaattatgaataagctttctataaacattcatatataggtttttgtgtgaatatagtacagtagtttcctgtggctgctgtaaaaaattgcgaaactggatagctttaaaacagcagaaatttattccctcactatcctgagggtcggaagtctgaaattagtatttctggactgaactcaaagtgttggcagggacacattgcccctgcaggcattctgagcttctggtggctcttggcatttcttggcttgtggtcagcagcagcatcactcccatctctgcctcttcacatcatgtcttctcctttgtgtgtgtgtcacctgttcctctgcttctctagggacacttgtcacaacatgtatggcctgcttagataatccaggataacccccccatctcaaaattcttaatttaatcacacttgtgaagacccttttcccaaataaaattatcctttacaggttcgaaggattaggatgagctgtctgtgggggatttcagtctactactctaggttttcatttgacttgggcagatacctaggaggtgtgttgctgggttgtatggtaatggtatgtttaacttttataagaaactgctaagctgttttccatagtggctgtactgttttgcatgcttaccagctatgtatgagtatctcatttattcagactcctcactggtacttgatattgtcattttaaaaagccgttctaatagatagtggtatttcattgtgattttaatttgcatttccctaacgattggttgtgtgaagcatcttttcatgtgttttatgtacatatcttctttggtgaagtgtctcttcaagtagtttgcctatctttttcagggggttggatttcctctttgttattctttttttttttttttcctcttctttttttccccacacctctgttcttcctaaagttagttttgggctccagggaattgggaagatatttgtgcttttataatcctctgtatgcctcaatatttccttgccacaaacttgttctgagtttcttattcttttttttttttctgagatggagtttcactcttgttgcccaggctggagtgcaatggcacaatctcagctcaccacaacctctgcttcctgggttcaagcgattctcctgcctcagcctcctgcgtagctgggattacaggcatgcatcaccacacccagctgatttttctgtgtttttagtagagacggggtttctccatgttggtcaggctagtctcgaactcctgacctcaggtgatccacccacctcagcctcccaaagtgctgggattacaggtgtgagtcaccgcacccggccgaagtagtgatttttaactgtcgatcagcattgtgaatactcatttctagaaaaaatggtctcatttactagtctattgaattaaagaaggtaatgtaggaacttgaaagttggggttcttattttcaagattttttataaagttgagtatctagactgcaaaatgtatcagtggttttagagggaagaattagcttttcattctgagtttctaaaactaggtatattagacttgggttcttttctggcttttgatagactttctcagaaaataaaatataatctaaattaacatgtaaggggcatgttaggtctggggttgcaagtgactgaagcccttgagtaaaaagggcgatttgttagtgcataggaccaaactgtaaggaatgatagggatggaattggtttttggggacaactgatctgggaattagattattgcctggattatctcctcttatctctgctctctctttgaattgattacattgtttcctgtctcagatgagttttctccaaatgattgggatcatggttgctggtgttttaggactcgtatccttctattttagtgaccccagaggaagaaaagggaccttctttgccagtaggcttaggaaaccctggggaagcaaagaagaatctggtgtcaagaatggttgggcacatagtagagcacaaacagtttataatgctggctgggagtgactgctgggttagtgaaggtgtgggccataagatttgttacacaagccagatcacttttgagatgaagggaagtactaggacaacagatgtaaacttgggctgtctcacataccccagtgatggggaggtgataatcagacttgttgcacagtagggcgccctgaggctgagggtttggaatcgtgaagagacttgcctacgtgtgtgtggaagaaagccaggcagagctctgggttttcttgaatctttttgaggcaacccaagatttctgtagatctgccctaattagtaaatgttattgctttatggataaagttgaagtcctagaatctgaacccaatttctactttctcataggaaactagttctgtgctctgatacaatgtttactcaacaagtacatagagtgtctgatctgcagtcttctggcctattgtcaatagatggtattgacaataccagtcacccaggctggagtgcagtggtgcgatcttggctcactgcaacctctgcctcctgggttcaagcgattctcttgcctcagcctccagagtagctgggactacatgcgtgcgcgaccacaccaagctaatttttgtatttttagtagagacagggtttcacaatgtttgccagactggtcttgaactcctgacctcaagtgatccatctgcctctgccttggcctcccaaagtgctgcgattacaggtgtgagctactgcgactatcctgttttatttatttatttatttttttctgttgggtaaatctgtactttttctttaatgagacctgtgctttttacaaaggattgtggttttgtttttttttggtttttttttttttttttttgagacagggctttgtcctgtcgccaggctgtaggtgctgtgatcatggctcactgtagcctctgttttctgggctcaagtaatcctttcacctcagccttttatgtagctgggaccacaggtgcatgtcaccatgcccagctaatacttaaaattttttgtagagacaaggtcttcatatgtttcccaggctggtcttgaactcctgggctcaagcaaccctcccacctcagcctccccaaatgctgagattacaggcatgagccactgcacctggcctgacaaaggatgttaatgtttaatatgttgtggaaaaacagaaaaaaaattaaaggttttgtgaagaatgtaaaatgcacccacatgcacccattagtcgtctcagggtcacatgtcaccttttccatgaagatacttgttatggtcttttatgtagggtgtttttttctttttaaacttacatactagattatctgcacctagcacagtggtgctgtatatggttgttcagcaagaatccagttcctgtgaagtttcctaagataacagcataagataatatttaaaatttttattttcatataaactaatagcattaccttttaatattttacttcagattactttatggttcctgttcttttattcaagttctgcagatctagttactgttatccccattttatggtcaaggaaagagacacattgtagttaactaactgattttctctctgatgtagctagttatttatatgcaatgttctcactaatgtattttccgcaacgaattaaactaaaacttgagagcgtgatattaaaaggtgaatgatgatatgtgatttgagacacttggtatgaaagccagccttgtacaggggtgctgtgtatgcagagtcatttactgtagagtttacattaaaaattgattttcaaggtaaaaaattgctctcttcatcttttatattgctttattcaccaacttttaaattacaattttaaaatgtcttctatatatagactttctagaactaaaccagtacagttgccattaggtgcatgtagctatttaaatttaaattaattaaagttaaagtaatgataaccactagcacatttcaagtacccactagctcacatgtggctagtggttacagtattggacaacagagatatagaacatttcatcatcccagaaagttctactagatggcactgttcttgagaacagtgttaaaaaaatgtcactcgaggggccaggcgcagtgtctcatgcctgtaatcccagcactttggaaggccaaggcagaggcaggcggatcacttgaggtcaggagttcgagaccagccttggggcaacgtgaaaccccgtctctactcaaaaaatatataaaacttagctgggtgtggtggtgcacgcctgtaatcccagctacttgggaggatgaggcaggagaatcgcttgaacccaggaggcagaggttgcagtgagccaagattgtgccactgcactccagcctgggcgacagagtgagaccctgtctcagaaaaagaaaatattacttaaggatagggtttcagtttttaggctctaggatttttggagttgaaaatgttagctttggattatcctaatgaggggagctttgtgagttactgtctgtggatcaagcctgtcatgttcacactctgcctaatcttttactagtctctctgggctctgtatatatcagccatacttggctgagggtttttttttggggggttaagtagtacagaatttgcaaatgtttgttttatgtagttaaagccttgatgcttagtatcttttccttatcaataaaatgaagtaatgagatactgactatatggaatttgaattaattgattgggattatgaagttaacaataaaaattttttttttttttttttttttttttgagacggagtctcgctctgtcgcccaggctggagtacagtggcacgatctcagctcactgcaacgtccgcctccctggttcacgccattctcctgcctcagcctcctgagtagctgggactacaggcgcccgccatcacacccggctaattttttgtatttttagtagagacggggtttcaccatgttagtcagggtgttctcaatctcctgacctcgtgatccacccgctttggcctcccaaagccctgggattacaggcttgagccactgcgcccggccaacaataaaaattttaatgaactttctagtcctagtcccaggagaaacctttgctgtgttttaaagttaactcaacttcatctctcattctctagactcctcagcccttaaaagctcagtttagtgccttatagaactcagtccacacatttcttaagtaactgctctggaccagtcactgtcttacataatttgataattcatttatgagtatgtttaactggaaatgaggtccgaagagtaagaaacccggtctttatcttgtgtattcttagcaattaggagctgaaagagactttggagctagtcgggtgaaagattttcattttagggatgaagaacccaggtagagtaagtcagttccccatatttggagaattaggattaaagaactagcctttcatcagactatctactttattggttgattgttaaattaatctgaaggaagttctcagcactactctatgttgaggattctatattgtctatataaactgtgtcattgtagaataataaagttatttataactcctgatttcagcacacggtatttcctatttgtttcttatgacgtgttcttaggggcaaattgcatgatagttttggagatacagtattatgaaaaaggcatttttggttttagattagagtaagttgactgatttttttttttttttttttttgagatggagtcttgctctgtcatccaggctggagtgcagtggcatgatcttgactcactgcaacctctgcctcccgggttcaagtgattcttgtgcctcagcctcccaagtagctgggattacaggtgtgcatcaccatgcccagctaatttttgtatttttagtagaaacagggtttcaccacgttggccagtctggtctcgaactcctgacctcaggtgatccgcccacctcggcctcctaaagtgctgggattacaggcatgacactgtgcccagtcaactgatttcttaggttaaataaatactcctggtttatatcttcatttattatacttgctagtacaggttgagcatcccaaatccaaaaagttccaaagtctgaaactctttgggcgtccacatgactctcaaaggaaatgctcattggagcatttttgattttgaatttttggatttgggatgctcaaccagtgagtataatgcaaatattccaaaatccaaaaaacatctgaaatctgaaacacttcttgtcccaagcatttcagagataagggatacccaacctgaggtgacgtaacgtaagatgttacggagttggagtgtccatttatagaagcaaataggcctgactgtttctatgagctatagagttttgatctctagttttacattccaggtacagttttggttttgatattactattgtgtacacacatgtgcacctgcacacacacacataacatactcccagacacctacttacaagagtgctaagaacaggaaactgtcctaggtgcagacaaggctagactcttctagggtccctaaactgtttcttaaaattcgtttttattcctcctagtccttggcaaagtggtgggtgtatattaggtattaataaggtaattgttatttgatggtatacttttgcttcacagaaactttgtttatttctgtggtagcatatgcttgtagttgtcagggaccagatcagctcaggcttttttgcagaatacaggttatttccccatagggttagtatccccaccttcttcccccaagaactgaaatcattttcagaagggagtcattgcttctggatcaagactttaattatgggctttttttcaaaggcagttcccttttctgcagttgttctttggatggatggatggatggggagaaagagagtgagtgtgtgtgtgtgtgtgtgtgtgtgtgtgtgtgtgtatttgcttgcagcatttgaatatgtgcagcacattggctttctagacatcctttgtatagtaacagcatgtgtggaagggctggcagcctgtaaaacagtttttctcctcttccccctccttccaacctcactccctctctggatctggtgacattacatagataaatgtgctggctaggaaaacagcagaaggagttgaatgtctgccaaaaatttgcagcatgaaaccaagctggctgcttcagcctcgctttcctgatctcttattgtgtgtgtgcagtctgcatttgtcagggttttccttattgagcattacgtcactatgttctccacccttatcacactggcttttcttttgaaagctactgtcctcaggcttcaaactcgttaaacacttaaggctttatttatactgttacggaggtagtattgaagatgaaatatatttaagtcagaaattttaatttgatgcaatattaacttagagtatgcttttgtgtgtttctgggcaacattagggtagtgtagaaaagaatatcttctgaaaggactttgaagacagaaaagtactgattttttttaaacacgaatatttataatggctttataagaatcaaaatctggaaacaattcaaatgttcctcaaatggggaatggactgtggcctagtcatacaatggattgttactggcgatgagaagtaacaaactatgacacagccattaacatgaatgaatttcagatgtaatctgctaagcaaaagaagctagacttacaaggctactgactgtatgattccatttatatgcagaaatagtgccttttttttttttagagacggagtttcactcttgtcgcccaggctggagtgcaatggcgtgatctcggctcattgcaacctctgcctcccaggttcaagtgattctcctgccttagcctcttgagtagctgtgactacaggcgcacaccaccacacccggctaatatttttgtatttttattagagatagggtttcaccatgttggccaggctgctctcaaactcctgacctcaggtgatctgttcgcctcagcctcccaaagtgctgggattacaggtgtgagtcaccgcacccggccgaagtagtgatttttaactgtcgatcagcattgtgaatagtcatttctagaaaaaatgatctcatttactagtctattgaattaaagaaggtaatgtaggatcttgaaagttggggttcttattttcaagattttttataaagttgagtatctagactgcaaaatgtgtcagtggttttagagggaagaattagcttttcattctttgcagagtctggtgagagtgcttgaatccatgtctaaaaaaagggctttgcttactaaagctttatgtagttacttaaaaaataagtgtgctcctacttctttttttcctgaatccttcaggcttatacagtttaggaaccattaatttgaatcagttatttgggcaacttacctgtaatattttcattatgtttgttacttagcatatgctatcctgtattgtaatgttaatgcacacgtcttaattttacaactagatcataagacccagcagcagggagctagttttattatatatttgtttctctagcacctaactaaatatccttatacacaataaatactaaagataatggtctgtgtaggtaacattgaggatatgaatagtatgaggtgatttcactagctgactactagtatgctagggctgttattacagaataccgtagactaaatggcttaagcaacagaaatttgttttcttacaattctggaaactggaagttgcaaatcaaggcaccggcaaggttatcctctctccttgtcttgcagatggtcacctttttgctgtgtccacacgagcttttctctgcgagtacactcctgatttctctttctcttataaggataccagtcctattggattagggccccagctttatgatctatttaacctcaattacctctgttaaaggccttctctccaaatagagtcacattgaggaattagggcttcaccatatgaatttttcagggagcaaaatttagcctgtaacaatgacctcctgaagataggtaggtatgccaagttgctaagatattaaatagaatccacactagatacttcagtaaagaaaatgatgtatagggaattgataaagcagatgctggagaactgaaatgcaaaatggaaaattgaagtaacaccaaggtaataacttcctgaatcagctacaaccccatgggctggggaaacaaaaaaaaaaaaaaagaggtttgaattattggaagcttggaggaggggctccacagagctgagattcagacttaggaggaaggcccgctgcctgattgctttcaaagacttgagcgagaggccccacaaagttgggtctcagatctctcaaaaagatgtcttgccctgctgctgttgggctttctgagggcgcatgggaagtctagttctgagagctgaaggaagctgaagactggaaacaaccgtttctcctcggaaagggccaatgctagggttccagtggcaggataggagatagcaaggagcaagtccgttcttttgtcacctttacgttctagtcttcctctagtgtgttcccggctggtggagatgaatgggaagccgcctgacaggagaaatgaagtgtgcagaatctgagccccacatcataaggcccggtagagaagagtgaacttggacttgagacacagcagcttaatagatggtactattattggcaggagtacagcctccctgaaattcactttggcagtatggatcaaaaatcttagaaatgtgcataccttttggcccagtaattccagttcaaggaatatgtcctaaggaaataatccaaaaagtagtaaagatgtaagtacaaagctgtttgactgcaatattgcatataataaaaaattagaatttaaatgttcatcaatatgggattggtcaaattaccttatagcatttagtgaagtgttatatagccttaagaaagatgatattgatttggatttgttgatgtggaaatagaaatttaacaaaaaaacagattatactccatcctgctgtggactcgtctgtgtttatgtgtgggttttttgttttgttttgtttcgttctgtttttgttgtttgtttttgagcagagtctcactctgtcacccaggctggagtgcagtgatgctgtcttggctcactgcaacctccaccccccaggttcaagtgatactcgtgcttcagcctcccgagtagctgggattacaggcacacaccaccatgcttggctaatttttgtatttttagaagagatggggttttgccgtgtttgccaggctgattgttttgttttgttttgttttaaatctatgtaaagaaaaagctgaaaacaatatacaggaaaagagacagtacatcaggttgaagaatgcaggctctggagccagactgcctgggtttgtatctgggctgtgccacttacatctttatgacttgggtaacccaaattaatctttctggggatgtttcctatctggaaagtggtgatgatattaccttccccataggacagttgtgaggtctgaaggtgttaatacctgtagagcatatagaacagtgcttgtgattaagttctcagtagatgctggctattaagaggaggaagcaaaagattaggagagaattttagtcttatctctcgttttattataaaaattttagtatgaatgttacgattttataattggggtaaatagtgaagcttttccattaaaactaaaaacaatgaagcagacaaagacgtactaagtatctttgcatacatgtaggagacctagaactctaagatgctctctttataggtaaccaagcatttcctgctgcagcctagatatagctgacaactgaggcttgtcttttgacaagcccctattccttgttgtaggagaatttcattcttctcaagatctgtacagatcctcaggaacttgcattgttaagcttacttctggctaggttcccaaggccttcatcttacttttgccctagctctttgggtgtgtctcttccctctgctctgcactgcacagaatcaaacttaagccccatgccttttaaaaaattactgaaaaatgacatacttgtttttttagtgggctgcaagtttcaagatttttattgtagcatagaaaaattttagaatgtagtcttagacagttttttgaaaagtcccttgaccatgttgcctttaggaacttgtcactagctgccacttactctacatttcaacctccttccacctttcttgaccctctcaatgccttgtcttagtttcttaggcagaaaagtttttgtcttacttagttacagagacactaatgtgctgtgttaaaataaaaggtcttattagttacatttaggaacctgctttggttccatatttttgtctatcttttcccctttcttaataattctctgggagtggaaaaagggagtaaagattgatttctttttgctatgaataatgctgttctttgaggaaggcagcagagaacctctggtcagtatttgttttaaatatccaagtttaaaccattctacactatattatgttagtatcactatttaccaataatagaaaccgagcattttctacctgtaaagcctccttcctcctccttccttccctccttcctctccctccctcacgttttatctatagattgttcacttgagcaactgagttgaaaactgcataatgtatttagagttatgaacttggagtcagaatatctacctgactttgaatgtcacttttgtcactttactagtcatgtgcaccgtttgacagtgattttttttctttgtttaactgaggagcgtataatgatttttgcagatccctttcagttccaaacatcatgattctgatagcagaaccttgcattctatcagatatgtatcagttattgttcttcataggtcttgaagaaaatgatgctatatgccgatttgttcacgtgttcttaaacctttggccgaaataaatgcctacaataacaatattttaaaaatttaatgaacatgaaagtcttgttgaacatcttcttctaaaacatcacttttttttcttttttttttcttctgtttttttgagatggagtcttgctctgttgcccaggctggagtgcaatggtgtgatctcggctcactgcaacctctgcttcctgggttcaagtgattctcctgcctcagcctctagagtagctgggattacaggcgcttgccaccacaccccgctaatttttgtatttttggtagagacgaggcttcaccaggttggccaggcaggtctcaaagtcctgacctcagatgatgcacccgcatcagcctcccaaagtgctgggattacaggcgtgagccaccgggcctggcaaccatcacttctgtatatattttagcatagaaatattcttttgctaatgctcttatactcaagtaccactaaattatttttttaagtgggtaatatgcagtgtggcaaatgtgtatgtacaaagactttaaaactcttaatgcagttgcataagtaaataccatatatagaaaatttcttaggccacaggaaattttaatgaacttgcctatttcaggaagttaaaatagaactaaaacttgccctgagttaagaagtggcaatcagtcagttaacaaaaataagctttgaaggatagatacagttttgaaaaaggtgtagcagaaactagcacttactaggtgtttcttacatttgaattacacagccataactttatctgttaatcttcacattaacttgaaaggcaggtatgttgtacttttcaacacttaagtaacttgcttaaagtgatgccacagtggcagaacccagtttgtttctaagtgctgctgaggtgattcttgtaggtggagatacaaacgactttgagagaaggggtaaaataccctggagaatgagcgtaaagtatgatttctgaagatgaatgagtagattgggaatagaggaagatagagtgagaaaggtagtttagtatataaaggagggaattgaatgccagcctgtgggagttgacagttgagatatattttataagttttgagccaggcaaatgactggataaaaatagtatttaaggaggattaatctggtagcaatatgcagaaaaaagtcaaagaaagagtagagggagtcagtctatggaggagattgcatatggtgacatgactgagtcaggagagaggtacaaacatgtaaaagaaactaaagtagaaagaaaaggaccacaaaggaagggagaggcaataataatttgtaaatatcatccagtatttggatgaatgaggaaatgtatcactgacaaatagaaagtggagctttcaaataaccactaaacctgtgaaaggaagataacgctttgcagtttcttaacttagaatttaaattcagcaaatatggatattgtcatttttgatgtcacttctgattaagaaatagaagattgttagagtatcttaatagatgattgatttcttatctgaatttccaataatctacatacatagtaaaagtggaaattgaagtttatcattactgatccaattatatcattaactttcaccagtaatcttattgatgtctaattgtagaagtcattgaatgaactcatcataataaaaatgaattcaatttagcatccctattaaagttttgtaatggctaatgggttatgttggaattgattaaaattatagaaagttatatactataagtaatggaaattataggtcttttcccaggccattcattttttttttaattattataaatcttttgcaggtgtgtacttttgagaacagcttatccttaaaaatgtttaataagcagccatagagtacttgatagtatatgggatgctgaagaatttaaagagattaaagtccacccagatatagtttccttgaagatatagaatctaggaggaaaggctctgagtaagtaatgataaatggagctaagcatggtttcattgcattttaatttcaacaaacgcttacttagtatatactaagtgcaaggcataggtgaattaagtggtgatatctgctcacctaggatatcagtttggaaaaggtggctaaaaatggaattcaaaactgtcagaaaggatttggtcagagcatgagttcatcaaaggctattattagtgaaagaatgaaaaacttggtaaaattgacatgaagagcttgcctgagtggaagagaaccatacgttttagaacattcagctttctcaaagtatgaacactttccaacaaaggatgagtttcctaaagggaatatgtgtgcagtttgttactcttatgatattggaaataacgaattttgcagagattcttccagaaggcttacttttttggtgtgtgagtgaaaatatgaatggtacttaattggtttctaattgttttgtgtggattttgtctttgaattgactgacatttataagtgctttgaaaatgtgagtacaaccttttctttgattgattcaaatttttatgttatgttaaaatgcccaccaaggagtaacatttactagacttcttactgtgtattgggttatattttgacaacctagcaatactcgttttcctcatgcccagtcattgagcatcattttggtttccttcactataccatgcctgaaaatagtccaattttccacccttctaagcttaagacttaactcctcttaatccttcaggtatttgtatagtagagtgcttgtcagtagatgtttatcagcttatagataatgtctctgctgaaaattatttgtttcaagttctgtgaaacaaatacccaccgaagaaagttaatttcaagttaaatttactttacttgattatagaagaagggagtaggatgaagtacctgggagccactagaggactggagaggcagtctaggttgtagttgtagagggatggatttgagagaagcttatggtggtttatgctcagagtaacctggatggataagatatatggtggtcagaaagaattttttgtttgagactgaaaagtgtttgatctatagatttaattcttaaaaatttttcttaagacaaagtgagttgtttttatgcaattggattaaaagataactaacttccatgtaggtacagtgaaaataaaatggctaacatttaaattcagtagccaaatataattgttattagtaacttttttttccatttttgatgggctacaattatatttctaattctgtttactgcataccagatttaacatattcctagggttccacaggaatggttaaaaatacaggtttcaagatgagaacaaattatagtagttgcttttcattgcatgggttttgacctattacttaaatcatctgatttgtgagaatatgaaaaatctatactaattggttttgttcatttttatattgtaaaatttatataaaaatttaccattttaactatttaagtgtataattcagtggcattaagtacattcacactgtcgtgataccatcaatttcttttccatccattcagaacgtttccatcatctcaaacagactctgtatccattaaacaataacttcccattctccacttcccatggcctttggtaacctgttttattttctgtctctatgaatttgtctattctaggtacctcatataaatggaatcatataatatataatatatgtccttttgtggtacactactagattttaaagaaacgagttgcaataattatagttgaacataagttttgtgtatgccttagtctgttttctgctgttgtaacagaatgctacacactgggtaatttataaagaaaatatgtttatttggttcatagttttggagactgagaagtctaagatcaaggggcctcatctctctgtgagggccttcttgcagtgctataacatggcataagggcagaagacagaagcgagcacgcaagacagagaggaaaagggggccaaattccaacgataactagcccactcccctgataacagcattaatctagtcatgagggcggagccctcatggcccaattaccttccgaaagcccccacctcttaacaacaccagacttggaggggacattgaaaccatagatactttatagatgttttgtatttaaatctatggtaggatgtgctcattatccttttttgttgcttagtgcatgtttgagtgttatagggagtattacatgaattatatgtgtacttcttccatactcttttaattggatatgccagtgtgtctcagtaatttccagtggctgtaaaacttgagaaattttgtagcttttagaaaccacatacctgtattgcctgattgcttattaagtgatctcttagaggtttccaaagttatgagtttgagtttacaagtgcagtttttttccatgaaaatttcagtggtgacaaattatagaatttatcattcaattcagtcttaactagaaataattgcatataataaaacaggttcttgactgttctttttgtcagtgtttaagaatagagacaaaataaagttagatttgagtgcctcagaagatattagaaaatagagataaggtttatggcctttaaaaaattaaagacagtattgggggaaagaaatgaaaattgggaccgggcgtggtggctcactcctgtaatcccagcagtctgggaggccaaggtgggtgaatcacctgtggttaagagttcgagaccagcctgaccaacctagtgaaacccccgtctcaactaaagatacaaaattagctgggtgtggtggcacatgcctgtaatcccagctactcgagaggctgaggcaagagaatcacttgaaccaggagatggaggttgcagtgagctgagatcacctcattgcactcccgcctgggcaacaagagcaaaactccatctcaaaaaaaaaaaaaaaaaagaaatgaaaattggactttttagatgggaatatctcagatgatatatctgtgtatctagaaaatgtcattatttaagatattctaaatggttatgattaaaaattatttcatggtataaacttcaacagagagcattgggcaaaatttttactgttcctgtttttaaaagttcaagtcagaatgcctgcttgttaccgaatcatccaccctgtgtttgcctcaatactgccatctggtgattattatagagatctcaacagggtgcttaaaggagatgtagggcaaccgacgacacaaggtacacaatattggtgccctctgcctcaaatctccctctgcttttgagttgctatggcagaaatcttacttagttatggccatgaaatcactttgtgagattgctttgtaaacaatagagcatttctgtactgctgtgattattactgcactacacatggctttttatcaggctcatacccaactcattgttctttctatgtaaggtactcttattatatctagttctacaaggtaattcaattaattattcagtaatacttattgagtgacttctatatactaggcattgtttttatttttatttttatttttattttttttttgagatggagtctcgctcttgttgcccaggctggagtgcagtagcacgttcttggctcactgcaacctctgcctcctgggtccaagcgattctcctgcgtcagccttttgagtagctgggattacaggtgcctgccaccatgcctggctaatttttgtatttttaatagagacggggtttcaccacgttggccaggctgctcttgaactcctgacctcgtgatccacctgcctcagcctcccaaagtgctgggattacaggtgtgagccaccgtgcccagcctaggcattgcttttagtagtaagaatatggtcctaaaaaacaggtgaaaatcagagtcttcatagaagttacatttagttaagaataaataataagatatacatacacacatgttaattagtgaaaagggttaaggggaaaaaacaaagcagggaaggaacttgtgaattattggggttggtgggttgctttgaaatgctagatggggtgttcaaaaaaagccttactgagaaggtgacttcctgagtagagatctgaaagatcttgggacgaacattctagatatagaaggaaagcaaatgcaaaggccctgtgcctgtaaccactgccttgaaaacctaagcaaggaagctggagtggagtgtagagggagagagcaatagaagatgaggtcaggcaggtaactgagggggaaagcaggggagtacagatcacacagtaccttgtagttcatgtggcatttaatctgagatggaagcaattggactggagagttgggggcagctgaatgacatgctttgatttaccttttaacagattcactgtggctgctgtgtttaatggtgtgtaaagtcatttgctacaaccttttttcttttattagttgtaggaacaggtttactttatatagatcatgggaacaataaggtataagaaagaagcttggataggtctgagagaaatatatggcatattttctgtctctgcacagatttttgcactgattatcagtagtttttgtctttgtgatacagagcaattgaaatcagcttgtagagtttttcttggaaaatgctttgaatatctcttctatttttcctataaccaccttagtgcatttcagattcaaatcttatggtgaacccaatatagttttagccctacctcactggttttcatgctcattaatagtttgggaatgagagtgacctggagttataatttttaaatgcttttaacaatatagtttggcatattgtaaaacaaatcatggtgtactgattagcagtgctatttgaccaataaattaaagaaaactgatagactgtgtcttaacctagatgatttatttaaaccatttgttgctgtagctcatcagctgaaatgacttaaacccccaaggtactgttactctttcccaaattgcacttaaaaaacaaactgaaattatcacttagttaaaatgtcatgatcattgtcagtaatagtatatctctgtggattcactttggtttggtagctgaaaagtttattatttttatgcttggccaaagaatatgcatcttcagtggggagcatgccatgtgtgactgaaaactgtttttatacagcttgactctgtttggaataacgcctttatttggcttaacaaattgcttttcagctttattttcacactgtaaatatcaatattgtataaacttgtcattattgggactaatcagcaaattgttttgtgtcatgagtaagcacggtctaagactgggattatttgataagtgctagaataatttggttaaactgtctatccagctctaagtaacaacacagccagttggtctgaatcactgtgcctcaacccttcactttgatgaataggtttgaatggctgaagctaatttggtttggggtagacaaagtctagtaatgtgaaactgatcatatataaaagaagtgttaacagtagtaatattacagggaatatacagggacatagagggacaattttgctagcggtttcttagttatgattttgaataccatttttttttgcagttagaaactttactgtcttgttctggatgataaagacacatgtttgaagacaggtttcctatgctgaagaataacaataatttgttttccagactttctcctttttttcccttttatgtttgcttcgttaagtagtaataaagtgatctaatctgtccctgagaagtatagtagattggccaagtactttgctatacttaaatatgttaattttggtaatttagtttgagttgcgatactgttctcagtcttccctctagcttccctgtcctaaagtaggcttctcttcagtgattcctctaaacccaactttgttcctttttttaatccagactgctaaagtgatacaatgagctttatatgtgaacctggtactgtgacctgccattcataggtcattacattgaattgtgtacatatccctcgaggagaatgacttttccatgctctcacccctgttttataaaagatggtgtagtggagagaggcccaggaagaagagttgacacatcatttgatcttcactgcctctaataggtccaatctcttttattacatttgtcttctcttctacatttaaataggtttagtctttcccatcttgaacacttagaatacattaaaacctattgcaatttctttttagctaccttttgtctgctctctgtccgttcatggcagtttgttggtcctgtgactttagttcttattctgtcactgacaagggctctctcacagtgatgccttcaactatttctcagttgcagaatctagtaaatacctttttttttcttttttttttaaagacagtctcgctctgttgctaggctggggtgcagtggcatgatcatggctcaccgcagccttgacttcctgggctcaagcgatcctcccacctcaccctctcaagtagctgggactacaggtgctcaccaccgtacccggataatttttgtattttttgtagagatggggttttgcttgttgcccaggctccagtagatactttatctttccaaaattgattattgattactttctacttgttgaagttcttgtgtcattacttcttttgtttctgttttctcttagattggtcctttgtggtctccttttttttctcaggtgctcctgaatgttggtatgcttctctcagtctttatcccatttctgtactcccctctccttactttctacccttttctgccccctccacgttctgagtgctgtcagttatcacctgtatgttgatatcttttcagtccatcttcagcctgtttcctaagttccaaactttaatgtccaaatcactattgatgtttcttgaagaatattccaaaggtaccatggtcctatactatattttttgattaatttaaatttaactctaattaaaatatacatacagaaaatgcacagattataagtgtacaccttaactacacataattaacatccatgaaaccaccatccaggtcctgaaagagaacattaccagcacctcagtagtctgtttacaattcactactgtttccttcctttccaaaggtgaccactttcctgacataacaatgtagaactatatttgaacattacattaaaaaaatgtacaggatgtattcttttttctgttctttcaatatagtttgtgatattcatccatgttgttggcagcatttgtttatttttattactgtttaacattctactgtatgaatacagcacagtttatctgtttaaccacctaattatttgggtaaattttgtttgaataaaatgtattattatgaataatgctgctctgaacattttggtgtatgttttattaatatgtacttcaattgtgtatatagctaggagtggaagtgctggatcatgtggtatggacatgttcaattttagtagataacgtcaacattttcaaattggtcttgtcaatttatatttatattcctgtcagcagtgcatgtgttgttccacctttttttttttttttttttttgagacggagtctcgccctgtcacccaggctggagtgcaatggcacaatcttggctcactgcaacctctgcctcccaggttcaaatgattcttctgcctcagcctcctgactagctgggattacagatgcccgccaccatgcccagctaattttttgtgtgtttttagtagagacggggttttaccatgttggccaggctggtcttgaactcctgaccttgtgatccgcccgccttggcctgccaaagtgctgggattacaggtgtgagccactgcacttggctgttgttccactttttaatcaacccttaatatcagtggtcttcataattttagccattctcgaaagtctattttcttggtgactaatgaggttgaacatctttccttatgtttgttggcctttcatgtgttattcatgtattttctgtgggaaagtacctgtggaagtctttgccatctctgttgaactgtccgcctcttccttactgcaatgtaaaaagttctttatgctggatatgggccatttgttggttaaatttgttgttaatgtcttacattctgtggcttgccttttcattttcttagtgctgtcttcccagtctcttgtcttccttactatgcttctctccccaaagcaattagccatcaagtcctgacaattttatcttttaatatcttttatcttcttttctccatttctttgctcagcgccttaatacagtccttctttgctcatggcctggattatagatcacatcccttgcaatcagtttttaactgcttacagaatgacttttctaaaatttaaatcttggccgtactattcctctgcctaaaatctcccagttgtaccttagaggctacagaataaagctcaaatctcatgactggcttctaccttcttcctaggccttctttagagttgttgggtttttttttttccccagatttttactgctggataaagtctttcctgacttacttccccagttcttttttcatactcctttttgaggaaaggatgtggtagtcttaattatgattaagccataattattaagacaactagccgttcatctctcagtctcttggctgagcactactgttagcttatttgtgttggatgttttgatattggtgttccacccaactctctcattaatctgtttgcttttctggcttattctctgccagccacttaattattggtattctcaccttagctctcttcttcatacctttctccgtgagaaaactcatcaattctgatggctttaatgccattttgtatgtatatgacttctagatttttaaatccagaccagtctctgtcttaaatttcagatctctctgtattatattgtcagtgggtattgctacatgaatgttacataagtattttttattttttattttagttatgttatgttacgtcacgtcacgtcacgtcacgtcacgtcacgtcacgttacgttatgttatttttccgagatggactcttgctcttgtcacccaggctggagtgcaatggtgcgatctcggctcactacaacctctacctcccgggttcaagcgattcttctgcttcagtctcccgagtagctgggattacagatgcatgtcaccacgcctggctaatttttgtatttttaatagagacagggtttcaccatgttggccatgctggtctcaaactcctgacctcaggtgatccgcccgcctcggcctcccaaagtgctgggattacaagcgtgagccactgtgcccggctacataagcatttttaagctcagtaagccccaaactaagctcaccttcccttcccaaatctgattgtgtattttctacctttttgaacacctttttgaacctggtggggctgcctgttaaatacttctggaaaaacttaagtcaaagggtacttttgtgaaagtacctccttccccactttcctcctgttttctattactatagttctatcatggtacctacaaacattttattgtactttatctgttctccccagtagactaaaagcatctcgatactttgtccttggggaagcaagcaaatcaatgaaccaatgaatgaatgcatcttgagggttttccattgccatcctgcacagtgcctagcataaacagttgagaggtgactgagggtacctccaactaaacacatttaaaatggaactcaccagtttcctccaaattgctttcctccaaactttctgctttaaaatgacttgctgtgcacagttgatagcgtcaccatcttttcagttcacttagtcatatttaactcactttgtttttctgctactctcaaaactggttttaagcccattgctatttcttctatttcatttccttagctttggttcaagttctcatcttgtcttcaccagatcattgtaaccactgtttaaatgttttacctatctttggagttttccccgtttgtctttgatattgctacaataattatttttctccaagtgattatctcctggttctgtaaacttgcctataggataaagtccaattttaaaaaaatttattttcgttttaaagctgtatttaggtataattgatatataaaaagcaaatatttaatgtatacattttaatgagtttgagagtccaacttctttaccttcggtggcagtcttcacgaacttatctagcttctttcttttattttttttcccctcccttatagcagaagctatgtgctttaagcattggccttaccagactgcacacctaagtctatgctacttatactacctctattgccttctctccatcactcttaggaggaacatagattaaacaaaccactcttaacatttgttagctactgtccttggacaagtttctaaagatcccaaaacataatactgatgcttagtacatgttgttttcccctttcaacctttcccttcctccacaccacagttggaatttctttttcgtactgctagaaaacacttactgtttctctcacttaatgtcttctgccgaggagtcactgtgtctgtttacttgtatatatcttactgctcttgtactagatcacatgctttttcagcgcttacactgtgtcttcttgaacttattccagttgaatttttcaatcttaagggtttgctttttaaaatccacactgtatcatttaggttctaagtgatgaacatgactgggataggattttttggagtaaagtttctaaatggtcataacaaggaccagttgtaaaggcccagccagagcaggctttgtaaaaactcacctacttagctggaatttaggagagtaatacaattgtcctaaacttactctggtaggaatttaaaactataattttgatgtctttgtagtaatactaaataaaagtattagtactggaatgaattgtgtttttcttcacagccggttgctgaaccaatccccatctgtagtttctgtcttggtacaaaagaacaaaaccgagaaaagaagccagaggaactcatctcctgtgccgactgtggcaacagtggtatgtgatttccttctgtttttcttctaaaatgtgttacgaaggcaagcggaaagtatgttgacttgagtttgtatccttgatccttatgagattaatacagtcatacatcttttaattatgggggataagttctgagaaacatgtctttagaaggtttcatcatcgtgtgaacatcatcgagtgttctgacacaaaccaagagggatggcctactacacatctgggttatgtggtgtagtctgttgctcataggctcaaacccgtacagtactgaatattgtaggcagttgtaacactggtgaatatttgtgtatctaaacatatctaaatgtagaaaaggtacagtaaaaatacagtagtatgaccttacggggctacagtcatatgtggtctggttttttgttgtttgtttttgagacagagtcttcctctgtcacccaggctggagtgtagtggcgtgatcttggttcactgcaacctctgcctcctgagttcaagcaattttccagcctcagcctcccgagtaggtgggattacaggtgcctgccaccacacctggctaatttttatatttttagtagagacaaggtttcaccatattggccaggctggtctcaaactcccgacctcaggtgatctgcctgccttggcctcccaaagtgctgatattacagatgtgagccaccacacccggccatatgtgggctgtatttgattgaaacgtcattgtgtggtgcatgactgtattttaatttgattatggttttaggtgactgagatgagcttctgtactagggagggatttgaatatatagctgaaatgtgtaattcagttaatttaaatcaggtcttagtttttttttatatatataaaacactttctgtgggtttattttttcctcttggtctttacatttcagtatttaacatctgcttaaatcacagcaatcagtttgaagttattgctggtttctttaataatcgctacttcgtctttcttgatttatgcctcaggcttgatgaatagaaccaggatgataacagatttgtttttcttgatggaaacttacatatgtcacattgggaaatagtgttgatactgcagtctagcgagcaatgtgaaattctaggccctaagaaagattttgcagaatctcctaatttgccagttccagagatattcttgctctacatttcaagaactcacaagatcggccaggcgcagtggcttacgcctgtaatcccagcattttgggaggccgaggcgggcagatcacaaggtcaagagatcgagaccatcctggccaacatggtgaaaccccatcactactaaaaatacaaaaattagctgggcgtggtggttcgcacctgtagtcccagctactcaggagactgaggcaggataattgcttgaatccaggaggcagaggttgtggtgagctgagatggcgtcactgcactccagcctggcaacagagcgagactctgtcttaaattaaaacaaacaaacaaacaaaaaaaaaacttacaagaccttacaggaaggccttagcaaaccagcattatctttgaccattggcttaattttcagtgttttatagtgataacaaccatgatttagttcagaaaacagaaaccacactacatacttcaagaggaaggaagttaagtataagaattaggtatttgtgaaatcattgtcagggctgaagaagcaagctggaggttgggctttaaggactgactctggggtcactgcagaactgacccatctgaggagttactgtgtctgcctctatctggaagaggtgcaagcaggggggagtccactgcacaacagttgcgctctgtagttggtgctgaagtgctaagtttggccatcattacaatagctctagatacctacgagggagaagcatggatacggttgttaccatgactttgcttatcattagaaaatagtactaggaggaggatgatctttgctttgtttttacctttcgaatatccctggagaacacatccacttgtcagaacttagagcctagctgcaaaggagtcttaagaagtatgattttttagcttttcagtttttatgcatagtagaaggtgagaacagatcttgagtgctaggtagtcatatccagcgtgttgtcacaaaccagaatgaactctggatggatttcatagttaaatataaaccgtaaatcatgaaagattagatgaaaatataatggcatgccatacaatgcagttatttccaaattccctaattaaaacccaaatatataaaacatagaatgagttgttctaggtggggtgggaatgaaaccgaggagaggaagtgttgtgtctgcagccctgccgtctaagtagcattatatttgaggtggtctgtgcgtctctctaagctaaggatgagcataatttgaaaactattactgtagcggtaactttttttttttttttttgagacagtctcactctgttgcccaggctggagtgcagtggcgtgatctcggctcactgcaagctctgcctcccgggttcacgccattctcctgcctcagcctccggagtagctgggattacaggtgcctgccaccacgcccggctaatttttggtatttttagtagaggtggggtttcaccatctctacttcaccaggatggtctcgatctcctgacctcgtgatcctcccgccttggcctcccaaagtgttgggattacaggcgtgaaccactgtgcccagcccctgtagcggtaacttttaaagaaattgtagaacaattaactactagttatctgttgctgcagaaataaattactctaaatcttagcagcttaaagcaacaaaacattttttacttcatactgtttctgtaggtcaggaatttgggagttgcttatctgggtggttttgacttggtatctttcatgaggttgctgccaagattttaactggtgctgcagtcatctgaaggcttccacgatggctcatttacctggctggcaagttgctgctgccacgggcttgtcgacaagaagcttcagttccgtgccatgtggacatcttcacaggactgcatgcatgcctgcagcatggcagctggcctcccccgatgagtgtctgagagagagtgaggtggaatctgcagtgtgttttataacctggccttagagtcacactgtgttatttcagcaatatcttcttggttatgcagatcaacccagttcattatgagagggagttgtaagagtatgactagcaggaggcaagaatgcctagggagcagcctggagactggctgtcacaatagccaaagaagaacagcatgggcatagctggatacatgaacgttgatattttctaaattaaaaagtaacatgcttaaagtagagcaagaataatttgggggaaaataactgctttaaatatggcaaagggccaaaagctatataagtataaagaacatgtttacatttctaagcatgaagtccaaagagcagagcctgtgaactggcaatttatatgaaagaaaactaatagttgagcctatgaaaagtgttttactcaagtagtaataggaacacataccacagtagcagtgaagtatcattgtatagcgtttataataatcacaattgaaatataacagacctagagctcatgtagttgtgctaaaacacttgttcttttgctggtggcactgcatattatatcatagtttttggaaaatgttttggcagtgcatatcaagctataaaaatgtttaatacatttgactcaccaatcccactttcaggaattcattctaagggattaaaagaagtaaagaatctgtaaacatgaaataattcattttagtgttccgtagtctcagtatttaacaatagggaaatgttcatgcaggttatagtatatcagtcagtggaatatgatcagtttaaggaatataaagtttacttaaaatttaaaataaaacaaaaactgtatgtttgctaaaattacagtcatgcagagctttcagctagtttaaacaggaaagtctaacataaaaatggctattattctaggatgataggattgtgggtgaaattttcacacctcttggattttccttcagtgttagtgatgttttgataataaacttgctatctcataaaagagaaaatcctttaggaatagaaaagagaggagaagatttaacaagccctttctctcaccaaagaaaaataagcacgaccaacttttagaggagagggacagctcttttcagttgaggggaaattggctacccttaatttttgagaatcagactgataactgactcttggaagaggaagcatttttttctcttgctattcattctgagcacagtagaaatactgcttttggttttagttttagcttgcatgccttaaattgtgagcagataactcactttaagtgatggtatttttattatatacaggagtcccccttattcttggaggtttcaagacccccagtggatgcttgaaaccttggataaaaccgaactctgtatatggtgctatgtttttccctgtgcatgtgcatacatacatataataaagtttaatttataaattaggcacagtaagaggttaagaataatagataacaaaatagaacaattataacaacatgccaccatcactagttttgtgctttgggaccattatgaagtaaaataagggtgactccaacacaagcatgataataacactagcatggtgataccagcaacagtctgataacccagacaaccactaagtgactaacaaatgggtagtgtatgcagtgtgggtgatcgcagcccagctgggacagcagatctcattatgctactcagaacagtgtgcggcttaaaacttaggagttgcttgtttaatattttcacactgcagtagactgtgggtaactaaagcctcagaaagcaaaactgcggataaggggactaactgtattttttaaattacaaaagtaaaacattgtcatttaaaaaatgacagcacaaaagggtataaactgagacataaaatccttcttgatatatatagctcagttttctaggatgttatcagtgtaaacagcttttttgtatattcagtaatgcatatatgagcatttctcatatatgaacatatatgtattcatatatatacatatataccggatatgtacacacataatgctttgatgtaggcttaataaaagtttggagtttgtcaagttttttttaataatcaaattgtggggaggggtcctaacttctctttaacattaataaaactgaattgtggtgccaagtcctgatgagaaatgtgtggcaggcttcctggtgcatcttgctttatttgatatatattttgtatttaagatgattgcctttttctacatcatttctttagtactataatagcaaaatagttcttgattgtttcattcatgaatgttctccctcgtattaggccatccatcctgtttaaagttttcccctgaactaacggttcgagtgaaggccttacggtggcagtgcatcgagtgtaaaacatgcagctcctgtcgagatcaaggcaaaaatgcggtgagtatctctgccttctaatatgggtgtttcatttagtagtagaatgtacgaccagcattttcatctaagtatgactggttatttttcagacacttggtccagtagcatttagaatagccggtagtctctttaaactacatgtcattagtttagaatgcttgctaatttagacttcagttatgtctaggtaatttgtaaagcacttaattatatatttgcagagagactaagccacattaaagaaatactccccaaatttctttgagcagtacagaggcattcatttaggatggtcagttgatatattaattacaagtcgcccttttctcattattaaagcagaccagggttagcttatttctggttattggatatacttgaaactaatgaaactttagttctttatcaaagattggctggaacataactttttgctaactctatttacatagttaatacaaattaaggaaacttttaatattatggtcactcatctcttttatttatttatttattttgagaaggagtctcactctgtcgcccaggctggagtgcagtggcacgatcttggctcactgcaacctctgcctctctggttcaagcagttctcctgcctcagccttctgagtagctgggattacaggcacatgccaccatgcccgtctaatttttgtatttttagtagggacagggtttcaccatgttggtcaggctagtctcgaactcctgacctcatgatccacccgcctcgacctcccagagtgttgggattacaggcgtgagccattgcgcctggcttatctctttttttaagatccctgaagctttctaggttttatgcagtcatgatcgtaacatgtttctgcttcataaggttaagcaaaactgtcctttcttttttctaataggataacatgctcttttgtgattcatgtgaccgaggttttcacatggagtgttgtgatccgccactcacccgtatgccaaaaggtgagaaatactttctgaaataaaactgggaatataaaggaggatgttagtgaaagcacattttatctactttgttaaatgaaataataattggatctttctttttgaggttgtataagtaggaagagaactgtcaccttaaaaggtggggggatagtctttctgagtgggcatcttaacattcttacatgatacggatttattgttattttcaatatctaggcatccatcaatggtgaagtggttcatttatacatatttgccagtctctagctagaagataaaatacttgccttaaatatatcttgaaatatctctttattgaaaggaggaaataaaatagtattaggtcgtgttgattatatcactgcttagcacttttgagggccctagagctatagagatatggtttattcaaaacttaaaaaaaaaacctttttatgaaatactttatgaaataaaaaggttttttgttgttgttgttgttgttttaatgaaatacattctgaacaaataagtgtccagattgtaagggcgcagcttaatgttactcttttcttttgattcctgttcattgagaggtatttagtttgggcatagttgcctcatggttggacttccatattcatatgcttataggttctttaaaaaaaacttcagccagacccctctttttgtcctatcacaaattccattttaactctgattttataatttataggcttcttaagtaaaatgcctataggatatttcataatatttgtttggaaaaaaatttcctgttgatagaaaatgacttaaccgtactttgtagtcatgttaacactttaggtttttacttgaattcacttattccaccccctcacccatggagtctcactctgtcgcccaggatcttggctcactgcagcctccacctatcaggttcaaagcgattctctgcctcagcctcccatgtagctgggactacaggcgtaccacgacacctggctaatttttgtatttttagtagagatggggttttgccatgttggccaggctcgtcttgaactcctggcctcaagtgatctgttcgcctcggcctcccaaagtgctgggattacaggcatgagccaccgcgcccagcctgaattcacttactgattgttactttttgaaacgtcttcaatttataaatactaaagaataaatacccactttttccatttatgtgaagtctgagcaaggggccttctaagagtcctaagaaaggttttttttttggagttggaatctcactctgttgcccaggctggagcccaccttggcctcccaaagtgttgggattacaggcgtgagccaccatgcctggcttgcagctaatgttttttgtagagatgcagtttcaccatgttggccaggcttgtctcaaactcctgacctcaggtaatccgcccacctcagccccccaaagtgatgggattacaggcatgagccactgtgcccagtcaagaaacatttccttaggactcctttcttgtgtgtttaacttctacaaaagagattatatagcagctttaggcaggaaactttttttttgagacggagtctcactctgtcgcccaggctggaatgcagtggtgcaatctcggctcactgcaacctccgcctcctgggttcaaacgattctcctgccttagcctcccgagtagctgggactacaggcacgtaccaccatgcccagctaatttttgtatttttagtagagacagggtttcaccatgttggccaggctggtcttaaactcctgacctcaggtgatccacccgcctcagcctcagtggacttcaagtgcagtcagtggacttccagtgcaggcttgaaggtgtatgtgagtctcttccaattatttgtagaattttgtgtgtatatgttttaatgtttattttggattggagggggtattcatcagattttctaatgacagtcttttacctgaaaaagttaagatcctgacttaagactatctgaaacctttcagtgtatttatgtctgtcacacttctatgtggaattttatttttttataggcatgtggatatgtcaaatatgtcgacctaggaaaaaaggacgaaaacttctacaaaagaaggcagcacagataaaacggcgctatactaatccaataggacgtccaaaaaacaggttaaagaaacaaaacacggtgtaagttgtacttgtggcaaggtgaggggagaaaaggatagggtcttctctatagtgtaggattcacttgttttctctatgaaaaaaattccattgtcatatctggcacttttatataataataatggctaacacttattcagcccttaataagtgccagacactattctaagtgctttatatgcattgaattgtttaattctgccaacaacccagtgaaatatagctgctgctgttactttcatttttcaaaggaagaaactaaggcatagtaaatgttgaactgggatgaaaatccgagtagtctggcaccaaagtctgactcttaaccattgctttatgttgcttctcttatataaaaacaggaaagaaaaagttgttactgtgacatttcacatgtcactctcctgatcttgtctcagttgttaatatctattaggtgtacaaatcactggataggttcttcctattgaggtgatggctaagtcccatttttgtgttctttggatgtaaaataatttgaatgttttcatctattagcagaaatcagaaattgtggactagaaagctgggctatgtctggaggaggtggggcaagattcagtagctagttttgtctttttaaaaatgtctgtagtaactcacctttgatgatatgtaaacgtcttcaggcttgtcaacctccctttattatcaaaagttttacttactttttttacacgtaagactatcttgaaggtgatataactgaaatgaatgggcattagcagcctgaaatgtacagaaccaatattgtagtctatattcaaaatcttaaatcaagctttgattttcctataaaatgatcttttgattcctggccttcgaagaataacccatccttgtgttttagagataaaagtataactttcagttggtgcagagatcacagtgtagtagaactttatacctggaaggatcttagttgttcttagtccagttctcattttacagatgaaggcactgacatatgtttagaaaaaatgtgatttgtccaagtcgtacagctagtaagagagaattatgactagaacaagtcttctgactcctggcctgtcattctttgcactataagtaggcttcctggcaatagatgtttctaataataatattaattttcattcacagagtactatttatagtttgcagaatattcttaataatatagattttaataaagctgtaggttacttactaattatatgttatgtattaaaaaggaaccttacaagtatcttttttaatacttaccctttcccctgtttaattgtttagatcaaaaggtcccttcagcaaagttcgaactggccctggaaggggtaggaaacgaaaaatcactctttccagccaatcagcatcatcatcatcagaagaaggatatttagagcggatagatggcttggacttctgcagagatagcaatgtctccttgaagttcaacaagaaaaccaaagggctcattgatggccttaccaaattttttaccccttcccctgatgggcggaaagctcggggggaagtggtggactactctgagcaatatcgaatcagaaagaggggcaacaggaaatcaagcacttcagattggcccacaggtaagagtttagaacagacttagaaacaaatagtattctgtacatgtattattcgggataacactaattatctataatggatttatatttgattattaacaattggttatagaatataagaacacattgaaaaaacatgtagatgatactgaggtgataactgtggcaggaatttagaggatggaaataaagttgcagaatgggacagtaggaactcttaggcaaaaggaagctgcttttttgtagaaccacaaagaatctgcctagagaaacttggggtgtaaccttgaggattactttacatttcacaaattactaaagaaatcatatggtgaatgttatgatgcctgcttattccaggaaggaaactggaaagaatagaactgggtgaaatgctgttgatctaagcataaaaaaaagaccaaaatatttgcagatgtgatgaggtcattgacttttctacttcagatcttgacaaatatagttgtaagtcatggattgcacttaaaaagggagagacagaaccacagctccaggctgcttatgtatcaggctaagttccctaattttcaaagtagaaaacatctgtggagaggacttaataatgtggcaaatcattcaagtcagaggagaagaatttgattaactgtccaataaattaaagcttaaaatagtcttattgctgagccttgaatttagagatactaaccctgtgaaggaagtagaaagggcttgaagaaagtagaatgagaatgaactcttttggaccacaagggccagaggtgtagtgtctcatctactacaagagaattccctgaccttggtttcctccctgaatgtctccttggtgagggagagtgtattcactgctctcattcgtggttgattgtccagtgcaggagagaaagtccttgtaattgtcagagtcccctttgtatgctttattgattggtcttttaccatagtgatgatcaactaattactctttaagcattcaagactcttcatgtctttatcaacctgtagataagttcctgatctgagcatgtttatctaagaaaatatgcaatccgtttagattaaactaggaaagaatctcagagcaaatcctaatgaaagacatttttgaattaaccatttgtactggagacggtttattagaagaatctactagaaagcttttgaaatagaaattgttagagcaagtgtatcaagtatatggagaaccaatattgaatttttgacagtggtgtgagcgtttgctttaataggctctgtcattttctttatgaattataaagtttaagtaccgaatgctgtattagagaggtgcatgcatcatgcactagggggcattaaagtcacatagtacctttagattgtacttttttcttccagtttgagaatgttgtcaacagtgagtccttgacttttttcttcttgtgttaagttaataacagatggcccatatgtgcagttgacttgagaactgtcaccaattggtcttttcagccatacttataaagagagcaaatgagcccaacagcagtgtcatcttcaaatgcaaaggataatgatcttcataagtcccaaatactctcttcactagttttttgccaacttgaggaagttccatcatttagtagataattatcatacgttttcatatttacccagatgattatcatctgggtaaatagagtttgtgctttaaaaggacagtgttttaaagtttgtgctttaactttaaaagggcacccagaatgtgatgggagttagtactgctgacatcagttaaggtagctactcaagaggtttttttgaacgttgatgcattaaacctatactaaaagtgtcaaatttatactatttcaaaatgaaatttatattccttatatcatttttctgtctgcctttctgtgtattaaaatgtaatctttaatgaagtttaaatttagttatataatatttttaggaagctttaagacaattcaggatttccactataaggcagatttaatacataaatattatttattgagtagcattcttctaagagtcagtttaatgctatattcttcgttatatattaagttcttcaaattgaaataaagacctgaaattttttctagttcatgtattaatctggggacagttaacatgtgagctctttttttatatgtagacaatcaggatggctgggatggcaaacaagaaaatgaggagcgactttttgggagccaggaaatcatgactgagaaagatatggaattatttcgtgatatccaagaacaagcactgcaggtaaagttggatattcaggttagacaatcaagcaacttgttcatggctgagaaacagcagattaattacattgtgggttaagcagtaacagcagtttgcctaatctcagaatagttgtggtttgtgtgtatatgtagttctgctgtttataatattcctttcaaacccatgataactgctttggttttgcagataagcacatggctttgactatcaatattaaataagcttggtttattttttgtcttactgtatgaagaagaatttgggatttgaccaaaaacaaacaaaaaacaagcttctcatgagtgataaaacacctatatttattaattcaagaagtatttcatgcctgtaatcctagcactttgccaaggtgggtggattgcttgagtctgggagtttgagaccagctggggcaaaatggcaaaaccccatctcaaaaaaaaaatagaaaaattagccaggtatgttggtgcacacctgtagtcacagctatttaggaggctgaggcaggagaattgcttgagctggggaaatggaggttgcagtgacctgagatcatgccactgtactccagcctgggtgacagagtgagaccctgtcttccaaaaaaaaaaaaattgcaattctttgtgacacatggcaagatcgtaaatatatagacagagtctatgtgccacatgctggagatgccagtgaatgactgaattctttccctgaactataggagagatttgtgaataagtaatgtcattaatatgaaaagttcaattatagaatacttgatgttttgggagaatagggaagccagcttctacttctgcctggggaggtcagaggaggattcattgaggggccttaaaggatatgtaggagttgtacatatcccttaaagggatatgtagggagttggttcttatataatcagaaggaacagaagtgaaggtggaatagacttgaagataggggaaaacatgcttaattgtgggaattaaaatggctcaggataaagaatatagggtgtggagaatggcaggaggtgaggttggaaaagtgcaggggctagatcataaaggctcttccagattatgttcatttattttttgtcttttccttctttgccaccaacaaatgtaccatgtaagccaagttctcttttatcttgaaaagaagaatttctaggctgggcacggtggctcacccctgtaatcccagcacattgggaggccgaggcgggtggatcacttgaggtcaggaattcgagaccagcctggccagcatggtgaaaccccgtctctactaaaaatacaaaaattagccggtggcacacgcctgtggtcccagctactcgggaggctgaggcagaagaatcacttgaatccgggaggtggaggttgcagtgagccgagatcgtgccacaccactccagcctgggcaacagagtgagactccatctcaaaaaaaaaaaaaaattctaaggctgatgccgagggttctagggaaaactcttcatattaagagacccagtggtggtgaatagactgttgatgtcggtcattatgtgagtacttttggaaaaataaaacagcagtacaaatactcagcacgcatttactcagcattctgctgtattatgatttaacaaaatattggctttgattcaggtggatctgggttcaagtcttgatctgtcatttactaacttctcctttgggcaggttgccctcaaagcttgtttcctttcatgctagtgagttattataggtactctagtagaaatctacatggacttcagtgggaactgaaaggaggcagtagttatgttcttcctgactgaaagaatttttttttctcctcccgagtaagttgcagacataatgtgttaatatccctttactcctaattttttgtgtgtatttcctaaaaacagaaatgttctcatacatgaccatggtccaatcatcaaatcaggaatttaacacaaattaagtactattatctaatttagttgtcacgtctctctagtctccttccaattgggaacagttcctcagtctttatctttcatgaccttgacagttttgaagtgcacaggtcatttatagaatgtcatcactttgagcttgttttatttttcatgattagaaaattccacaggtgtgctgtgtcctcctcagtgtgtcacatcagaaggcatgtaatatcca

SEQ ID NO: 15133 - DNA, 27794 bp, Human
aagcccgggaagatggatccagcttcaagactctgggagcagccacacctggtcatgggtctcctggactgagatgtcctcccaaacttctgaaccataaactacttttactcatcattggctccccagtgcccagcacagtgcctggcccttggagggtgataaatgaatacaagtcccctactaggctgtgaactcctttaagggaggcaccacttggggatcactacagtattgccccctcctcccctccccagtgcctgccacagtgacctgctgatgaccatggatccaaatccctttctcctcattagaagctctcagtccaaaatccgtggttccatgggtcagactgaggcccaggtggtccttatgggtgaatgatggagaccccaccaagctgagaactgggaggaatgatctccactgtttatggccaggccggttttttgcctttctgaatggcaacggcatatttcagcagaggtcctcagtagagccacatgcaggagatacatgcatttgtccactcgtcactcacttagtcatttgttcacttatatatccactctctcactcatgccttcagtcatttgattactcatctgattaattcatccattcatccaacattgtgcagaacattgaacaggtttagagatgcttcaggcacagtttttttacctgagagctcccagattggggcgagaaaggtaagagccatgaagacaaataatcatacagcagcttagcaagtagtaaatgtcatgagaaatgtacagacacatcagccaagggatacagagagagagatttctcccaactaagaaagggagtgatcagaggtagcttcctggaggaagtataatcagcaccagctccagaatttctccatggcgattgggtacggatggcagcttgtcagggaagctagtagctgcatcctctacagggcactttacaaaagactgaaagataggccgggcacaatggctcacgcctgtaatcccagcactttggaaggccgaggtgggcagatcacttgagctcaggagttcaagaccaggctgggcaacatggcagaaccccatctctaatacacaaaaaaattagccaggtgtgggggcttgtgcctgtggtttcagctattcaggaggctgaggtaggaggatcctttgaacccgggaggtagaggttgcagtgagccgagatcgtgccactgcactctagcctgggcaacagaatgcaaccccaactcaaaacaaacaaacaaactgaaaagtagtcagctgcccataccaaagattggggttataatggagatgaagaggtggttaaatctctcccaagtcccctcttgctgcttctgctttgtgtgtggtctagaaggaaaggttgcatgttctggatgggcacaactccctgattttccaccctctcactcatggggagggtgcagtcagtagaggttcttggtgggaacttctaaatctcagggccaaggatagaggcccctgcctgcccatagtaagggcttttacagtcaaccagggagataggatgaggccccgagccgaggcaggaggagcccctgtgaaggagggaacagaaatggcagataatagaatgcataggacttggagacagggtggacgtagctgccaacctgagctccatgtgtgcatttcagcctgagcctggttccctgaaaccttgccaggcgggcaggtgaggtgggtgcagccacctgcacccctggtgaaaagccacccaaatgaccgtactgctcggcctctcctctgccctcctccgcctgctcttcccaactcccagcccaaggcatctggctgggccgtgtgcagggcgtctggccccagggagaggtggggtgagctgcagactacacccacatggctataaatggggagcctctggctgctgctcactcagcctcccttccccagccgtgacagcactggagcctttcggacacctggaccatggaccccagggaatgtgtctgcatgtctggtgagtaaagaagccctccctggggtctgggaaccttggaccagcttcctacagggagcctgcaggtccctgatgaaaacttctcttccctctaattaggagccaccaatggggttcgtcctgggagccgacaggtggactggccacctctggggcagctcccactctctgttggctcccagcctgattttctagaatcgatatcctagctcagggaatggctgagagggggacttgcaaactttggtctttctagcgttggcccctaagggcagtcaccagggtgaggagaagagctctaaaccagaatctggcaacctggtttgggtccattgctgcggtcccctccctggcgcttattctttctggtcctcagtttcctcacctgtagactgaggttccttattcccagccaaccacatcccagagctgctatgaaagtgctaaaaccattaagcacctgcagatgtcaggggagttgtggactcccctaacttatgtggactcttgagtctctgaaactgcttaattccacggagcatgttagccagaaggagagaaatcagggttcaaagccatcctgggcttttacaatcatggaaatggtatgaagaagtctcacaagtctgggtggtgtggctcacaactgtagtcccagcactttgaggctgaggcaggagaatcacttgaggccaggagttcaataccagcctgggcaacatagcgagactccatgtctacaaattttttttaaacttagctgggcgtagtagggtgcaccttagtcccagctactcaggacgctgagaagggaggatcacttgagcccaggagttcgaggctgcagcaaactaggaatgcaccactgcactccagcctaggtaatagagcaagaccctttctcaaaaaaaaagaagaaaagaaaaagaaagaaagaaaatgaagtctcacaagactcccttgtccttaacaggatgtctctgtaccaaaaacttgcaaaagaggcagaagcttccagcattttgaaactcaaaatgaaaaatgggataatttttttaagtgtagatgatcattatgatataaaaacaaggtgctggctcccatctgtaatcctggcacttgggggagtccaaggcaggatgatcacttatgcccaaggaatttgagaccagcctgggcaatataacaaggccctgtttctacaaaaactttaaacaattagccaggtgtggtggtgcgtgcctgtggtcccagctactcaggaagctgaggcaagagcttgaggctacagtgagctgtgttcccaccatggtgctccagcctgggtgacagggcaagaccctgtcaaaagaaaggaagaaagaacggaaggaaagaaggaaagaaacaaggagagagaaagggagaaagggagaaaggaagagagagagagagaaagagagaaagagaaagggagaaagggggagagagagaaagagaaaagagagagaaagacagggagaaagagaaaaagaaaagaaagaaagaaagagaaagaaagaaagaaagaaagaaagaaagaaggaaggaaggaaggaaggaaggaaggaaggaaagaaagaaagaaagaaagaaagaaagaaggaaggaaggaaggaaggaaggaaggaaggaaggaaggaaggaaagaaagaaagaaagaaagaaagaaagaaagaaagaaagaaagaaagaaagaaagaaagaaatgagggagagaggaaggaaggaagaaaggaaaggaagaaacaaacaaaacaaggtgtggctctgtggctcttgttttgagttcactgacgttccttgacctttcttaaaccattcacagttttcatcttgacttgtgaaggtgacacgggtgtgaaaggggtttttgtttgtttgtttgttttaaggcagagtctcactccatcacccaggctggagtgcagaggtgtgatctcggctcactgcaacctccatctcccaagttcaagagattctcgtgtctcagcctccctagtagctgagattacaggtgtgtgccaccacgcctggctaatttttttttttctcgtagagatggggtttctccatgttggccaagctgatctcaaactccaggcctcatgtgattcacctgtcttggcctcccaaagtgctgggattacagacgtgagccactgtgcctagccaagagggtgtgaaaggctttgatagttcttagaggaaccttgggcttggaaacgctggcctcgtctgttggttctcattgtacataagaattatttgggttgcttttcaaaaatatggactccatttccccaccaagacttatgaatcagaacatctcaagggttggtcccaggaatctgcattttcacagttatcccaggcatgattgatgcagccatgccagttcccatccatggcctgtgactgtggactattgcagagtccttgacactgggtcgatgctcagcagccttgtcaccctcttgtccagccagtccccaaggatatagcccaggagccttgccactctgacagtcggcatcatgccttatgttccccactccatctccatcctcacgtttgtggtggctctgtcctgtcttctaggaggaatctgcatgtgtggagacaactgcaaatgcacaacctgcaactgtaaaacatgtcggaagagtgagtatggtgactgggggcaccatgggctgggagttagaaaagtccaatccaggccaggtgcagtggctcacgtctgtaatcccagcactttgggaggccgaaccgggtggattacctgaggtcaggagttcaagaccagcctggccaacatggtgaaaccccatctctactaaaaatacaataattagctgggcatggtggtgggcacctgtaatcccagctactcaggaggctgaggcaggagaattgcttgaacccaggaggcagaggttgcagtgagcagagatcacaccattgcactccagccttggtgacaagagtgaaactcagtcaaaaaagaaaaggaaggaaggaagaaaggaaggaaggaaggaaggaagagagagagagaaagaaagaaagaaagaaagaaagaaagaaagaaagaaagaaagaaagaaagaaagaaagaaagaaagaaagatcccatccccaccctcaatcctccagccatggtggattggggcttgtggggagggggtctagatgccttttacccatctgggagagatctgaaatgagaaccatgtagagacctatggcaggtctctacccagggataagggcatccacagtgtttggagcaggaagaggactgaggggaagttctgtcctgcccagtggtaacagggatagagcactggcctggagtcatgagccctaggttctagtcttgcttttgccactgtctcatgaccttggcaaaccccctcccttctgtgggcttctgatggactctagatggtccctgggatcccttccagttctaacatgcctcaacctcctatctcagcatttttgctaatgtggattgaaacctcatgcacacacccctcttttcctacttcctctaagtagtgggaggggcagtggtgagatggaagtgttgacccacagcggatctgcgcatctcctgactctttcaggctgctgtccctgctgccccccgggctgtgccaaatgtgcccggggctgcatctgcaaaggaggctcagacaagtgcagctgctgcccatgaaagccatccatcgtgcccaccccttccaaggagagaaacctgggaagtgtctgtacagtgcatgaatcgagaaggtggaataattgtacaataggttgtgctttttatatatttgcccaaatgtggtgttggtcacattcatgtaaagtacttggggcaataaagttttcactcttggttgcctggtggctcagagcattgttttaccctaacccagcaggaccaaaaggtgctgcttctgttgcagatcctgtaaccaccacccacatgtacctgtgacaggtggctgcctactgcaaggtcctatgactctgcctgggggctttctcctcctgcacaagcttgcttgacccatgcacagggcaggccaggagtacggaggagctaaagtcactgggaacagcccttagccaatgacaactgtaggtcggtgggtaaatatcccagcatctttacccctcaaaaggaacaactctgagactcattctatgctgtctcccagaagtctctagaagcactgagcttcaaaagctcacagcagtaacctgctcattaatgtaacctacggtggcctccttccttgcctcacctccccagttccccaccattgctttctgggatctccacccaaagaaactacttgtacagggtccgctttctgggtaacctaatcttggccaggctctcctggcatagcccagaatgcctcattgtgcaaatgtggctgtttaatgggcttgagcatggaatcagtcatgaacggaggctgtgtgtatctaaaggaaatctccaaggtcaagacattgagggcattagctgccctggtttggttatttggatcagtctttaggactggatgacctggaaggcatgaaccaggaagaagatggtggtggaggtgcagaaacagcatcctaagcagaccccctaggagatgactttttggctaaacagctgagaaagctgaagtccctggaggttggcactggggactgggggtgatccccagctctcacccacaccaccatcctcaacacagctgaagacaaacccaagctctgagatcattttcattcatgccatcaagggcctgaactagggcccatcagagaccagagcggcctcctcctccaccagcctctgtcaagcaaccatcagatacaggagtgggtgagaatagagcctttgccaaggtcacagagcagccccaggttgggctgggctcagctagcaggatttactgcatgcttcctggaactgatcactttcataatccacactgtcattatccctgtttggaacttagctggggcttccctaggaagattttcaccctctgtccatgagttgtgccttagacacagaatcatagtgcagtggaaacagcttggccctgggagtcagacactctacccctccctggcaacatgaccttgaccaagtcatttaaccttttgaggctcagtttcctaatctgtgaaatgcgtctccttcacagagttgtagagagaaactgtagcacagaatctgtgcacatagcagtgccccattaacatagattttagcagagctacagcctgtcctagccttctgtttattgatctctgaaaaggcccctaccaagccattctctgtcattgcagagctcttaagcaccttgagaaggacacaacgcaagggattataccttccagcggacagaacagtcccttgtgcctccagcaagcaggttggacactcaccctgcaacctcggcctcggtacccactgggatgccaactcatctcatccaaatgcctttagagttggtacttctgcacgatctcacttactcccatcacaaccttgaaaaggagattcagccttcagattcttatattaataataataatattaacaactaatagttattgagcacttaatatggattcaacacctaataagtgccaagcattgtcctaagcagtttataaacatcatttcatggactctgcactatcaggaccacttcagagccagacaaccagggccctgctctgggccctctgccttagaggacctggtcttcctgtccccacaggagaggagtccgagggtcccacgagatctgtccaactagaactcatgctcattcctcccccaagtcccccatctagcaccatctagacaatgctttgggtacctgggaccccaaaggctagttctagggtctgcgtaggccccctctcccagcagtctgtccttccctaaggtgcaccatgtcatcagtctgtacactcctgggcccgaacgatggccaagggtagaggtattcagagacgggaggatgtgtgaatagagattggacacatgagtttttatgtctacatagagtggagaagtcagtgtgggaagagcagggggtgaagtgcacctaggcctccattcttgcttttgccccaggctctgcaagtgttaggggcaggcctgcactaacaaccctagaagacaatcctgttacataataggatcctgttagatcccccactttgcagatggagatgctgaggctccaggaaagtcaatggctgaaagtcacaagacttccagggggcagaactgggaactgagctcaggtctgcctgacccagaggccatgctcttgtctatgcgatatggatgaggcagagaggaggctgcaggcaatgctgccccagacccaggggcgaagagtctttgcctggggccttgtactttagagagcacacacaccacaagcacacaaatgtgttaaggcagcggcccccgacctttttggcaccagggaccagtttcggtggaagacaacttttccacggacagtgcagtggggcagcgcgagatggttttcggatgaaactgtagttagattctgataagtagctcaaacctagattcctcgcacgtgcagttcacaataaggttctcattccaatggaattccaatgccacttctgatctgacaggaggcagagctcagacggtaacattcacttgccccgcggcctggttcctaacaggtcacagagcagtactgcagtcagggatttggggaagcccatattaaataatacttggggcccctgtcactcaggatcttgtatttgccgttacagtgtgatcaagtaatcctaaacatcttctctggttactaacactgttcaggccctggggaaacacttctccatctcttgctctgtgtcctcaaaacaaagagtgacgatatttgaatggcaggatggttttatagattgtcccaatgctgatgtcagagatagacacagtcttcaaagtacagggaggatttaagtgtagaaattagaaaaaagacaaattaacaaactcatcaaatcctcctcaaaaagcatgaacgcaacagactctcatgtcacaccatcatttcccatgagtgtgacttgtccattttcttgcttttctttgtgttccaatttgtgtttccagaatatttatgattttatgctaattgcagaagctgcacaaggcaactgaggaatgttttgtaatattaagcaattcatattattcatataaattcatattactcttaaattggtgtagatagagctatagctacagataaatatacagatatacatactatggactgaatgtctgtgtgccctcaaaattcgtatgttgaagcctaaatccccaatgtgatggtatttggaggaggggcttttaggaggtaattaggttgtaaggcagagtcctcatgaatagaatcagtgcccttataagaagagatgggccaggcccagtggctcatgcttataatctcagcactttggaaggccaaggcaggcagattgcttgagcccaggagttcgggaccagcctgggcaacatctctaaaaaatctctaaaaaaaatacaaaaattagccaggcatggtggcacacacctgtagtctcagctactcaggaggctggggtggaaggattgcttaagtccaggaggcagaggaggaggttgcagtgagctgtgtttttgccactgcactccaggctgggcaatagagtgagaccctgtctcaaaaaaaaaaaaaaaaaaaaagaggcatgaagtgatctctctgtctttcttttcactgtatgtgaggatacaaacagaaaacggccacctataaacaagaaagtgggctctcaccagacaccagatatgtctgtgccttgatcttggattttccaacctccagaaccatgagaaataaatttctgttgcttaagccacctagtctatagcattctgttatagcagcctgaattgactaagacatacataaatatgtgagctatacctttctatatgtagatagaatttttaaatatttcaactggatgaacatcaagttctagaacaatgaatcattttattttaataaaaatatttaataaaatttcattaaatccttaagaaattaaataggccaggcgtggtggctcaagccggtaatcccagcagtttgggaggtcaaggtgggcagatcacctgaggtcaggaattgaataccagcctggccaacatggtgaaaccccatctctactaataatataaaaattagctgggcatggtggtgcatgcctgtaatcccagcaccttgggaggccaaggttggcgcatcacttgagatcaggagctcaagaccagcctgggcaacatggtgaaaccctgtctctacaaaaatacaaagcttagctgggcatggtggcacgtgcctgtaatcccagctactcaggaggctgaggcaggagaatcgcttgaacctggaaggcagaggttgcagtgagctgagatctcgccattgcactccagtcatagcgacaagagtgaaactccgtctcaaaaaaaaaaaaaggaagaaagagaaagaaagaaagaaattaaataatacaggacattgaagctggatggagaaacgtagatgatcttggcggctttcttaagcacgtgcatctctgggatgaccacttcggctgcctcataacagtagaaaaataaacccctatttagggtttcagccactgttcagctaaaagcaatctgatatattgtacaaacatgagtaagtcttccatgctctgtctcttaagttgttatgaaatttggaataaaataaaatttgaaataaaatgtcaaataaaattttaaagccagatgtggtggctcatgcctgtaatctcagcactttgggaggctaaggcaagaggatcgcttgagcctaggagtttgaggctgtagcaagctatgatcatgccactgcactccagcctgacgcagtaagagcctgtctctaaaaaataataataaaaaaattaataaatcatttttacaatattatgattatgtaagtactgtttactggagagccaaggataaatggatccacaaagaagaatatgtaactcaataaacgtgggccgcttagagaaagaagttaaggtctttcagaatttgtctagcagattttctgcttctcaccagaaaacccataaaaaaatagaaataaaagaaagaagaatattctcttctgagacttgctcagaatcaggtcacattttagtttgcttacaatttggactattatttccttacgggacttttatgtttttcctggcatttcaactgtcttttttcccccttgtataggcacatgggcagatatgtcttttttactctatcattaagataattccatttttaatcacgctatttgttgagtgatctaatattcactgacttgtttccagatctgctatacaactgtcattctgagatgtattttcattgctctcctagtttagaaccattgcttcttggattcccctatcatgctctattttggactccttttcattttgctggagtacatcctcaagcaattttttaccaaaaggatgaattaggagaaacttcagagtccctaaatgtcagaaaatatctttatttttctctcatgccttactgacagtttgattggatatcagtttaagttcaatatcattttctcttagcacttttgaaggcattgctccatgtcttctgagagtcagtgttgctgttgtgaacaccaacattacccgccttttatttctcactggaagcttttgggtgtttaacttatcattggcactctaggatatgtagtatgggtccaaatttgaatgttctttttttcattcaacctgctctgtgtttgctaggccttttcattctgaagactgactttttccccctaaagtcttggaaaacgattatttctttagtaattttcacccctccattccattttctcttccaaaactcctatcagtggttactggttttcctggatcaatcctctatgtctcaaaatattttcctttagtatgcatctatttctgtctttctgtgtgtatgtgtctctctctctttcacctctttaagtgggacattagaaaagtactttttgtagtactttcactgatgtttaaaaattttgtcaactatacttaaatatataagggcctcttcttctttgaatgtctcttcatcataatattctgtttttattttatgagtggagtttttgtttttgtttttgtttttgttttgagacagagtgttgttcttgttgctcaggctggagtgcaatggtgcgatcttggctcactgaaacctccgcctcctggtttcaagcgattctcctgcctcagcctcccgagcagctgggactacaggcatgtgccaccactcctggctaattttgcatttcttttttagtaaagacggggtttctccatgttggtcaggctggtctcgaactcccgacctcagatgatccacccgcctctgcctcccaaagtgttgggattacaagcctgagccaccgcacccagcctggagttatttcttgaatcactctgatgagttaaacggttttaatttcttattgttttctctttttttggaggtccaaacaaatatttattaaattcctattataagccagattttatactctgacctagggataatatattgttaagttttccttgaattatttctgcttctttgagctgaaagcagactctgtgggtgagtggagtttgctgactggcaagcttggttttagcatgcccaggtggggagatggtagccaagtttggccaccccttggggtcaaaacaagaagggtcatcttctgtggagttgacccacctctggaagccctggctcctcctaggctggttattcgatttcttcagagaaaatcttgcagtctcagaccgggggaaaatggtggggctgcccaaactagggtacaggaggtaagtgtgacaaacacatgtcagttctacagccagaccttccattagctgccatcttggtttttactcctccttcctcttctgctttcttagcctcacctcaccccaccaaaataaaacaaagcaccccaaaatctcctatagacttccgcacttcttgatttgagctgtggctttctctactcccatttacccataaatgtgatttaactcattccagtattccagaaatggtaaaatctctgatctcttgatgtactgtccaagccatctcccccaacacagctcttttattggtttttcttttttcctctttatccttccttactttctttcagtgtatactcaggaggaggagaggaaaatccatgtgctcggcctctcatctttagccaaaaatctgagccagacttttcattggtaggattttgaatctttacaataactctgcaggatagagattattgtccattccacaggtgaggaaaactgagactcaaggaagtgagagaccttgtcccaagctcaagcagaactagctggtagagaagcttgaaggccatgagggaaggtgagatggaggggaagaaaggccacagggataagtgagcagagcggctacgtgtggccctgagggataacacttgagcattaagaggaaacaccaaggaaacagattttaggtcaagaaaaagaagagctctctcatgtcagagcagcctagagcaggaaagtgctgtgtcaggaggctgacacgtcatggcttgtgttcctgtactgcctaaggcacaatggcaacctcagaaaggctgtgacccactctgcacctgctcaggccatacctggactggggtggaggccagaagagggtgtggtgaggagggaggaggagcccagatcacaggacaggaaggcaaagtcctcaggtgggctgtagggggcgctccaggcccagagacggggcagcaggaatcatctgcgttttgagggcggatgttctcacttcactctggctgctgttggggcccaagagagcctagaaaagtcctgggaccttcagacatggctgctgggaggacaaatcaggacaagctctccaagggctcaccaggccataacaacgtgcaaatcacccagattcacaaggcatgggcttttaaaataatttggcaatatgagcacatcaaagaaccataaaaacattcttcttgcttgaccccgtcgttttacttctagaaacctattctaaggagttcaccacaaattcagaaaagaaggaaaaagaaggctgggcacagtggctcacgcctgtaatccagcactttgggaggccaaggcaggtggatcgtttgagcccagggagtttgagaccagtctgggcaacagagccccatccctacaaaaaatacaaaaattggccaggcatggtggctcatgcctgcaatcccagcactttgggaggccgaggtgggaggatcgcttgagcccaggagttcaagaccagcctgggcaacataacaagactccatctcaattgtcaaaatatttattaaaaaaaaaattttaatacaaaaattagctggatgtggtggcgcgcacctcgctacttgcgaggatcaggcaggaggatcactcgagcccaggaagtcaggaagtcagggctgctgtgaatgtttgcaccactgcactccagcatgggcgacaaagtgagactctgtctgaaaaaagagaaagacaaccttactcacaaaaagattcattgcagtactatttacatttgtgaaaaactggaaacaacctaaagtccaagtccatgaaaatgttcaagtaagctaagactataaaaaaaacaaaaacaggccgggtgctatggctcatgcctgtaatcctagcactttcagaggccgaagcgggcagatcacttaaggtcaggagttcgagatccacctggccaacatggtgaaacacctgtttctaccaaaaaataccaaaaaaaagtagccaggagtggtggtgcacacctgctactcggggatgctgaggtgggagaatcgcttgaaccctgggacagaggttgcagtgagccgagatcgtgccactgcactccagcctgggcgacagagtgagaccttgtctcaaaaaaacaaaaacaaaaacacagaaaatggttatagcaaaacctaaacagataataggccataaattagttatgcagtagtttttcaaaaagaagccacatagaatacaaaatatactatcctaaatgtcaacagggattgtgttcagatcacagtaaaagataatttttacttttccttctttctgtgttttagaattccccaaaattttctgaagtagcatgttttaaaataaataaatacattctgaaaaggaaaaaaaatagtgtgtattctttgagccagaaattttactttaagaaatgttgtatggaaaggaaaaaaacaaccatgaatatacacatacaaatgctcccaagatgtttatcatggcatggattataatagtgaagatttggaaacaatcaaaatgtctcaaagtagggtactgggtaagtcaattatggaataaatctattaaaataaaattatagaagtgaaattcatgtcatggatgttcataatctactgataagcaagaaataaagtcatttataaatcagcgtgtactgtgggcttctaattttatatttaaaggggttatatatgtacttttcattttttccagaattttctacaatcaacaaagaaggaggaggagttgaggagaagagctagatccaggtggagacccaggtgtttttaaaatctgaggcacagatgacatgaattatcaaatttaattttgaagacaaggaaaggatagaatatttggaattgaaaccttcttggaaaagttgggccatttgacgacaagagatataggctaaatggaggattcccccttctctgtgcccagccttactgtccaccttcccttgaaaattacttcccctatgcaaaggatataaacagacacttctcaaaagaagacatttatgcagccaaaagacacatgaaaaaatgctcatcatcactggccatcagagaaatacaaatcaaaactacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggctattcctcagggatccacaactagaaataccatttgacccagccatcccattactgggtatatacccaaaggactataaatcatgctgctataaagacacatgcacacgtatgtttattgcggcactattcacaatagcaaagacttggaaccaagccaaatgtccaacaatgatagactggattaagaaaatgtggcacatatacaccatggaatactatgcagccataaaaaaaatgatgagttcctgtcctttgtagggacatggatgaaattggaaatcatcattctcagtaaactatcgcaaggacaaaaaaccaaacaccgcatgttctcactcatagatgggaattgaacaatgagaacacatggacacaggaaggggaacatcacactctggggactgttgtggggtgggggcaggggggagggatagcattaggagatatatctgatgctaaatgacgagttaatgggtgcagcacaccagcatggcacatgtatacatatgtaactaacctgcacattgtgcacatgtaccctaaaacttaaagtataataataaaaaaaagaaaagaaaagaaaattacttccccaagtgtcctccttcgatttgacatatttgagcccccaaacacctttgggggcaggggcagctcatgacactctgcatttgacagaggccaaacatgcaagttggccataaggccgggattgcgaagcaggtcttttgatttccctggctcttttccctacatgtttgagctgctaaaaatcaagacagggttgttacaggaaaaagtggagcaggatttctcagctttggcaatattgacatttggggccagatgagtcttggttttgggggattatcctgtgcattttaggatatttggcagtatccctggcttctatccattagacaccagtagcaccactgtccccaaaacgctaccactatcaaaaatgtttccagacattgccaaatgacccctgggggcaaaaccacccactgctgagaaccactgagataaatgaggtgtgagagggatctttgatgccccgaagtcattcctgggagaagggaatgctgcctgttcctgcatctgggaagctaataattaggaaggcagagaggggatactggtttatgtaaaatggcgtgggtgctaccaatctactatgcagactcctagcagcattttgatcttttcttttcttttcttttttcttttcttttctcttttcttttctttttgcagactcctagcagcattttgatcttttcttttcttttttcttttcttttctcttttcttttcttttctttctttctttctctttctttctttctctctctttctttccctccctcccttccttccttccctctttcctttcttctttttttttttttttgagacagggtctcactttgtcactcaggctggagtgcagtgtcatgatccccgctcactgcagcctcgacctcccgggctgaagggatcctcctgcctcagcctcccaaatgcctgggaccacaggcacgtgccaccacacagctaattttttgtagagacggggtttcaccatgttgcccaggctggtcttgaactcctgagttcaaacaatccacccgcctcagcttccccaagtgctaggattacaggcgtgagacaccacacctggcccatgtgttgatcttttattaagcagctttctctttacccaggctgtgggttcttgaagaaggacatttcttactaatctttgtatctggcattcctaacacaaagtctggattaaggtgatgctcaacagatgtttgtggtctgaaatgaaattcaccaccatgttactcttttaagccaagcaggatggtgggggctacagggtaacttcatggctctgtatttaactaagcctgactcttcatgactcaaccttcaaggggtcccacaaaaataattagcccaaagtcagactcactcaattctcacaggcattcattcactcaacattcaaaggacatttcaggtactcagggaactttgctaagcacaggagtggggaagggaaggaatcatccctcttagtccccaacttcagggacctcagagtctgtcttggagatgtcagaatgtcttgtctcctctcctgtaggggagaatatatctagacaagaccccacagaagtgccaaggaggggaggttacagctggctgcaggcaggagtgaagacttcctggaggacatggtatttgagcagggcctaaaaggatatgtagtgtttttttttttgttttgttgttttgagacagggtctcactccgtctcccaggctggagggcagtggcaagatctcagctcgacgcaacctctgcctcccaggttcaagtgactctcctgcctcagcatcctgagtagctgggatcacaggcatgcaccaccacacccagctaatttttgtattttttgtagagacagggtttcaccatattggccaggctggtctcaaactcctgatcaaggcggtgatctgcccgccttggcctcccaaagtgctgggattacaggcatcagccaatgcgcctggcctgaaatttcttttaaaaggaaatctcatatcactactgtagaagagatgctgaatcatttgccataaacaggaggtaaccatggagacaaatacagagaacataaagccaagttattaaatgtctagctagatactgtggcatggtagggctcccctgttctttcctgactcctcagcccattctctgttaaaaaggggagctggggtcgggcacggtggctcatgcctgtaatcccagcacttcgagaggttgaggcaggaggatcacttaagcccaggagttccagaccattctgggcaacatggtgaaaccctgactctaccaaaacaaacaaacaacaaaatacccagaaaaccacacacacacaaattagccaggcatggtggtgtgtacctgtggttccagctacttaggaggctgaggtgggaggatcgcttgagccagggacgtcaaggatgcagtgagccatgattgtaccactgcactccagcctgggtggcagagcaagaccgtctcaaggaaaaacgagggagggagggaaggagggagggagggagagagagagagggagaaaagctgggcactgagagacagaaggagaggcactgaagacatcttagctccaagctgagtgtccttggagcaaccaggaagattcattaagactgaaaagagaataatttttaatgtgattcaaggttatttcatacaatcatctcactttgggaagctagaccagtggaatcaggcttggagtcaagagacatggttcaggtaccggcttcattacaacattgctgtgtgactttggacaaaatctatgctgtctctgagtttccttatctactaaaataaggcagatggtactcatgggatgagttttcagaaagaatctcaggatccctactcaaaccctggtgtaagtggggcaaggatgtcataggtgagcgacagctatctgggctagggatgcgggggtaaaggaatttaccaagacagttgtagataaaggaaggcaggtttattaaagaaagtatgaaaatacattgccggggagcaactggcaaaaccagcagaagaggaaccgactgcaaggaagcaaaggctttctgaggattttatagaatggaacttgggctgattgataacaccaatgcagcagggagcttaacttgcattctttcctcagcgggggtgtttgataaattgaggtgtttgatggtaagcaggaagtctgcgagttatgtacgttatctgcatgggagggccgtatgtcctgggccaaggtagacctagaacttatttgctttatctctttgctctctctggtcccaccagtctgaccccttttccctaattaggattccacaaaggataggacaggggaggggggcattttgccaacttgagggcaagatctcggagcatcaatgatccagtgaaaattgggaagacaacatcacaaaagacctaaaagaatgtaggctcccggaagctagttcctgtggctcacagtgactgcactaagctcagagatttggtctcctccagataagtgctgggaccccgttgttgtgggctggaacttggtccgggccaggatctgcttggaatggagaatctaccttcacagagaggtctaaagtcagtgttttgttttgttctattctgtttttttgtttttgtttttttgagatggagtctcactctgtcacccaggctggagtgcagtgatgcaatctcaactcactgcaacacctcccgggttcaagtgattctcctgcctcagcctcccgagtagctgcaattacagatgcccgccatcacgcccagctaattttggtatttttagtagaggcaaggtttcaccatgttgggcaggctggtctcgaactcctgacctcaagtgatccacccgctttggcctcccaaatgctgggattacaggcgtgaaccaccgcgcctggcctaaagtcagtgctttgatgttctcttgtgtgggaaaccacatacactatcacaggccaggctgtgggctgagtcaggactgtgcaggtcatgtagggcctgaatggggcatttccagaggtcgaggacctgccttatgggtagagagaggaggcaggatgactttctttgttgcagatgaagattccgcaattccgtaaagtttgcttggggtatcaaagcattatcaagtatccaggagcctggcgggtagcatgcctaataactagaattcatagtggattgaattaaagacatcggggcaggctgaagagtaatgcacttagatttaagtccagggtctgcctccaggacaagccactgaatctgagcctcgatttcctcccttgcaaaagggagttagcaatgcctaccataagggtaactggaaggagtcaatgagataatatgtgaaggagtcagtgagataacatgagatcagctccccatggtgctctatatggtacctggcacatggtaaactcccagcaagtggaagacattgtccatagtagccactagcagtcatctggtcaacccatgtgaaaagtggggcacaaactggggagaggcttccttgggttcactacaccacttactagacaagctgaaactagaaaccacgggacttctagacccccgccttttctctagcttcagctgccctgtgcacaaaattgttcattaataaatccggatctctccaagaaatgactttatttgtagatttgcatatttgcaaactctttttgtacactgtgtgcccaggctcctaaaatcctagccaatttttcagtcccaggatagtaaattgggaaactctttgagagcgatgcaatagtcttaatcctgcactggaccaatttcagtcagggtgtgggcttgctgggggtcttgctttttttctgagatcatctggggatcatatggggatggaaaatcccttagtgtgaccttgagtgatctccacccctcagcctactggtcttgcctcttggccccagtctaattgaaaaagttaaagtttctgtgaactcccttctgccaggaagctctaggattgggcgcaaggtctcgattgaggactgatgtctatgactggtggcccatgctgatgtctgcagtactgtatcaactacaggccacaggtgactgtgtttcaggaagcacagagctgaggccaaccatgagactgggtgtcaagcaggagctttaggaacccaggccccctgcagagtcctcacctgacttcttcatttgtaaatggtgagaaccaatgtggtgaggaccctgctccaagtcttttcccaatgccatcccatttaagtccctgacaaatctattaagcaggaactattattactattagtattattttcgttttaccattgagcaactcaaggcacagaaatgttaagttgacctagctagtaacttgctatggtgtttgtttgtttgctttagagagagaaggggtcttgccatgttgccctggcttgccttgaactcctgggctcaaatgatcttcctacctcagccttccaagtagctggaactacaggtgcacgccaccatgcctggctgccgtattactattaagcggcagagtcacactgtaaactcaactagcatgacctcagactcattcattcattcactcatcaagtaaatgtgtcctgaatgtctaccacgtaccaggcactgttataggcacttcagagacaccagtgaacaaaaacagtgatccttgctctttcttgcttaaattctagcaggagacagacgacatataatcattacaaataagtaaattatttagtttgctagtaaatgttaaatgctatggaaaaagggaagatagagcaaggtaaaggagatgaaaagtactggggcatcgaggcatgcaattttacgtagtgtgatcatgatgggcttcacagagaaagcagatttgaacaaagacttagaagtaaagaaaggagtgacttgcatggttatctgtggaaggagaatcacaggctacggaaacatagacaaaataactttgagctgttttttgtttgtttgttttttgagatggaatctcgctcagtcgcccaggctggagtgcagtggtgcgatctcggctcactgcaacctccgcctcctgggttccagtgattctcctgcctcagcctccaagtagctgggattacaggcacccgccaccatgcttggctaattttttttgaatttttagtagagacgaggtttcaccatgttggccaggatggtctcgaacccctgacctcaagtgattcgcttgcctcggcctcccaaagtgctgggattacaggtgtgaaccactgcacctggccacttcgagatgtaagaattaacaaggggtcagagaggataaaggtaggggagaaagggacctcctggagcgatagacctgcacggcatgctcctcatggaggcttagaacggaaggccacatggaggatgaggggtagggggtatcagaaagatgctgtggttttcagacccctcaatatcctggccacccttggggcaggaaggaggttgctatgccagctctgaagcctcaaccccaaagaaatctgacagacctgagggagattgcaggggaggcagcttcagttgagtgcatcccaagcgtgaaggtcctagatacagaaaccctgaggttcagggcctagggcaaagaagttaagaggccagagtgcccttaggcaaaatggaagcaaagaaacagatgactggctgatgctagagttggggaactctgagatctgatattccaattgtccagtggctggaacctacactgtccgtgtgagagcctacacttgaatatagcctctgactctccatacaaggctctattttggaccttggttagccttggctggcctggctacccctctcccgtggtagcacagcattcagctgctctcgccctgcacagtgcgggctttgctttaaaaattctcatctcaggatgaatttccttattgggttactccagtgtgactagttctttgtcaaacacctcctctgtccctgccttcatttgggggccatcttttttgcgggggaggtacagggtcttgctctgtcatccaggctacagttcagtggtgttatcatagctcactgcagcctcaaactcctgggctcaagcaatcctcccaccctggcctcccaagtagctaggggtacatgtgatccccaccactactggctgattttttaaatttttattttatttatttattttgtagagatggggtcttactatgttgcctaggctggtctcaaactcctggcttcaagtgattctcaccttgacctcccaaagcatagggattacagacatgagccactggccttgggagtcatcttaatgctcagctccacgtaccccgaaacacaaccccttctgtgaaagcattagcaagcaaggaagattttcagaaagtctcagagggacagcagagagagtgacactcacacacttcacaataacattttttaaaatgctttttacagaggtcttctcccagctctggtcccttctttgctgccccccaaacttcatctagacccctgaatggccctcgtttttgaggagcaatgacctctctcctctccacttctcggggtctcattctcactcacgctaccctgctcagtcacaaatgattctccttggcagcttagacctcttttcctttcattttgcacccaaatcccttatattcatataaacattgatcaatcttattttacctaggctctcttttctttttgagacagggtcttgctctgtgacccagattggagtgcagtagtgcaataaggcttacttactgcagcctcctcaacctcctgggcttaagcaatcctcccgcctcagcctcccaagtagctgggactacaggtgcatgccaccacatccagataatttttttttttttttttttagatggagtttccctcttgttgcacaggctgaagtgcagtggtgcgatctgggctcactgcaacctccgcctcccagggtcaggtgattctcctgcctcagccacctgagttgctgggattacaggcacctgctaccatgccgggctaattttgtatctttagtagagatggggtttctccatgttggtcaggctggtctcgaactcccgacctcaggtgatccgccggcctcggcctcccagagtgttgggattacaggcgtgagccaccacgtccggcctcctttttataaatagaaaaatctcactgacctgccttgagtttaacatgccccccactgacaatccctctagatacctgagttctgagttctaggcctggctcggcctcaggcttattctgggacccaggcacatttctgcttctctggcctcactttttcttatctgtataatggagggttaggagtcaaggatctgaagatgccaggcaggacagcggggaaatggaacacgccccttgccagtgacactcggagggcgcaagagtcagtgtcgggctcatcgtgagcaggttctttctgcccccagttcagcaacccgtctgaacagatctggcgtcctggagaattctagaatgaaggggaagagaggcagggaagagctgggaaatacgcaaagcgcctttttctccactttcggagatggtacgtgcgcgcttccacgcagtggcggctgctgcggcgagcacgtcccctgcgggacccacgcggggagtgggctggcagtgcgcgcatagcggcggcgagtgggtcgtgcacgcggatgcggggtgggagtgggggcgcacgcgcgggcgtgggcgagcgggccccggcagtgcacacacacggcaggggcgggcgacagatgcagtgcgtgcgccggagcccaagcgcacaaacggaaagagcgggcgcggtgcgcaggggcgggcgcccagcgggcttggcatgcgcgcccccgcccgaggctataaaagcatcgccacctgctgccactagccaagccgcgcgtccagttgcttggagaagcccgttcaccgcctccagctgctgctctcctcgacatggaccctgagacctgcccctgcccttctggtgagcccccgcccccgctcgcatcctgcgcactgcgcgcccttgtacctgcaaagaaacccacgccctgcgccttcgctcaaggacacttgggggaagggcccctgattccctattcttcacctcgtgaagggcgggcatgcctgtgtcgcggagaacagggagacttggcaccccatctcctcgtgacaggcgtggggacccgagttcgtccacattaacccttcctgtggcgtcgccctctctaggtggctcctgcacctgcgcggactcctgcaagtgcgagggatgcaaatgcacctcctgcaagaagagtgagtgcggggacccttcccctctgccgccgccccctctgctctgcggagtcggtgtctcaccacgcaggatgtggagagacagccaggccccgatcccgtggtttctgactcttgctggaatagaaccacccgggcagacattaaaatacagatgcccctgccccacacccaggaattgatggcctaggcgtgggacgagaggtttttgtaaatccccagaagactccaatggcagctgggattgaggactgccacactggtccaacctttcccgacccatccctcaaaaactccccaaaacctggggaagccattagtgaggctgcggctcagctctggagttccggtcccttggcctctctccggccttacggatcctctcagtttgatctcaaaatctccccagctcacggcagtgtaatatgcatagggagtaagaggtgggaggaaggctcccttcttccctaggtatgaaaccaggcacaggtccccaccgcctccccacggctttcctgggccccttacatctgcaccatatctgcccctcccaagtttatcctttgaggcccctttcaaggtcgtttaccctgtgatgctttctccttaaggcctagtacccacctaagctgggcttaagcccaccagcccccaggacttcctggcatccacccaaggggctctggtcatttcctgggtacctcactcctgtggaggtgcaggatgccactgccgcgacatagatgctgagtcaaagcaggtgtgagactaagaagggggctgcgactagccctggctgaatgaaccaggatgactccccacccagcacccttccctcccctttgatggggacgaattgggggagtgtgcatcagagagtggtcatcttccattttatctgcaggctgctgctcctgctgccctgcggagtgtgagaagtgtgccaaggactgtgtgtgcaaaggcggagaggcagctgaggcagaagcagagaagtgcagctgctgccagtgagaaggcacccctccgtgtggagcacgtggagatagtgccaggtggctcagtgccacctatgcctgtggtgaagtgtggctggtgtccccttcccctgctgaccttggaggaatgacaataaatcccatgaacagcatgagccaaggactggtctcttcttaaaggggggaaggatgtggagcagtgggggagcctattccaagggagccacacagttaagagtgaaaccctggctgggtgcagtggctcacgcctgtagtcccagcactttgggaggccgaggcaggtggatcacctgaggtcaggagttcgagaccagcctggccaacatg

SEQ ID NO: 15134 - DNA, 5944 bp, Human
gtaatcccagcaccttgggaggccaaggtgggtggatcgcctgaagtcaggagttcgagaccagcctggccaacatggtgaaaccttgtctctactaaaaatacaaaaaatagccgggcatggtggcagatgcctgtaatcccagctactcaggaggctgaggcaggagaattgcttgaacccgggaggcggaggttgcagagagccaagatagtgccactgcactccagagcgtgggcaacagcgcaagactttttttcaaaaaaaaaaaaaaaaaaaaaagccaggcatggtggtgggcacctgtaatcccagctacttgggaggctgaggtgggaggttggcttgagtctgggaggtggaggttgcaaggctgcagtgagccgagatcacaccacactccactccagcctgggcttagagctagaccttgtctcaacatcaataacaaaatgcagagtgcattttgaatgcaacaaaaggcttgttggtggaaatcagagagcagggtcgaaggtgtggaatattgaagagttttgagagttgaggctggacagtgacatccgggaattgggattttgactaggaagcaatggggagccactgaaagtatatgacttggtcagatttaggtttaaaaaaccaagaaggaagggatgggggagggagagagagtgatagggtaggaaggaagggaagttggctgctccagcatggtaactggaattgaagagtgtaatagtaattgagggaggtttggttactaggtcagtgtcaggaattctcaacaaaaacgacggaggcctggtggagaggaggggactctcaatagagagattttttttttttttttttttgagacggagtcttgctgtgtcgcccaggctggagtgcagtggcgtgatctcagctcactgcaacctctgcctaccgggttcaagcagttctcctgcctcagcctccctagtagctgagattacaggcatctaccaccatgcctggctattttttgtattcttagtcgagatggggtctcaccatgttggccaggctgctttcgaactttttttattgttgttttttatttttgagatggagtttcgctcttgtggcccagtctggactgcaatggctcaatctcggctcactgcaacttccgtctcctgggttcagcaattctcctgactcagcctcccgagtagctggaattacaggcgcccaccaccatgcccagctaatttttgtatttttagtagagacggggtttcaccatgttggccagtctggtctcgaactgttgacctcaggtgatccacccgcctcggcctcccaaaatgttgggattacaagcgtgagccactgcgcccggccaatttttgtatttttcgtagagatggggtttcaccatgctggcaagactggtctcaaactcctgacctcagatgatctaccggccccggcctcccaaagtgttgggattacatgcgtgagccactgcgcccggccaatttttgtatttttcgtagagatggggtttcaccatgctggcaagactggtgtcaaactcctgacctcagatgatctacccgccccggcctcccaaagtgctgggattagaggcgtgagccaacgcgcccagcccgtactttttttttttagtacagacggcctcccaaaagttctgagattacgggcgtgagccaccacgcccagcctgaatagagagagatttaacagtatgaatgaagggaggagtcaagaacagtttaggcttctcgcgtacatgattgggtggccccagatgtcattcacaagtataagccttggaggcggaacataactcgaagaagagcccttttgtgctccgcccatagcgtaggaaggtgtcaattggctgtttcgaggaacgcgccaaaaactgccaagggctgtgggaggtgtgttcttgcgtcatttccgagagacttccgcgccgcagtttccctgcttccccagctccagaacttccggccagcgcagccattttggcttcctgaccttgggctacggctgaccgttttttgtggtgtactccgtgccatcatgtccgtcctgacgccgctgctgctgcggggcttgacaggctcggcccggcggctcccagtgccgcgcgccaagatccattcgttgccgccggaggggaagcttgggatcatggtgaggaacgggcctggaagagcgcgggaggcgccgtgggctgaccccttctgcctagctgacctcaggtggtcctgagaatgcctcgcgccccgcagcgtagcggggagcagcagtgccggtttgggcatgtctggagggcgcgaacgacggggacagtgcccgggcgacagtcggggctgtcggcgttaggtctttccccacagccccaggatctcgggtctggtcctgtcaggccctccctctcctgtcgcctcctcgctgcgccgcctcctgccgacttctttagccgctctgagcccattttctcgttggttcactgggggatgcctgacgctgtcagcgacgaaaatggttgttactgctatttattttattttattttattttacttatttattttgagacgggttctcgctctgtcgccaggctggagtgcagtggcgcgatctcggctcactgcagcctccgactcccgggttcaagcgattctcctgcctcagcctcccgaatagctgggactacaggcgcgtgccaccatgcccaactaaattttgtatttttagtagagacggggtttcaccatgttggccaggatggtctcgatctcttgacctcgtgatccgcctgcctcaacctcccaaagtgctgggattacaggcgtgagccactgcgcccggcctgggagggggttttcaggcaaggaaggataggtatcgttttggagttactggcccatgcaaggatcctgggtcttaacatacaggctttgctttttttgtttgttgtttgtttttttgagacggagtcttgctctgtcacccaggctggagtgcagtggtgcgatctcggcttactgcaacctccgcctcccaggtttaagccaagccattctcctgcctcagtctcccgagtagctgggatcacaggcgcccgccaccactcccggctaattttttgtatttttagtagagacggggtttcaccatgttggtcaggctggtctctaactcctgaccttgtgatccgcccgccttggcctcccaaattgctgggattacaggtgtgagccaccatgcccggcccagaccagctttaaaacaggtttcaataaatcctgcttcctgtcccttcctttaccatctggtggtgcatttctccctgaaccctaaccccagctgtctctccttcctctcactcttccccctccttataactgaccctttacctcaagggttagcgtagctttggacctgctctgtctgctccgtggagcgtggattcctttaacgtgaggatgcggggcctcccacttgcctctgagtcctggctccctgagcggggctttctgctgcctgggaactgcaaggacttagagagcctaggggaatactgactccgaggtgccttctttcttgtgctctgtgtaggaattggccgttgggcttacctcctgcttcgtgaccttcctcctgccagcgggctggatcctgtcacacctggagacctacaggaggccagagtgaaggggtccgttctgtccctcacactgtgacctgaccagccccaccggcccatcctggtcatgttactgcatttgtggccggcctcccctggatcatgtcattcaattccagtcacctcttctgcaatcatgacctcttgatgtctccatggtgacctccttgggggtcactgaccctgcttggtggggtcccccttgtaacaataaaatctatttaaactttacttcagaaattcattgtgccttccctcctgcctgggctcatgcctccactggcactgggtggaggtgtggagaagagcgcccggctggctgccctgtggtaggttttgtgtgcctcagctggactcctcgtgtgcttctgtacctttaaatggtgcctggcttcctgggaagacaaagcctgttgtcattgtgcagcttttctggctcatcccctccagctcccttgtttgtgcaaagcccaatgggcgtgtatgtgtctgtgtgtgtgtgtgtgtgtgtgtgtgtgtctgtcccactggggctggatcttcagctagaagcctttcctctaaggggccagccttctctggtcttcctttttggtggacttcatttcttaggtgctggtgcccttcctaattgggggtagggactttgcagaatcttggcttttttttttttttttttttttttttgagactgactcctgctctgttgcccaggctggagtgcagtgatgcgatctcggctcactgcaacctccgcctctcaggttcaagggattctgctgtttcagcctcctgaggcattacaggcacccaccaccacgcccggctaatttttttttgtatttttagtagagacgaggtttcaccatgttggccaggctggtctcgaactcctcctgacctcaagtgatccacccaccttggcctcccagagtgctgagattacagccaccgcgcctggcaatcttgcctttttaatttttttttcaagacagagtcttgctctgtcacccaggctggagtgcagtggtgtgatttcggttcactgcaacctctgcctctggtgttcaagcaattctcctgcctcagcctcctgagtagctgggattacaggcacatgccaccacacctggctaatttctgtattcttagtagagatggtatttcaccatgttggccaggtctcaaactcttgaccttgtgatccaccctcctcgtcctcccaaaatgctgggattaacaggcgtgagagaccgctccgtgcccccgctttttttttttttttttttgaggctagactgcagtggcgcaatcacagctctgtagccttgactttgactgcagccttgacctcccaggctcaagcgatcctcccaccacaggttgtaccccagtagctgggactataggcatgtgctaccaccatgcctggctagtttcatctttttttttttttttgagactgagtctcactctgttgcccaggctggagtgtagtggaacaatctcgactcactgcaacctccgcctcccgggttcaagtgattctcagcctcctgagtagctgggattacaggcgctcgccaccatgcccggctaatggtttttttttttttttttaagtagagatggggtttcaccctgttggtcaggctggtctcgaacttctgacctcgtgatccgcccacctcggcctcccaaagtgctgggattacaggcatgagccactgcgcccagccatacctggctagtttcttaaaacattttcttgtagagatggggtcttactatgttggacaggctgatcttgaactcgtgggctcaagtgatcctcctacctcagcctttcaaagtgctgggactacaggtgtcagccactgcgcctggctgcttgcttttttttttttttttgagacagagtctcgctctgtcgccaggctggagtgcagtggtgtgatctcggctcactgcaacctccgcctcctgggttcaagtgattctcctgcctcagcctcccgagtagctaggactacaggcgtgtgctaccacgcccagctaatttttgtatttttagtagagatggggtttcatcatgttggccaggatggtctcgatctcttgaacctcaatatctgcccgcctcggcctcccaaaatgctgggattacaggcgtgagccaccgccgccggcccctgcttgctttttaaatgtcaactccagggcccctttc

SEQ ID NO: 15135 - DNA, 41895 bp, Human
  misc_feature (1)...(41895): n = A,T,C or G
cacaaggcattcaggtcctatgtagataaagtggtcagagatggcctttccatgggtgtgacatttaagctggagcgtacattgtagtggggctgctggggcaaggagggagaataatgttccggccagcaagaacaccatgtgcaaaggccttgaggtatcaacacaatcactgaaagagaagcgatcggataacagtagccacttttattgagttccctgcactatgcactctgtttttcaaacactatctcaaggaatcctcaacagcagcccttctttaagaggtaagcactaaggccctaaacatgatggttagagacactattaaaaagcatgttctaggcagggtgcggtggctcaggccagcaatcccagcactttgggagacctaggtgggcagatcacttgagatcaggagttcaagaccagcctggccaatatgtcgaaaccctgtctctactaaaaatacaaaaaaattagctgggtgtggcagcatgcacctatagtcccagctactagggaggctgaggcaggagaatcacttgaacccgggaggcagaggttacagtgagccaagatcgccactgcattctagcctgggcaacaagagtgaaactccatctcaaaaaaaaaaaaaaaaaaaaaaagcatgttctaaacacttgcttacagaattcactctttggtaaacagttcatttcattgtaataaagtagctcacaacgcatctctgaaggaacatgctcaggaaagaaaaaaaaaaggtaggtactatcatatctccattttatagattaggaggctgaggttaatctacttgcctgccccaagtcagctgctcagcaacgaggccaggatttgaactaggttatgtttgaatccaggacacctgacctttccattcagttgttttcattatcattagagattcacctaactcatatattctacacctttgtgacctttaaagagttctacaattatttaactaagattttacttgtaattggatggtctgggtacaacaagggtttgtcagtatttacctttgcctagaaatttacatgcattaggagacttgacaatgtcttcgtgtattttaattttttttattttattaaaagacattttgaaaacatgcaaataaaggaaatgatcctagatacatatttttcttagcttttctcagtattgtttcaacttgatgatattgttccaagtattgttccaacttgcaaatttaagttcactaataagggttccatgaaaaagccacagctttaaagaaaaaaaaatacatatatataattattcacacactatacacatccctccatccactaacaaactactgagatgtatggtatagtttcccttttcctccaacctaattattcatgtatgttttaatcattatagcaacattttaaaaaagcaaaaacagaaaactagagcataaactgcttcagaatgtatttatatgaaaaatacacactttgaaatttctgggattaagttaggcccaggggtagcaagaacacttctaaatcccagcctgcagcttctcaggtactggagacacaaggataattcagcacagagctcccatcccacaggcttacatcagaaagctgacagatctctgggcttcatcccattgttccatggggtcaagaccaaagggactggaaacagcagggtttggtctggcctagcccaccctcgcagtttcttgtagagaaaaagagatgtgtggaaagaaccataggagaaaacagtgtctgcgtcttctgagttacagagtcttctggtgctttcctgaaattgaatttcccggaatttcagggtagtttgcaaaataccataagcagatgcattaacaaggcataaaaggaaatacagtgaaagggttttaacaacccatgagctaacgagttgattggattggattataggcatctcgaacagtgatccacagtgcagacatcacgttccaaatgctggaagactggaggaacgtggacctgaacagcatcaccaagcaaaccctttacaccatggaagactctcgcgatgagcaccggaaactcatcacccaatgtaagctgtcccaccagggattgttgtcctgtttttatttttaaaagaaagaaaaagtgtcttagtaaataccgaagtggcatccccaccctgttcttcccagcatctcttcctccttattgttccttattgttccttttaaatgagtcagtccagaaggaagggctgattgacttgagaggacatgtgtcaacactgctgggtaaagagtgttctggtgcaattgggcagcatacagtgtcatgcaaagggccccacatgtgacctgaatgccagccccggttccatggaggtggcattaaatatgagaacaaaagcttattgcctctctcagtgtatgtcagcctggggtcagctggatatgctgcctatttttcatttgagggtcacgactcagcccacctattggtaggtgaacctttcaatcacgttaaatgtctgagaagcaggtggatggtattttacttctgtgaatatatgttcatgtcccggtgaacaagggcttccaacatgcagactgcaggtatactgctccaaatatcaaccccatgtaggcaggatgtttgatcttggtactaaagcaatatgagaaggccagagaacaacatcattgttagcacatccctgctattcctcagatgcccatcccagctgactgcccagggcatccccccagcccaataaccctggatccataggcgtctacaggctacctccataattagagaacatcaggtcaggaaaggtgttgagagcatgcattcccatgttctcaatggggtgaggcccaggatcccaatagtgacactgcttggggagctgcagagaggctgtcccaccaagaagaggggtctttctgaaagccccaaggcccttcagatttcttagtatatgccttctgcactgctgtcttgagggaattctattcagctacccagtctaaacttgaggtgcctttaaacaaagttccctaagagggtcctattagagatctctttcccattaagcccttttcaaaagcaaatgtaacagccgaaatgtttgaacatgtggaccttccccagggcttctttcctggcttagcccaaacctcactcaggctgttacttcttccttcacagctgccccaagcccacttttcccctggtaagaattttagagatcatcactaaaataataattcagcttattgactgcctattctaagccagctcctgtgtcaaatccaatacatgcacggtcccatttaatctccacatcaaccccatgaggaagacactcttatcacccccactttacagatgagaaaactcaggcttagagagttggtgaacctaactcaaggtcatgcagccactaagcaatagagctgaacccaagtctggtctcacgtctagtcccagcttcatcaccaggccttagtgctgctcatattgtattcatgtgcacaggagacaaaaaaaaaaaaaaaaaaaaaaggaaatatgggtgagttttagaggttccaggatctttccaagtgcttacaatcatccttcctcttctgctttttcctgtcccctgatggaaagtcaacagaaagcatggccctgcacaccctaatagcactgggggtacctttgatcactgtgcccctaggaactcccaatgggccaggcacagagcaggtgtccagcaagattcatggaataccaaagagatgagtggaaacccagagttaacctagttcttagctctgcaaatcttcctagcagtgttagactcagttctcttcccgcctcagctcctttcatgagggacgaaaatgtgaaccagactcataaggaaaaatacaatcagtattgcttgcttaaaggaccaggctctgagcctttgctggagcaccatggaggtcactgctgcctctctcaagaaagaaccttctgtggctttctcttcaagttcctttaggtccagggcagaatggtgccctttaaagctgtgattgcattcttcttctggggaagtaaatgctgtggttcagttcaacccagctagtccttactgaatgcctgtcctaagtcaggtactgtattagatgctggccaaagggcagtgaataaaatggacacatcccttcccaacatggagcttacagttaatggtaaataagacctcaaacatgtatttacagatgtgttgcatcttaccaaagagaacaatgtcatgtaatacagtgctgtgaagggggaattgagggagggtaccaagcctcaaggcagtccagcacatgtgcgtcaaccctgtacctcctaaccagacagctgggaagtccctgacacacagggagttggaccaaaggtcagcttgagcagggctgggacaactgtgtgcagtgctcttctttcctcacagccagctgacaaatctgcaaactcttgcttagggggttaccatcacctctgtgatatagatctcagccggcaatgctcagcttaccttagattttaaaagtgcacattagtacttaagcaagctgattagaatgagttataattgtaactgcccaaggtctgctgggcatcccagacccatgtccaagttctgttggctgggatccctggggctgggatgcccaacagaccttggttcaaaccttgctcttacacagctcttacacagcatggggctggatgcccaaaagaccttgattcaaaccttggctccagtacactgtgaccttggtttccatttctgtaaaatgggactaaggtgaagggattaaatgagactatctgtgccacatgcttggtacacagtctagtgttagcatagtgaagtggttaggaggcaagcacttgagtcaggatgtgtttgaatcttgtctccgcaattcactagctgtgaaagaacaacctttggaaagttactcatctttgtttgtctctttcttcacttgtaaaatggaggataataatcgtaccaacctccatgggttgttcatccattcagtcaacaaacatttgagcattctagtgttatgaccctctggtctcagaatcttacttcttgtagcaagcgtcaactaagtaaaatagagcaaagtgtccagtcctttaaaatgagagaacaaaaactgctcaaatgaaaatgaaagaaacgtatggatcttgaattgtggtttgatttattgatctctgcatacagaaacacaaaaatgtgatgaaaagagatgtttcaaactagagatcaccagagccatgtttctattttctagagcacttcattgattaaaaagcacttccagccgggcgtggtggtgcacgcctgtaatcccagcactttgggaggccaaggcgggcggatcacgaggtcaggagattgagaccatcctggctaacacagtgaaaccccgtctgtactaaagatacaaaaaaaaaaaaaaaaaattagccgggtgtggtggcgggcacctgtagtcccagctactcgggaggctgaggcaggagaatagcgtgaacctgggaggtggagcttgcagtgagccgagattgcgccactgcactccagcctgggcaacaaggcgagactccatctcaaaaacaaaaaacaaaaaacaaaaaaaagcacttccagattcagttatctgacttaaagtgaagacaggttgtaaagtggtaggattatctctctaatgaggaaactgaggggcagagagactgtttcacttactcaacaagtatctattaagcacctactacatgccacacagagaggctgcttgcctgatacagttgtggtccagaaacatttgaattatcacatgtgccctaccctgggcagagagcaagagagcagcaatgcctcacccattaattcaagcaagaatttgttgggtaacaactatgtcacagataatgcaccagctaatgaagatatcagacaaagaactagcagggagacacacatgcccacccaactatgccacagtgccattagtcatataataaaggtagaaaaccgataataaagtgctatgtgagtgcagaggaggggtgatcagttctgcgggcaaggggcatggaaggttaaagggatttcataccagggccatttcagctgggacatgaggaaccaagtagtgggaaaagcctgaaaaaaaaagactaaggctatgaaaaaagcagggcttgctggcggaatggcaagtaatatgggatagccacagtttaacatgttcacaggcatggaagatgatcttggaaaggtaagttggggcatgttttataaagtcttgaatgctctgctaagaccttggagttttatttatttaaagttttactttattcaaagttttgttcctctgttcttttaagacgtagctcttgttaaatacaactgcagtgatgcgtgtggggttctcctttgtttgacagtatatcaggagtttgaccatctcttggaggagcagtctcccatcgagtcctacattgagtggctggataccatggttgaccgctgtgttgtgaaggttggtaaaccggcacctagcgggcagccttgggccctgcagcccaccactgccctctgtgaacttggccaagacaaagccctatggtaagctatctgaacagggttttgaggagaggccccaggaggtggaggggtcaggaggcaggactcttgagtcttccatccctgattcaaccaggtcagcatctcttttatctgctctatacactgagtcttggtataagatttcattttttaaagtttttttgctgctacaaacaaaacaaaaaccattgctccatagcattgactttgaagaccataagccttcctgtcatttttctgtatttatttatttatttttgagacagggtctcactttgttgcccaggctggagtgcagtggtgcgatcacagctcactgcagccttgacctccccaggctcatgtgatcctcccacctcagcctcctgagtagctgggactacaggggtgtgccaccattcccagctaatttttgtattttttgtagagatggggtttctgccacgttgcccaggctggtctcaaactcctaggctcatgcgatcatccgcccaccttggcctcccaaagtgctgggattacaggcgtgagccacttcaaccggcctcatttttcaaagagacagtaataaatgaaaggtcaagtcgaccactattaaagccatttactttcttgtaggtggctgccaagagacaagggtccttgaagaaagtggcccagcagttcctcttgatgtggtcctgtttcggcacaagggtgatccgggacatgaccttgcacagcgcccccagcttcggtaaggccaccccagccctccccatctccaagcactttttcctctgggcacggagcccagaggaatctaccacagtctaacttgctgtttctgcaaggtcatcaccctgaaacacatctcttctggggagacatgacattgttaggactttcagggagagagatggcattacatgctaaaggtggagtatcaatctgaaaatgagtggttttgcccacagatagtactatctgagcttaaagaagaataaattgcagtggctgtactccccatgcctagatgttcccagtgattgctgcttccaaagcacaatttcatagaatcccgtatttgtgcacttcccaagactgggcacatgaagaaacctctgagtttgaacacttgcaaatggcttgattgaccatactcttgctgtgggcagatgaccttaagttttctttaaaaatgtactctagtctaatccctaaaagagggcatttgcattcactttcccttttgtttcactgaccctttaagtcttcatcacctccaggagatatccccacctcaagtcttcatctgctgctttctagtataacagggcttgaaatctctgcccaaaggtactgataacagtctctgcgggcagcaacctgattactgaatcggggtgaatgttatgatacattgtaggacagttttctacttttcaccagaaagaaagcagtatgtactgagtccaggtcatcattggcaaactgagatgggacttttaggcattatccagacatttgaaatcccaaaacattttggtttcaattttctaggcattttcggcaaaggggcattggtaaattttctgggtaattgcttcagttctctatttccctttgcaagtaagggttgtggttttgtttctcattatctccaattaagccaatcagctctgggttttgctgtgggtttaatttgacacttttccatctagctttttatggtcttgtcaccattttccagttgtgctatacaacgaagtaaatatgtgggaaaacaaagaaggcactattttttctaaacagccctgtccatgaaagactgtgtttacccacttggagaagtgttttgttgtggatttctttaatctcagcattggaaggttctctgaacctgcctgcaccatggctacagatggaaattctctttgagctgtatatggaaatgctctgctgactgctacctgggcagtgccatcaggcatggcattttgatgacttccagttcagcacagttagtgttagcacatgttacctctagctctggaaaaatcattcatgcagaactgttttcccttaagtgaactgttggaaaatatttgagatttcttcattgcttccaagtcagagaatcaacaatatcacacacaaacacacatatccacatccacacagcgagcatcctctccatgctttatcctttactcttcaatttgcttattcttaaactgaccacgtatggtagcaggtgcctttcattagacagggaaagtaattcccttgcaatattctttgaaattcatctgtgcttactgagttaacagtcaatgtaaaaaagaaagcttgagcaggagaatgattaggctttatgaatgggttgaatttattactaagaaatatggttccttgaaatgtgtttctttttgaaccacacactcttttgggatagatatactggaaactcaggcaaatggcaaaaaaagatgatcacaaatcacttagaaaaggagaaaaagagatattaacccagtctcagttttacagtatttctcaaccctgagtgggttgaaataatacctgtctccaagtccatttagcaaactatctgaaatggcccagctcatctgactcattgttgaattttgcagcttggggtgacaggcaagttaaaagagtttgcagcagacaaaagcccagctccccctttctgcttatatatgtcaaagacccagttggtggttgtgtttgggtcatgtgttccctgtatgaaaacagctaattaggaaaaagagccctctgttccttggtcccctcccccagccacaggggccagctctatatatcttataactcccacatggtccttgtcgctgtgaatgggtacagggtttgtgtgtcagcgtagcaggctgaccattacaatgatcgtgtggaatatcacaatgatcctgtaggggactctatcacctcttcccagaacagcctctttcaaaggtagttgactcctttcttctccttaattccttttcactctcttctccttaattctttttcactgaaagaacctatgctgtgaactaaagtagccagactttctttctttgctgcaagcagtgtttctagcaaaattagttaccaaaggtaggctatcaggcaaacttttagtcctaatgaagcagagcaaatcaaagttttgtttttaaaaaacaccatctttttagtcgactgatctgatttcagttcctagagtacctagatctcaagttggtgccagcgcctttaccttttcattctgggttttcagcaaatgcctgcttatctcactgttatgaacatctggaaggtaataatagttcccggaagtactccagcatatatcagtttataaagcagcctgggtgtgacagctgaggggcacaattgcacaacacttccacagtttcacttttttacacacctgttgtctgacctagcatcaaagctcactcacttgggcagggctggggagaccatgtgggcatgtgtcagggagcggctcccagaacaagaggccatgaccaagccttcccaactgcttctctatgcttagatggcctggcccagctctcttttagacagaatctgctaaattgcaggaccttaatgttcgcaatgtcattcaggcccccaccaagcactaagagacaggaattgctttccctgtagtcaggagtggaagtaaaaacccagagaagagaggacttgcgtgtggactcagggaagtggcagattgaattcaacccgcaattgttcccatgctaaagctggagtttttttctgccatgctacactgccaccacctcatttacctttctttaggtaaaagaaaattaataacaacacagaaacatgtattgagggccgaatatactttagacattacattttctcaattacttctcacacaaccccgtgaggtctgaattactgccctcaatatgacagaccaggaagctgaggtagtacttgaaggatttgcttaacattagagataagaatgaagcaaagacaagataatgatgactattataagaaatattttggaagcacatactatcattgaattcttgcattaactctgcaatgtaggtaataatagacactttctaaagaggtgagaagggagcttggagaatttccttgcacaagatcaatgcagcaaatgtcagaattctgtttcaaaatcaaacctgcctgaccgcaaagcccattcctttttgattatcacaattaaggcaaatactctgggctcagatgcatgccacaatagagctagaaaaatttatttaatccacattgatggtattaatatttttaaaatatccatggattaagatttaaaaatttaaagctatgagagaaaagaataattattagactgtcatgagcagtaagagatgccagaagacaatggagtaatatcttttaagtgttgagaacaaagaactgtcaactattattcaagagtgagggcaaaataaagacataatcagttatacaaagacagaatttggcacccacagatgttcacttaaaaaaacaacaacaaaaaactattaaaggatgcatttcagctgggcgcgatggctcacacctgtaatcctagcactttgggaggtggattccctgaggtcaggagtttgagaccagcctggacaacatggtgaaaccccgtctctactaaaaatacaaaaattagccgggtgtggtggcgggtgcctataatcttagctactcgggaggctgaggcaggagaatcgcttgaacccacgggggcagaggttgcagtgagtcgagatggcaccactgaactccagcctgggtgacggagtgagactccatctcaaaaaaaaaaaaaaagccatagctgaggtctagaatacaagaaacaacaatgttctagttattgttgccattgctgtgtaataaattacctaggcttaatggctttaagacaaccattttattatgtttatggattttgcaagtcaggatcatgtgtcagctcacagttccacgtgcaagtgccccaaatgtgaagtcactttgcttttatgatcccttcttagatacagtgtaacttccctcatactctattggtcaaaggcagtcccaagcctaccatgagtcaaggaggcgcacagaccccaattgttaatggacggcacatcaaagaatttagggaccctgttttaagatgaaagaaatttaaaaatatgtaaacatatttaattaactattgaatgtaatttaaaaactaaaaactaatttgtatatgtgttttaaaaagttaaaaataagttctaggtaaaactataacatggagtaatgagaagagaatcttcaaggaacagttaaagcatgctaatgtctttgtcttttttaggaatactaggtaactttaggctttgttggagaaatttacagtttggatttaataaatgtttagcatatatgttaataaattaaggtatcattactaaaagaacacaatcatgatttatggaggaaaatggaaaaatatgaaaacttaagagacaaaacgttaaatggaaaagaagaattgagaagataaaagaagcatagaaaatggatggtaaatgaaagcacaaaatagcatggtagaaataaagaccaaatgataatcacaataaaggagaaagtctcttcctccaaaaaaaattaggcataaatgtttttataggcaagtttaactaaacttataaaaaatgtaaaatctttagtctatgaaaataaacatgaaaatcaatatttcaaagaataaaagaaaagaagaggccgggcgaagtggctcacacctgtagtcccagcactttgggaggatgaggcgggcaggcagatcacgaggtcaggagttcgagaccagcctgaccaacatggtgaaaccccgtctctactaaaaatacagaaattagccgggcatgttggcacgcactgtaatcccagctacttgggaggctgaggcaggagaattgcttgatcccgggaggcagaggttgcagtgagctgagatcgtgccactgcactccagcctgggcaacagagcaagactccatctaaaaaaaaaaaaaagaaaaaaaggaaaaaaaaaagaagaagaaaatctgttttcagtgactgcaaagtttaggacatcctggcccagcctaggatgtctgatctcattgtcctcagtgctgctttgcccacctcattcccttcaataaaatggtttgacctgcccccgcaaaataaggaaatgattgtattcttttagtaatgataccttaatttattaacatatatgctaaacatttattaaatccaaactatgaatttctccaatgaagtcaaaaattacttagtattcctaaaaaagacaaagaccttagcatactttattccttgaagattctcttctcattacttcgtgttatatttttacctagaacttatttttaactttttaaaacacatacacaaattagtttttagtttttaaattacattcaaaataaagaaatatacaactcattttacaaagctaacataatctcgatttcaaaatctggcaagaaaagcagaggaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactagcagatcaaatttagtggcaaaattttttaaatcaatattagactatgccaaaaatcctagtaggaaaaattaccaattaacatactatattaataaaaagagaagaatcataaaatcatcattatagatacagagaaaaaaagcatttgatacatttcagctctcaggtatggtttttaaaaaaccttttagcaaactaggaatagaagggaatttaatatcttaaagggcatctacaagtctgcagcaaacatcacacttaatggcgaaatgttagaaaatttcccatttctatcatgaaaagacaggaatgccttctaatatgatatctaataaatatgtactggaggtcctagccaatgccttaagaaaagaaaatgaaatagaagaattagaaaggaaaacacaaaattgtctttatttatagatgtcatgattgctggcaaaagagaatccacaaactaatagaaccaatgagaattcagtcaagttactgaatttagtttgtttttttttttgagacagagtcttgccctgttgcccaggctggagtgcaatggcacgacctcagctcactgcaacctccgcctcctgggttcaaaccattctcctgcctcagcctcccgagtagctgggattacaggtgcgcgccaccacacctggctaattttttgtatctttagtagagacggagtttcaccatgttggccagccttgtctcgaactcctgacatcatgatctgcccgcctcggcctcccaaagtgctgggattacaggcatgagccaccgcgcccggccctgaattcagtttttataaaatcattggcattcttaatttcactaactcgaaaatataacttaaaacatacacattcacacaattcataatagcaaaagaaactaaaatgtacctagaaataattctaacaaaaaattggtggtgattacactggtgttcattttagaattctctatatttttctatgatgcatatttttcataagaaagatgaaatgctttgattctaccaaatgcaatcaactatattaccatataacaataacaaaataaaatctccttttgtctctaatcctaatgcctttttccataacaggctctgctgctccctagctctgtgactttaagcaagttattcaagccctctgagccttcatgtcctcatgtattaactgaagataataccttctttgcagtgttgttgagaagttaaaagagcttacttagcgcggtgcatatggaagtagtcaatgcttgcctatttgattcatacatctaacacatatccattgagtctctattgtgtgcctggcaatgttgtagtcactgggtataaagcactggtcaagacagaaaaatctctgcaagatagagcttacaatctagtggaggaggcatgcaataacaattaagttaaatacaggttatagtatttaacttcgatggtgagaaatgctaaggagataaataaagtgggatgttcgctgtaactgcctctctcctcttgtctttggtgtctctctgtctctctcatcagtctttctgtatctccttttcattttcctgtcttcatcgatattcactatcctcatcgctgcgacactctggcaatgaactgtttactgcccaataatcttaatgattaatttctgcttagtaagaacacttagcttctgtggagtctgagactgagctttatgcctcctttgtactcagagcacttagcacaatggtaagcaggtagcagtagctctacaaactcttgttgtttgaaggattaaaatttagaatggaaaattaacagacaaactggtagctgatcagaggcattaatgaagagagcttgaaggcccatgtcaaatccgcactttccctaaagtaccggcttccaagttcagctctgatgttttctaagagtaatcttaggcaagtttcttcacctcatcagatctttgtttccttgtcttataaaacaagagaatggtataaaatgatttctaagttgtttgttcatcctaaaactactggtttggatttttatcatccaagctttccatgctaattcattatttcatagtacatttctctctttctatccatgttgactttagatcaacatcccagcaagtaatttcttcattttggagaccctttccttatttgatgctatcttttgacttgtttgactctatgaacaaaacaatcatgtcatgagatcttagaacatagcagcaaaagggatcttagcaataataataatagctaccaattattaagcatctaatatacacttttactcattttagtacttctgtaatgtacattttactgtccttttggagagctgtagcacataacgattgaggagcaacttcagagtcagacagtccagggttcaagtcttggttctgccgcttaatgactgtgtgacattagacagctactttacctccctaagcctcactttcttcctttgtaaaaggaaagtatcacttatctcacatggttgtgatgaggattaaatgccaaaataaatctctggtggtttacacagtggctgccacagaggcagaggtcaataaatgtcagattttgttttcagtatttataaggattagggagggtaaaggaactcatctaaagtctaagctactaagtggcagagctaggatctcaacctgggcagtttgatcaacagcgcatgtaattacccacacagtgctgtacctcctcagtggttcacaggatcccatttcagagaaacagttggaaagtttagttttagagactgcatctcacagtgattgagcagaacctggactttgctgaataccaaatggcattgaaaaacagacatagtactggagatggaagaaggatgtgaaggaggtgcaggacagtggaccttggccttgagctctgtgggaacaaggacaggagtttatggcaggctgtagagagagggggtcatgttcatgacctgctgagcatctagtggccttacagttaagccagggatcttcctctctagcctttctagaccaaaagaattaactgatctgagatgaagggtgtgggtgtatacagaagccaggtgcagttaaggagaaaatacataaatttcaccaaggagtgctccacaagcccccaactagcctccactaccttatgtctgagacttggagagacctagctcccagctcaagtggcccctgtaggggccaagtcacttatgccatctgggccttattttctcatctgtgctatgaacatattgaactaaatgacttataggggaatgggaacagattacggagccagaccaaactgaggcaaatccctacttgattactaatgaagagactcatttcctcatcggtaagggaggataataccatctacctcacagtttgttgtaaggaagaaacatatgttcagtgcttagcagagtttttggtacagagtaaacactcaataaacagtagatgtgatgatgataataatggtgatggtaatgatccatgatgaagacagaatgacaaaaaaaataatgccagagagtcccgtaaagtctctaaaaggctgggcgtggtggctcatgcctgtaatcccagcaccttgggaggccgaggtaggtggatcacctgaggtcaggagttttagaccaacctggccaacatggcgaaacccatctctactaaaaatacaaaacttagccaggcatggtggcacgcacctatcatcccagctactggggaggctgaggcaggaaaattgcttgaactcgggaggcagaggctgcagtgagtcaagacagcgccaatgcactccagcctgggcaaggtagtgagactccgtctcaaaaaaaaaagtctctaaaaaagcaaactagaaggaaatgggaaaaaagcaaacagtatactggtcagcttggagagaggtgagaagttttggacattttaaagggactgcaggatatctacatggagatgtcctattgggacctggaaacatgggatgggagataaaggcttggcccctctctctgaccctgggtccatgaggccttgattacagtagacattaactgagcccctaccgaaggtgcaccattccactgtgcatggtagcagcatgacatgcaaaaaaaagctggttttgaaataatgtattatctattaatcgtgtcatcttgcataagtgcttggcctgcaaaataagaataaaaatacccaccttgccacatggttgtagttattaaattagagaagataagactttgagcacagagactggcatataggaaagtctttaaaaatgactgttcacattcccttttacaaaataatctactctaaattgaaaaatgaagactgccacttgaaaagaccaactatttttaatgaattaccttttctaagaaccatgtgctaaatgaggtcttgaaaacatttagggaaataagtaaataacttgttgcagatttaaattttcaaattggctcctagaattatgtcaggtacattagtagatagcaatacaaggcaaagtccctgccatggacatacttaaagtccaattgggggaataatatgctggtggaagagataaaaatgagagacactatgttaataaatgccgaagagagtgagcggtgctcacatgaggatgaggccagtgggtaagcaagagctcagagatggctcggtgggtgccatttttgatggtgtcatactgatataacttcagcaaggaaaagattcacttgccacaaagtgttaatgacacttaccttatgccaagcactaggctaaggtgaggatacagccaagaactgcaacctatgaccatgaggagatcataattgagtggaaaattagactcttgagcagagcatttagaacactgtgtaacttgtgcagttgaccagacagagggggcatacacgagacagcacgacttactttctgtttgatcctttttttcaccagggtcttttcacctaattcacttaatgtttgatgactacgtgctctacctgttagaatctctgcactgtcaggagcgggccaatgagctcatgcgagccatgaagggagaaggaagcactggtaagccagcattttcctgggaattgcaccacttggtaatgttatttgtatccttacttctgtgctttatgtttctttaactctgtatctcaaagaatttagttatggtgaacaggttaagtggtatcaaaccaatcatgtctttttcctctttaaagtgggcatgtgggctgggtctggtggctcacacctgcaatcccagcactttgggaggccaaggcgggcagctcacttcagaccagagttcaagaccagcctagtcaatatggcaaaaccccatctctactaaaaatacaaaaaattagctgggtgtggtggtgcacaactgtagtcccagctgctcaggaggctgaggcacgagaatcacttgaacccgggaggcagaggttgcagtgagccgagtgtgcgccactgcactccagcctgggtgacagagcaagactccatctcaaaataagtaaataaataaataaataaataaacaaattaaataaagtgggcatatttatatacagaaattgccttgagtgtcatgatggtgatgggaaaccatcgaagagtttgacaagagagtgacatcacacagattagaataatatttcactttttaaagtcttttagagacacttgcctttacatttggttttaaaaacttaccctatctctatccacagcagaagtccgagaagagatcatcttgacagaggctgccgcaccaaccccttcaccagtgccatcgttttctccagcaaaatctgccacatctgtggaagtgccacctccctcttcccctgttagcaatccttcccctgagtacactggcctcagcactacaggtaatggaaagtccttcaaaaactttgggtagttaatgtttgaagaaagggctttctgccagcctgggcaacatagtgagacttcatttccacacacacaaaaagccagacatcttggctcacacctgtagtcccagctacttgggaggctgaggtgggagaattgcttgagcccaggagctacgatcgcaccactgcattctagccttagtgatacagtgagaccttgtctcaaaaaaagaaaaacagggctttctggaaaaacattcttctcccacaatctccaaaagataatgccaaaacctgggtatcttcctggatttgtgaatgacgtacaggtattcatttattcattggtacacattctgtatgctgctgttttcaagttggcaaattaagcatatgataaaatcccaaaactaagccactgaattgattataatgctatataacataaatacacaaacattttgaaaacaagaaagggaactctctgaatcaaaaactgagctgctttctttttctctggaaagggaggcagacaggaaactttacactaagctatggcaaccataaggaggcaagggctgtgatgtgagtgggtcttcagctaagctagagctgccgggcacatagcatgaggctgatgctaccgtgagactgtgtggaggcccacacagtccaagatatgcacaggagtctcataagattaatttacaaccaagaattacccaagcttggatacacacccaaaagaaggcagagatccaaacagatgtttgtacatcagtgttcctaacagcatttctcacaatagccaaaaggcagaaaccactgaagcgtcttatcgatggatgatggataaagaaaatgtggtatatacataaatggaatactattgaaccttggaaagcaatgaaattctgactcatgctacaactctgatgaaccttgaagatagtatgcttaatgaaagaagccagacacagaaggacaaatatatgattccatttatatgaggtacctagaatagtcaaagtcacagacacagtgaatggaatggtgaatgtcaggggctggagggaagggaaatgaggagttagtgtttaataggtacagaggttcagtataggatgatgaaaaagctctggagatggatggcggtgatggttgcacaacatggtgaatgtacttaatgccattgaactgtacacttgaaaatggttaatactgggcgtggtggctcatgcctgtaatcccagcactttgggaggccgaggtgggtggatcacttgaggtcaggagtttgagaccagcctggccaacatggtgaaaccccatctctactaaaaatacaaaaattagccgggcatggtagcacatgcctgtaatcccagctactaaggaggctgaggcaggagactcgcttgaacccaggaggtggaggttgcagtgagccaagatcgctccactgcactccagcctgggcatcagagcaagactccatctcaaaaaaaaaaaaagttaatatggatatatattaccacaattaaaagtcacccaagcatccgtggaagcccaattccatgaaggaggaacaacaaacttaagaacagagagagtctatatccaaaggaatgaagttaataggacaacctgaaaagtattgttaagatgagaactaaaaagaaatcagccaggcatggtgactcaccctgtaatcccaacactttgggaggccaaggtggaaggatgttttgaagccaagagttcgagaccactctggccaatatattgagacccccatctctacacaagctttttaaaaaagttagctgggcatggtggtgtgcacctgtggtggaggctgagatgggaggatcatttgatcgtaggagttcgaggctgcagtgagctatgatcagaccactgcactccagcctgggtgatagcctgtttaaaaaaaaaaaaaaaagaagaagaagaaagaaaggaaagaaagaagaaaaagaaatcatacccatgagagtcaagatcttcaaaaggaaatatataattgttgaaataataatttcaatagataggttgaatattagaaaattagattcaactgaaagagatcagtaaaccgaaagactgagctgaggagttctctgataatgtggcaaaaagaaatagtaagtataaaagtgatgttaagaaaaaggactgataaactcagaaattctaatattcatttaataagtgttccagagaaagaatagagagaaagtgaagatgtaatagctgagagttttataaaatggaataaagacaaggctttttagaccaaaagctctcattgaacatgtgctgaataaatggaaaaaaaaattacctctaagcccaatgaagaaaatcaaagataaaagaaatcttactagtttccccaaagaaaatgtatataacttccaaagaagagagaaccagactgatagcagacttctcatttgcaacattagattcaatacctgaaaccatacttttgaagtgtaaagaaaaaaactgcattgaaagctttggatctagaatcctatatatgtttattcatgtatatatgtacacacatgtatttttttttcccccgtgaggacattttatgtgccaagtcctgtgctgggtgctatgggaaataaatagattaatatgccaaggccttgctaccaagagggaacacaaggataaagaaaagtacagagacaagtgttatggaaggaagaatgtggtatatgcaataagtgagatataaactaatgctatgaggttcccaaggaaggagagattctatgtggctggaagtatcagggaagacctcacaaagattccaggctttatggagtggagggcttggtcaggctatgataattaattcattacctttccatccaaacctgctctactaccctcctgttacccaggcaacaaatacgggagtcagcttcaaatctttcctctccctcaactcctgtattagttagggtaggctaagctggtgtgacaaatagatccaaacacgggtggagttaacacaacagaaatctatttcatgcttgaagacagtactgctagggtattcagtcataaaggaggctctctgtaatgcagtcatttggaaacacgtgctccttcaatattaagctcccacatagcccagggcagtatttcccaaactgatccacagaccagcagtatcagtatctcttggaaacttattagaaatgctcttatctggtcctgctgcagacccaatgaatcagaaactctaggagcagagcccaggaatcttgttcagcaaacttccaggtgattttgatgctcactaggttaaggaccactgcctgagggctttgttaagtctgcaaccagctggcagaaatggaaaaagggcacggaggatgaaaaccgactctcttaaaagccctggcctgaaggtggcacacgtcacttccacttatattccatcagcgaggacttaatcacatggcctcatgtaacagcaagacaggctgggaaatgtagaatagcatgtacccaggcagggaaaggggaacagctttgggggcaacagcgggcattctccatcacacttcccaagtccagttgttctaatactaatctagactgatctgttccttcccatcccacttgtgcctctggttcaggccacccccacctctcatggacatccacagtgactctcaagctggtaccctgcctccagactctactctgtcctctcacactactcactaagtctcgttttcatgaagcctgtgcctcctcaaagtgctggggcaaagaacccactgcctcactctaaaagccttaaagagctctctttctcctaatcacttctcacactgttccttcttcttgggctagcctccttctaccctctgcctgataaaatcctactcacctcctttgatgtttccctcaccctccaagttagaatcttcctccagaccctcacagcatggacttaattatatcctaattctatttaggactgtttccagaatagactcggaactaaagttttttttttttttttttttttttttttttttttttttgaggaccaaataaatagggtcagattgctccattcaggagcatttactcatttactcacctatctatccatttctccaaaatatatttctcaggtggcttctatgtgctaaacactttcggataggtggtgatataatagcaaacaatagaagtgtggtccctgccccctgggagtttatgtttagaggttaaggttcttgatgagcaaactgacagtaacaatatagtgtgaggagtgctaggttggaagaagggtcagagtatcatgggagcatgaaggagaggggagaaaaggtattccaagtagaggcaagagagagcatgttatttttaggaaacttaaaagtatatatcccagagacttttgattaattccttccccaaagtttcctctctctatggaactacacctacttagagaaggattgagcggatgcttaagaaactggaaggacttgctatcttgtgtactagtcaataaactcagtggccctctgtcagggacagctaaggaaattggattcttcaaagtattgaaaagctgggttgttgataaatggcattagatcaagctttgatttcactttgggtacacagctagagagccctcttctgtggaaatttagatttgagatcgccgtatttgtttatatagatgcgcctcaaactgtattttgttttctgctttgaggaggaagaatgtgatcaggctcccacctccctcccattttctttccatagtgggttgttgtagttcctgcttagaaggctcagaaaaagtacgtgtagtgaaaagaatgactttgttcactgaacattaaaagggaagagaatttaagtaccattcgcagctcttcatgcagctctcaggagttcttcaaagattgggattattgggcaaccatcctgagtctcctttctccctaaagaaagagccatttacccaaataatcctgcccaaatatccctgtcatcaccagggagacacacacgagtctgctagtgataatatcctaacttctgaaataaacagggaaattatacaaataaaacagttctgcattatgaagcagaaaccatttggatgaaatgtttctcaaagtgtagcaacatttcaaataaggagacagactcaaagggaataagggatgggagggaagagtgtgaaagaaagatgtctaggatcttctcatagttctcatccagctagtgagtgtgcctggctttctttgaagcaatgtggaggcctcaagttatggcaggtgtgatagacaaggccacaggaatatcataaatggcttcagatatttctgtgcaatgtgttcaagagccataaacgtagcttcttagaaatacaaatgtgaaacaggttctcttcagatgattttaagctttgaagattttggcacattccagctttgttctcagatatctccatggggcattaaaaatgtcatcctatataagactatgtatgatatttttctcaagtaccacttttgaaatactccattgctaaattagactggatctgggcatgtaatgtgggtcatggtcttggagaaaagaaacccaatttcctaacaacatgtatgattatataggcatattatattataaagcacaaactatttacccatgctagaaacctaaatattaggaaatctattacggtaggcttcttaaattttcattgaacaatagtgtaaattgtaaaacaattatgtaaatcttataaaatgtatttgccatgtttctttttttaaaaaagtcaactcagcacatggttttcatgcccagttaatttttatttctattttaaaattatcgcttgacttatatatcccatctactttccaaaaagttttgaagtagtttataataaaaacagaaaaatcaatttcgtaaaaaggaccaaaaccagaaagaaagaaagaaagaaagaaagaaaaggtgaggaaaattaaatgaaacaatggttagctttaaaaatttattaaaatcttattaatatgtgaaattttatgtgacccagttatttttttgggtttccagcatatcgttgatcagacaatgtaaatattaccaggtttgacttgttgagaatcaaggccagtcaagtacctgggactctttaacaaataaatgtcccactttggatggacacttctccatttttcagctgtgaaaaaggaacagtattatgtgtgctcggtggcacaaagctaaaattaattcattgcacataaccttttggcatccttcgatacaaggactagggaatacaaggtagtacagataatgagttatgactcactaggaaaacagtcactctgcttatctgtagctacgtctagttccatgtccacatttctaaatatattttattgactgtacttattaattgtttttttaaatggggaaagaaagggaaatgaaataaatttcaggtacctaaaattaaacctgatatatggccaattttggttgggtttacggcaatgtcatgataagaggctggttaaaggattccattccaacagatttccacaaggtaagatctagcctgtctgtccattttctccccaaatttgtaggcttgctacgctccctcatgacctggcaaagttggcaaagtttagaaaccttaactttctttaaggaaaactggctcctttcctccttgggagcatggcaggcagtgccaaactgatcagtctatttaacatgacattgggctgcaattctttaatggcatctaaagcaaaacgttaagctcctactctgtcccatcgggccaccgaagggttctaaaacctcgtttatgatgtcattttaagtattccctccttcagcaatgacaataaaagttaactattaaactcatgttttcaacttcccaccatgggttccctgcaacacaaaaccagcaaattaaatcattgagatactaggatacttaatgaaataaaagcgaattcctcataaatggccctaactgtagaacatctggcctgcccagctgcattttctctacatcagttgaggatgtaacaaagataaccgacccttagtctttccaaataacaaaagcctagttattctgagggcagctaaaccgagtgggataggatggacacttcagccctgccacagagtctgcgatgactcatttacaggacctcagagttgtcagtgctagtgaattcctccttctttcgtccctgctacttccttttctttaaaggaatggaatcacgaaaaataagctgggattgaaaatagattgtttaattgactctttttttttggatcacaaaatcaaatcttagcttgctgctgggactttaggctccctcattcattcatttgttcattcattcaacaaatatatatttcgtgtctaatttgtaccaaatcctgggagtacagaagtgaaaaagagtaatagtcacttcccgcatggtacttacattctagtggtaagagtcaatacagaagtaaactgccaggtaaaggtgtaatttcaaatggtcaaagtgctatgtgtgaaaataatagtgtgctatgaaaaagtataaagtggggacgcatcttagttggtggtcagagatgcctccctgacaaggtgacatttatctgagacctgaagttttacaaggagccagctacatagaggttgcggagggaaaaagaactttctatgcgacggggaaaagcatgtgcacaggcctcaggcagcaaagagcttggcatagtgggaactgacaaatgtgtataataaataaggaagagagtggcaggagaggaagttgcagagataggcagaggctagattatgcagcaacataagaaggaactgattcatttgctgccccggtcagttctgtcaatcagattttgaccatggaactattggtaaagtgtaactcaaacagatgaggtttctagcttcaataggaggtctctttagacacagctgtcttaaggatagataatagccaatgacggaggttgcagtgagccaagatcacgccactggcactccagcctgcatgacagagtgagactctgtctcaaaaaacaaaaaaaaagatgatagccaatgacatacctagagatacaggtaaatatcaatatatagtcttctttccctgtctcaatcatgaagattacaggaaatgcttgtttagtagcaaatcctgtcaagcaacatcgtccaaatagaactttctgtgatgagatggaaattttttctatcttagctatccaaaacagtagccattagccacctgtggctattaagcacttcaaatgtggctagtggaattaagaaactgaattttaaattgtatttagttttaattcatttaaatttcaatagccacgagtggctataggatagggcagagcagctctagaatcttgacacacttaaaggagcttacaaacaaaaggcgtaggttaggttaaaacttgagcaatatctgtgatggttcacagaatcctcctaaggaaaaggttaaagcagtggtctccaacctttatggcaccagggaccggttttgtggaagacaatttttctatagactggggaagaggtgggggggatggtttcaggataaaactgttccacctcagatcatcaggcatagactctcataaggagtgtgcaacctagatcccttgcatgtgcagttcatagggttcacactcctatgacaatcgaatgctgcttctgatctgataggaggcagagctcaggcagtaatgcttgcttgcccaccactcacctcttgtgcggcccagttcctaacaggccacggtccggtactggccctggggttggggacccctgggttaaaggattcagtccaagatctgaaaaaaaagggtacagccaggtagcttgggaagcactctaaattttcagaagtctgtagcagaatctcaaagcttcaggtttttgttgttgttgttgttgttattgttgttgtttttgaaacagggtctcactctgttgcctagcctggagtgtagtggcgtgagcacagctcactgcagcctccacctcctgagctcaagtgatcctcccgcctcagcttcccaagtagctgggactacaagcacacaccaccacacccagcttttgtattttctgtagaaatggggttttaccatgttgcctaggctggtctcaaactcctgggctcaagaaatcagcccacctcagcctcccaaagtgctgggattataggcatgcgacactgcgcctcgccagcttctgatttttaatggcccttaacatacagaatgtgtgacaggaggcagtatgttatagagctttgttactcaaagtgtggttcacagaccaaccacattgtcatcatttagaagtttgatataagggcctcactcccaatctactgaatcagaatctgcatttttaacaagatctccagtgattcaaatacacattcaactgtaagaaacattgctatggaaagggtttggggttgggcagacctgcattgaaatcccaactctgccacttacctgagcaagtcatttaacctcttgggcctcaattttctcacctgaaaaaggaggtaatactacttacctcaaaaggttgttgtcaagactgaatgggtcaatgtataaaaggaaatgagcatgagatatggtttatgttggatgatcattaattcatttatttgacaaatcattactgattgtctattatattccgagcacccttcctgtcctgtgcttaaaaccccttccaaaacaaagcaaccttggggaagaagagtgttttgttggggatgggaggggaagaaaatgttcccctgtagcagtttcaatactgtaaggtgaccaacaactgctcctcttgggatctttataggattctcaactatcaggggcttccaccgctatcctcagacctttaaataaatagaaatgtgaggaggggaggggggaataagagaaaaatatgggaattgaacaaatagggaagatttgctattgttttaccgacaaaaagcattagaattgtcttaaaaactaagcacaaactgtaagctgcgcagattttcttttattagcttccttagaaaagcagcagcagcaattctcactggaggtctcactggtaggaaagggaattcaaggggtgttcttttctgctccccaggcaaaaagggtttctcacccaagccagtaggtgttaatctgcttaagcctgcctgagtggatgtgttagattgctggcacatgtccatttaggggttttgttccccagaccacaggagcccatttttccaagagttccactagctttttgtttgataacgtctatttctagcagcatttactccttcaacaacaaattcaatggaacgaaaatttactgaacacctactatttggcacaccctctgttggggatacagagatgaataaggaacagttgctgtgctccggggctcacacaaaagtaactgctgttgcattctctcaggtgatggctattatcatgacttcttcccactgcttggaaaaaaacatgctttggtttccttggctgccccgtttcaatatccattgacctcgctgtgctcgcctgaggtcccagaggcttcaagggttaattacttgcttgctgtggctggttcattgttctcccaaacttctcaccctttctgcttccatttccaactctaaactttgtttaatgtattaatgtttttctttttacggaggcaatacacattctttacagaaaaatacagataagtaaaataagggaaaacactgtaaaactctcctcaatcccaccactcaatgataacccattttaataaacatgacattttaaaaaactgtaacagtaatataatttcacatgaagttcaaaacatagaggagggcaattatgcataatccagtcatctgagttgtgatcattttggggatcttcccttcccattttcttgtacttataaatcaagcctaacatgtagcctgctaaagtcattatcttttgggggaagaatatggaatagatgtgcaaagcaggaaggggtactttcagctgtgctggtgagtaaggacactagtaattttatagaaaaacatgtttagaaatttgccgtaattggctaaattactgttgctattcaaatgtttcatccctggtaatagaatctcacccaagaaacttgcctttcttccctggggtctgaaatgagaaatacagaaatatctattttaagaagttctcatgtaagaatacctgaattcataatgaagagtgtttgcataccattaaaagcctaccacgtgccaaactctctgacatatattacaacagtcctgcaagatagatattattactcctgttttaaagatgatgaaacagaagctcataaagtttaacaggcttgcccaagatcttatagctagtacctggcagaaccagaacccagagcaaagagacacaacggtagagagtagaaagtgtgtggcacaaagtgtgtgggttcacagcccgactgaaccacccactcactctgggaccttgcgcaagttatttaacattctaagtttccttgaactggacttttgtgtgatgccattagcctgcagttagtgttgacaaaaggaaccgtccttagaatcaagatgaagtccattgtaagggtgttgaggacattgttgaacagttcatagttaaagatattgctgtttgctctgaatttggaggacagtaaactcctgagcgatcgtcagtcttagtgctcctaactattcaggcttccaggagcactggctcctggaaaactcatatctaagtttaaagttcacatataggaagaatttgggcggcatgtttcacctcattctgaattgcattttttgcctccaattctgcttttctttcttctttcattcccacttccattttattgtctcgaatcttttatattgctatacactcccttaaattcttttggatttaaccatcagtttcctcatctataaatgggggataacgttcttttaagggtgtgtgacaagcactcagcacagtgcatggtctgtaagagatgctcaataatggtgtctcctttcatactcttagaataaatctttgtcacctcattacaacaaaggacattatttgcattctaaaagattcttcaatttatgaaagggctcaccaaagggttcttttaacaataagccaatgtatttaaaataggacaccatttccacatttcttcaagggtattccttaccgagtctctgtcacataactggcacagcgctgatccaccaactctgcttcctcccactactccatatcaatgcagctcctctcatatgctatttgcaaagtccctgggatggaatggactaatttttaaaatgaaaacctttcctttatctttccagaggaatttttagatagaaatggtctgctgcagaaaatacagaatgggagatcaaattttctcttttacttcaccttaaaaatgtcctcccttaaattctttcatgttttccatgtacctaaagggggatgttgaatcccattacctctgccttctaaaacaagtttaattatttccaccatactaacatattttaaaatttatcagaaattaagttgtctgatgagtttagtattgctattaatgatttatcaaattatcattaaaaaaaattctagcccaggagcggtggctcatgcctctaatcctagcactttggaaggccgaggtaggaggatcacttgagacctggagttcaagaccagcctggggaacatagtgagaccctgtgtctataaaaaatttaaaggccaggtgcggtggctcacgcctgtaatcccagtactttgggaggcaaaggcgggtgggtcacaaggttaggagttcgagaccagcctgaccaacatggtgaaaccctgtctctactaaaaatacaaatattagccaggcatggtggtgtgcacctgtaatcccagctactcaggaggctgaggccggagaatcactcgaacccaggaggtggaggttgcagtgagctgagattatgccactgcactccagcctaggtgacagagtgagactccatctcaaaaaaaaaaaaaaaaaaaattaaaaattagctgggcatggtggtacatacctgtagttccaactacttgggaggctaagggggaaggatcccttgagcccgggaggtcaaggctgcagtgagggccatgatcatgtcattgcactccagcgtgggtgacagagtgagagcttgtctccaaacaaaaaaaaaactaaccatctcataaaatattaagcatttaattttgtcaggtttttatcccccagtctttagcactttcaaggtatccaattaaattaaaaaatagacaaagggaattcataatttgtatggaataggtcactgtccaggtcactgtctaataatcttcaaaaagacctgagctggcagagcccagtaatctacttatgtttgcttaaagcaatttgttggatccttaacacctgttgagttgagcgctgaaaagttaatttgcagtgcctatctgggctgtatttccccaggctttccttttccttctcgccctcccttcctttcttcctatccttcccttcccttttctcccttctaaaatttttattgagtgttttggcagtcaggatctgtactaagcactgggaatccattggtggccaaaataggccaggcccctaccctcatggtgctttctgtctagtgagggggccattaatctaatcacattcactaatgggtgtaggattacaaattgcagtaggcaccacttaggcctacagtacagtgagggatctggcctagtctggggttaggaagaggacagctttttggactgtgagaggaagaatgagtgggtaataaggcagcagaaacagcacgtgcaaaggccctgagttgctgggaattgtggtactctggagacaatgaaagatactgtggctggaccagacaaaacaaagacaggggatgggggatgcctctggtgagctcagcagagtcagagatacatgtcttataaagattttggccttcaacttaagaacaaagggaagccactaaagtaaggaagaacaagggatatgagaactgttaatgatcaagacgtcttaatttgtctctgcaggagcaatgcagtcttacacgtggtctctaacatacacagtgacgacggctgctgggtccccagctgagaactcccaacagctgccctgtatgaggaacactcatgtgccttcttcctccgtcacacacaggataccagtttatccccacagagaggaacatgggtaggtaactttccagggatgctgctggacttttaaaatttgatctaaagaggctgggcacagcagctcacaccctgtaatcccagcactttgggaggccaaggtgggccttgaagtcaggagttcgagaccagcctggccaacgtggtgaaaccctgtctgtactaaaaatacaaaaattagccaggcatagtggcttacaccgataatccctgctacttgggaggctgaggtgggagaattgcttgaacctgagaggcagaggttgcagtgagctgagatcgcaccgctgaactccagcctgggtgacagagcgagacgccgtcttaaaaaaaaaaaaaaaagaaaaagaaaaaagatctaaagaggggtttccttagcagctattttctcaaagaacaggaagggtgctaccctttgctgagttcccacaatatcctgagcactgtattgtgtaatccccacaacaaccagggtaggtaggtaggtaagaaggtgttagtgaccccattttagatgaggaaattgaaacttgtttggttatcttccattccccaaggtcacacagctggcacatggtagggcctaaactgagcaaatgtctgactccaaagcctgtgttcctccctctttactcctttaacgcctcagctgaaaacccctttcagcagttcccctgggtggctctttgtacacttcgcagaattacagagcttcatcttaggttcaagtcttttatgattccatttagagaagggcttccccacctgagggctggaggtccctttaggctgcagttattcatgaggttcaggggatttcccataggttctagcggtgttttatgccctggaaaaatgcatcatttgttttgcccatatttttttctttttcaaatacgtggagtgatgttgctgtgatgaatgaactacaaatccatacaaaagtgttacttgaatcctcatagctctttgccattatgcactgtctttatcaaaagacactaaccttacaatgtctaatgagcagtgatctgaaaagcacttatgatattaacaagagatcctgaccgggcacagtggctcacacctgtaatcccagcactttggaaggccgaggtgggtggatcacttgtggtcaggagttcgagaccagcctggctaacatgatgaaaccccatctccctactaaaaatacaaaaatgggctgggcgcagtggctcacacctgtaatcccagcactttgggaggccaaggcggggtggatcacgaggtcaggagatcgaaatcatcctggcgaacatggtgaaaccccgtctctactaaaaatacaaaaattagctagacgtagtggcacgcgcctgtagtcccagctactcgtgaggctgcggcaggagaattgcttgaacccaggaggtggaggctgcagtgagctgagattgtgccactgcactccagcctggcgacagagggagacttcatctcaaaaaaaaaaaaaaagaaaagaaaaattagctgggcatggtgggtgcctgtagccccagctactcaggagactgaggcaggagaattgcatgaacccaggaggcggaggttgcagtaagctgagatcgcgccactgcattccagcctggagaatagagcgatatactccaactcaaaaaaaaaaaaaaaaaaaagagagctcctaccatgtggtgcagtgggcctcaccactcacaggccaggttccaacagaccagttgtgggggacatgggaggaggagggggaggatttctcaggtcccttccacagttggcccagcataatgcagcacggcggtgacctgacagtgggcacaggcctggatgttggtgtacttttccataggttcaagtgcccctgagcagtcaatcgggcaaccattattttctcagggggcctttgagagtatttccacacatttagaatagactctgaaaactctgtttcagagagatttttgattcagcagaaatagcagaaaaaatactcacatggtcataggtcagcatctttaccataaatattttactaagaagaacagtgataataataggctatgtctacacaggactttctggtttatggagtgtgttcacacatacgatcctcagaatgaccgtgcgcagcatttttatggatgtgagaaacagggtcatgaaagtcacacagctagaaagtcgtggagcctgatttagaaccagggtctttgatgcctgtttgaacacgccatggtgctctccccccaggagacagcttacagaaacccactacatccttccccatgatgtggaagcagaggcctgagtgatacaaaaacataaatctcacagtggtttgttttttgttatccctatttgatttcaggatacaacaggggttttaaacacagcaggagtagaggtttccatcactaatgatgtttggctcagggctagatttcatccctgaacgctggctggggggtaagggaggtatcttctaggtgttgagggagaaggaaaatcaacctggggttttaagttaaccataacaaggccacaagagtggaaatggtaagaatcaaaaagaagaggccggacacggtagctcatgcctgtaatcccagcatttggggaggccaaggtgggtggatcacctgatgtcaggaatttgagaccagcctggccaacatggtgaaaccccatctctattaaaaatataaaaattagccgggcatggtggcacatgcctgtaatctcagctactcaggaggctgaggcaggagaatcatttgaacccaggaggcggaggttgcagtgagccaagatcatgccactgcactccagcctgggcaacagaatgagaccctgactcaaaaaaaaaaaaaaaacagatgaaagaaagaaaaatgggattgggggtgaaggggggaagaaaagaaaagagaaaaaagaagaaaaaggaaaaaaaatagatgaggtttttaaaaaggtgtcaaactgatctgttcttgctattactcacactattcaatgtgcttgatgcattttagatacacgggaagctataactatgggagctatggcaaccagcatcctcaccccatgcagagccagtatccggccctccctcatgacacagctatctctgggccactccactatgccccttaccacaggagctctgcacaggtgagtcagtggtcctggtttcttggccaggccttggtatacttggtgccaaatctggttaacacagttcataaactgttatgcatactgtgtgtgcagcgtgtgtgtccccaaggagaggacagtctttatttatttatttatttatttttattattatactttaagttttagggtacatgtgcacattgtgcaggttagttacatacgtatacatgtgccatgctggtgtgctgcacccactaactcctcatctagcattaggtatatctcccaatgctatccctcccccctccccctaccccacaacagtccccagagtgtgatgttccccttcctgtgtccatgtgatctcattgttcaattcccacctatgagtgagaacatgcagtgtttggttttttgttcttgcgataatttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacatgtgcatgtgtctttatagcagcatgatttatagtcatttgggtatatacccagtaatgggatggctgggtcaaatggtaattctagttctagatccctgaggaatcgccacactgacttccacaatggttgaactagtttacagtcccaccaacagtgtaaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcacaaatgtcttcttttgagaagtgtctgttcatgtccttagcccactttttgatggggttgttcgtttttttcttgtaaatttgtttgagttcattgtagattctggatattagccctttgtcagatgagaaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggcgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtaggacagtcttttcatcagtgtcatttctggcctccaatggctggcccacagtgggtgctcggccagtgttcatgctccatttgctctcacacacctggtcgctaaacagttttttttttcattctatcccctctttgacctcttcatgccaagatctaattggctgcatgtctgctgccctttttcgggcagctaccctcaccctgggccttgggtctcctttcccatcaccactctcctggtgcagaccctcatggagtcttgtcaggactggtctctcaacatcattttaactggccttggggtgtcccgtgtctgctcttttcatccagcccgcacaggtaatcttaagccgaagaatcctcctgaaatggatcccttttcaaatcactctcaggccctacatctccttgggctcctcactgtctaataagccaaatcagccctctgtggcctgtggggaatagacaggccattgcacttggctgcatttgggaaaccaccgctggacactctacctgtctaacacttccctgtgccttggctctgatccgactggtggccagttccactctgcatcctaagtatctctgtatgccctctgtgctcgtctcagctcaggcctttatcatatccagcttagatgaagacagaagccttcctggtggtctctatgcctctaaaatgtgccccatctctggtccaccccctacactgctgctagaggaggctttcggaaaaaaacccaactgaccgtgacactttccctgtctttggcacatcattgctttccaggacaagttcaattctttagtatgtctcttaagactggttacctttctggcctactcacaaactccctccctccccgcagccatgccagcccacatgtggttgtcttggatgtgccgagttcctccatgtctttgcagaaattgttccctctggctgggtgtctcttccccagtctcttcggctgggcattcatgatgggcattcatggcaatcatattgccgtctttgtggcattcctgaaagtaccaccttgagtcctccaggaccttattaggtgccactccctgggtttcctctctcagtagcatttctcacaccctgttatcatcaccaactttcctgtctgacgcgcacggagaccctaagctccctgaaggcaaagatgaagtccagtatcctcaggtcacagcacttggcacctatcagaaagaggagctaccttctcctgaacacgtgttgtatgccaggctctgcgctgagcactctccacatcccttagataacccctgcagaagaggaagtgagactcacagtaacctgcctgaggggttgaacccaggcgctgtgactcctgtccaagctctcaggcaccaccccctgccgcctctcagatgcaggcattcactaagtgtacactgagcagatgagtacatgggaggtggcgtcagcatgaacaatagtatggtgtgctgagcacgctcactctattctgcaggcacaggaagctacggagtggtaagatcagagctatgattaagaaagagagctctcagggcccccacaaaatgaaccaagggggactggtggaggcagggggctctgctccaaagcacttgcagaagtttaggaatgagatggcaggactgacgctagcatggaggctgtaattacatcagctgttagcacaaagacttgtctctgagggaggacaccaaggagaacgtatccacaacacatgggcattctgggcaaacaggtgtttgttttgatttccatctgcagtaccaaggggagccctggtttaatccccagacaagccaagaagttgattccaataaatcatcacctggggcattcattataggtctccaactgcgtcacacagagatgccagctccttaggagctccgtctcttgggagcactctgtgctcctcactgtgatccactgcatgactgagaacggctgcaacagcctagatcactccgcacactccaagcatctcattcattcattaatttatttctcaaatggctcctgggtaactatgtgcaagcactgcactagccactgggagtacagtgagaaggagacagagcatgcctgctttggtagagcttatgctccagtgggagacagcatcatcaagccatagttctgggcattgtcttccctccttcttcacttcctcattccccctcatgaaatggcaggagctggttttctggggtgatatttttaaagccattgccataaaaagaagccaaggtctcctcaaggcctatgaggtcctgctctggaagccacaacagtccccaactggaacactgccatttaatatctggtcttaatagaatggcccaaggacaagtgaaagcccatggaagggcccttttaatccagacaaggtgtgagagtccaaagggtcctaggccaggctcttcgccaccatgccttgtgactcttagacgagtgcctctgacactcccctcaatatacacacactccacacttcatggtttatgccttagtctccatctgtaaaatggggtgggaagaaattaattatatcagtctctacccaggttgatgagtgaggtcagtgttcaaaatatactctctgggggaaggtactgtctaaagacaaagtatcctttgttttgtttttcattaacatttattcagagcactgttctaggcatatttaaatatacagactcacttaattgccctaacaaccctgggaagaaagcatttttggagacaggatctcactctgtcacccaggctggagtgcagctgcgcaatcttggctcactgcaacctctacctcctgggctcaagtgatcctcccacctcagcctcccaagtacctgggactataggcacatgccaccaagcccagctgatttttgtgtttttgtagagacaaagtctcgccatgttgaccagacatgtctcgaactcctgggctccagtgatcctcctgccttggcctcccaaagtgctagggttacaggcgtgaaccaccacacctagacttttccctcagttt

SEQ ID NO: 15136 - DNA, 19510 bp, Human
  misc_feature (1)...(19510): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacttaaacatttgagggtgttcttgagaaaaggtattaaacttgtactgtgtacttgaagctgtctgacttaggaccagtgagagtgcagcttcccatgaggaagaggttgaaaaaatcctacaattgtaggaagtttgtggttatttgagatcaagcataggctagagttcatgagtcttaatctgagtcatgatacattgaaaggtcatgatcaattagttgtgaactgtattctgcccttctgacaatatgttacaaatattttcaaatcatgtgtagtcatgtgttgcttcaagatagggttatgtcctgagaaatgcatcattaggtgattctgtcattgtgtgaacatcatagagtgtactcacacaaacctagatggcagagactgttgctcctggactacaaacctgcacagcatgttactgtactgaataatgtaggcaattgtaacacaaaggtgggtatttgtgtatctaaacatagaaaatatgtagtaaaaatgtgatattataattttatgagaccactatcatatacacagtccatcactgacccaaacattgtcatgtggcacatggctatatatgtaggtatatgtgcagagtcaagatttaccctttaatagtatcacttccagtagaattctgaaatgacttcttgaaggaaagggggttggttacagctgggacacttggaaatgcatacaccccacagactgatattcctgtgcctctgacctgggtgagaacacaggaacatgcaatgaacatgaacaagcattgcagatggtgttgtgaaagaaacctggagaaccaccagggcaataactacttctgtacaaccttgtagatgggattccttacccagatacgcgctctccaggaaaataatttaaagtcagtgtctctttaactttaatttggtttgtacatgacatctacatatcaatatattgttcattttaactgtacatcttgctttttatatgtaaatactttgggtgaccatattcacaatttgtaaatgtctttcactgtagggacagaaaggggacattggccctccaggatttcgtggtccagtaagtgtgattaaagacaatatcaatgctatgtttgatcaagttctttaaagtagcaaggaaattttgaatcagtgtctctcattaactgtgtgagagagattataacatttaccttgttgtcaaaccagggcagaaaatagctggtcactatgtgtccctttgaccacgggtaaatatttctatttggtccctggaaggcactagtgatgcccatgatgggctatggaagagaagaaaagctttgtctaagcagcccaggcccaaggtgatcctgccccttcagggtagaggacagtgagacaacaagggatgaagaagtcaacttctcctccctccacctgggcccgggttatgacaacgtgtttaatacatggtcagcaaaaagcaatcattccggcccaagctctgtgtagcaggcagtgctccccttcccagtggacatgtatttgatgtcagctcctaactgcagagcagccacattttatattctgtgactctgcagctgacgaaaaggagaaaggggacccggactctgagtgctggtgtccattcatctcctacctcaaaaaacagtggttctcacattcagtgcgccaagcaaggctgtcgtgaatggtcatgcaggttaaacaaaacggcacatggtggcaaaagggtcatgaggggaaggggtgtcctgttaaaaatgcagttctcagacccccatgctcagtaatgtaactcaggaattggagtggggcctggaaatctgcatctttacactggatgcatagagcccctgtcttagtctgttctttgctgctacaatagaatacctgagactgagtaatttgtaaagaacagaaatttattttcacagttctagaggctgggaagtccaaaatcaagatgctgacccttggtctggtgagggcttttttggctgcatcctcacatggcagaaagcagaagggcaagctgacctgaggctgctcaaagcctcttttaatagggccttaatcccattaatgagagagaaacactcatggcctaatcacctcctacagaccctacctcttacttctatcacattgataacacctgaattttggagggagcacattcaaactatagcagttcctaaatactttagtggagttgccaggaagattaaataagtattttgtgaaatcacttagcactgtgcccaacacttggtaggtgcacgcatatcattacagatttcatggtggacattattatgttatattattaatataatacttttgtgattttatatatattgcttaaccacaaggctcttgttaaataagtcaacaaagtaattgatccatctagcatatgaaaaagcaaagaggttttttttttttcaaacctttgatatttccaccttttttccttcaagataaatatactgaatgctaaatgaaatctaccttttcattacatttcagaggaattcttagcactcttcactgtatattttcttatattcaattccatataattctgtttgcagcttctactaacctcaaaagaagttccacttaggaaggaaatggttaagaacaccagcagtaggtccactgagcatgtcagaaacaatattcctcgattcttgcaggtcaaggattccctggaatttaaagaaacaataaatacagtattttttgatgtgtgggttccatacacttccaaaatggaaataagttcagtccaccaggaccagcaattttgaaaagtgaagtagaatagaataaaaagtatcagggttgatcatatgttgtaataataagtcattattttgtgaaactttaatttttctatacatatacacacatacataggtatgtatgaatgtgtacatataaatgtgggtgtgtaaactgagtcacatcataaaatgtatttctaattgaaagcccataaaatatctgatactgtgataccacaaaggtctacttatttaaatttttccacctacatttacatgactatcatatacctgctaacatgtaaacctatgaattcaggaaaataaggaagccatctttgggccaaaatgaagaaactgaagtaatgatgtttggtgagctgtccataaatagctatcctttctctgtatttgtttctttctcctctaagacagaatattatgacacataccaggaaaagggagatgaaggcactccaggcccaccagggcccagaggagctcgtggcccacaaggtaagaataaatttcttcctaaagcatttgctgaacatatttctggctttctttcaaggtaataaatagcatgtgcttatggaattgacatgggtgaggaaagggaacagagatctcttcattttcataaaggtgttattttttgatgtctcctgctcttcatatttttatttcataggttgtataccaggaaggtaattaaattatctttatgtagcaaaacataaagttcaaatctgtcatggaaacatttgctggagggcaggaggagggagtgcaaggcattggcaatctcaatgggattacgaagggaaaaatggagaccgcgaacaaactcacacagagatgtgcaagggggaactgaaaccctggtttcctgatgcttgaagcaatgatctgtccttgatgccgtgaattattgtcacatgtacttatgctgtatcactttggagaaatccaaaagttctgggccaatccctctcatctctggctacatattgaaaaccctgggaacttctataatggcctcgtcaaggtcccaccctgtgattctgatttcattgtctggaggagggctctggacactagaagattgtaaaaactccctggactagtccaatgtgcagccaggattgggagccactgatctagacaaattattgctatgaagaagatttcaaaggaaaattctacttaaaagaataaaatttcccagtgtatttaaataaaaggacagatgaatacagacattgatatagattttcttaaaaatctggtacacttactgtaaatcactcacatgtatatataaaggaattataacccccagaatattacagatggaagcaatctaagatggaacaccaagacaaactgctatcctggatgttccagcactgtttgattttctggtgtctacacttccagcaaagtgctaaacacagagcaggctcttagtaaatctaggctgaattatgtgaaaatgataaggcagcatgatttacttttgagtgttagacttccaagattagttttctcttgtctaaataagtgaaaatttctgatatttgtctaggtgagagtaggaaaaaagtatgaaaactctgtattattaactatcagtatattgtcacccaagattccaaaagtggatgggacagcatttatatctttctaagcaattaattaatgttatatattcccaggtcccagtggtccccccggagttcctggaagtcctggtatgtccatgtttcttggggtacaaatagaaatgctattacaaaggaaaataagctgtcctctattaagtttacattatttacataagacaaatgtttcattaactgatctagaagtgtttccaggctgggttcaatggctcacgcctgtaatcccagcattttgggagaccacggcaggtggatcacctgaggtcaggagttcgagaccagcctggcaaacatggcaaaaccccgtctctactaaaaatacaaaaaaattagctgggcgtggtggcgtacgcctgtaattccagctagtcgggaggctgaggcagcagaatcacttaaacctgggatgcagaggttgcactgagctgagatggcaccactgcactccagcctgggcaacagtgagactctatctcaaaataaaataaaacagtgttctcagcttcttaaattgtcatctttgcaatttatagtggaagaaggagtggagctgatacaaactgatacagaaatgctctttttctcttctcagcagttttaactatttgcaaaagctttattgtccgggatttttacagtgacttttggagtatgagcagggaccttgaaactcagaggaggtacagaaatagaaaacaatgtcatggtaatgaggttgcttgaaaatgatagttttcataacatatcatgagttgcataaggatacctacattacactttttctgtaaagttctaaactttcgtctctgactcattagagtgtttaccttttgagagaggaaaaagagttggatcagggatggtccacagggactcatcaagtataactgtagtgtgttctttttaacgaaaacaaaactaagaaaaaagagcaaaatttgataaactactgggcatgtgccctgccactgatcatatttttctctatatgatgttgtatattatactacttcataattttgaaaattaatcaaaataaagcagactgcagaactataagtatactataatttcactattaaaaaaatagatacagaaatggataaatattatatgtacctgaatatgcatggaaagatatacctcaaactgttaatagtagatatctcttacagttagaatggggcaaaaagatattttagagctctgacattaaggaagacctccttccccctgccaggcccctaagtaaaaaaaacaaaacaaacaaacaaacaaacaaaaaaacaggctcctttaataagccgatgagaggaaaactacaaagctctaattccagaagaattttaggatagttttttctgtttctgtgaaaaatggcattggtatcttgataggaattgcactgaatctgtagattgctttgggtagtatggtcattttaactagattagttcttctgatccatgagcatgggatgtctttccatttgtttgtgtgctcttcaatttctttcaccagtgttttatagtttttcttgcagggatctttcaccttgttggttaaatgtattcctaggtattttattgtgtgtgtgtggctactgcaaatgggattgccttcttgatttcttttttggctattccattattggtgcataaaaaatgctactgatttttgtatgttgatttcatgtcctgcaattttactgaatttgtttatcggctctaagagtttttttgatggagttaggggtgaagagagattggttaatgggtacaagcatacagctagatagaaggaataaattctaatgtttgatagcacagtagggtgactatagttaacaacaatgtattgtatatttcaaattaactggaagagaggacatgaaatgtactcaacacagaaatgataaatacttgggtcaaagatactcaaaaataccctgacatgatcattacactacacatttgatacatgtaacaaaatcttacatgtatcccataaattagtacaaatctaatatgccaaagtaaaatatgattaaaaaaatacaaaactctgaaatggatgtcaatcagaagattttatctttgtgttcaaataataggacataatcagatattaccccggctggtttctcagtcctttgctggtggcatctctcttcttaatagttaaactgtttgtgggacagagatttgagactgtcccctcctcacatcctcaccactttaagattagggtggggttcgtgccaccaggcacggctcctttcccaggagatgactatcccccatcacagccttttatgtctaagacactggcaggaataaagtccacttaacaactttctctctttctcattttgcgcactgggggcatcctctagtctctaataaaaaaaatctacaaagtagcatatatggaagtattcctcacttccttttaaataaaaagactatagtgcatcccaaactctgtttcagtttcttgtaataaattttcttgtgggaatggaatgttctgcacttcactgtactgtggttatttaacaaggccacagatgaaaaaagcaaggatattcacttttttattttatatgtgttatgtacctctccattgtgcaatttttataaataaaattaaatcactcttgcaattaaaaaataaattcgtattaatcaggaaaaaatgtaaaatacaagaaatgattattttctccaaggatcatcaaggcctggcctcagaggagcccctggatggccaggcttgaaaggaagtaaaggggaacgaggccgcccaggaaaggatgccatggggactcctgggtccccaggttgtgctggttcaccaggtcttccaggatcaccgggacctccaggaccgccaggtaaagatgtggaaggggaccccttttgtgcacagtgccaaatgacagatgtgtgcaaaccacgggcaacaaaccctcctcacagcttagccatcagtctgtgtggtttttatgagttacctttccaatggtcttcatttcactaactgtctgtgaaagaaactgatgcaatgactagttaacaaatgcagcaaagtcttagcctgagtttcccagagagcagagtaggaggcagggacaaagagagtgatgtggggaaggatgggtggctatcaagttggccttgaccaattgcaactgcctgttcagccctggagactatctgtgccaggggagaaagaggcaagaatttatccatttgctcctagttcccatgggtcaaagannnnnnnnnnnnnnnnnnnncccccacctcccatcctcccacttccaggctgtgtctgcatggttcccaggaagtcccatgccttggcatcagcagggaagccccaggacagtaggccagaggtgtgccgcatgggtgtaaggcaacatgctatgaggtaaaggggtcagagatgacagagatgtggcccaatggacttgaagtggtgctcagaggtcctgacacagggagcctttccttcgcatccctctagagagccacttagcattctgtgttggctcataggtacaataggtcctcacaaacatatagatcacactttatattttaacataccttttctggggccaggtgtggtggtgtgcctataatcccagcttcttccaagtctcttttaagatggaggtttagtatcctctttttttctatgtcaaggctgacatacagagttcacagggctaatgaagctaaagctgggatctgggcccaggtgcttgcggctctctcccgaaggtgtcatgctccctctgtgcctgctacactctgtccaggggtctttgcttcctactttcccttcgctaagcaacacccatctgtccttcagacttcagcttcaagttcaagtccagcagaaagctttcagtgagtccacatcctgtaacctccaaggttatcccaactatagaagttttcacattgccttctctttgtatttgtcagtttttcttacaagaatcaaagtattttgaggtcaaagactgtgtctttttggctgtttaagcccagtatgtagcatggggaacactgcaggtactcagatattttttgaattaagcattaattgagtatgaaaatgtataagtatacaaaaatgtatgaatgtagaagtattcatataagtctacactaagtattaaacttttatcagattgtactatttaaagatgaccttccaggtattttaaagatgcagaaaactgatcacaagatggtcattctgtgttccaacaaaattaaatggttccagtggtaccttgtttttctgaaatttgggacagctatggtagtgtttttaaatatttactttcatcaccattgccttcaacctgtaattgaaatggcaaagccaaaaattagattactgaacacaattaaccagtttaagagaaggagctgttcattgcaacattacagtagcagataatgtggaagctgagaagagctttcttagagacctgctttaaggatgacaactcaattgatgtggacaagcaacaaagagaaaacagatgataccctgagtcagaatccatttttcttttactcaatatatattaagcatctacagtatatcaggaaaatacaatgtatccaaaaatatccagaataagagttgatcctttgcctcaagatgctaaagggattgtctgtgtattagtccattctcatgctgctaataaaggcatatccgagactgggtaatttaaagaggtttaattgactcacagttcagcacggctggggagtcctcagtaaacttacactcgtggcaaaagcagaagcaaacatgtccttcttcacatgatggcaacatggagaagtgctgagcaaaatggggaaaagcccattataaaaccatcagatctcataagcactcattcactattacaagaacagcatgagggtaactgcccccatgattaaattacctcccaccaggtccctttcatgacacatggggattatagaactacaattcaagatgagatttgggacacagccaaaccatatcaacttggaataattggaaacaactaagtaagataaaataggttgattctgtgaccaaaaaaaaaattatacaatgagctttcaaagatcaactaccttaaaaataccacatctatgtaatatgaagggaagagctggtcaccatgctttctcagttgcagataaacttctaaagactaggcttccaatacaaagatgagagagatgcattttaaataatacatatattacaatacttgctaattgaaaaaaacacaaataaaaaattgtctttggtgctgtatttttataggtgacatcgtttttcgcaagggtccacctggagatcgcggactgccaggctatctagggtctccaggaatcccaggagttgatgggcccaaaggttggttcaatcaataatgttgtattaggataagcctttttcatcgtcattattatcactgatttttccccctgagataacaatgatcccaaatagctaccagtcagtgatgacttattttccattagctaaaagtattcatttatctgtaaatcaataatttatttggcacccatgcaataaattgttggatatccctaaaatgtgagtttttgcctgcatgcaaggaaagaaacactgaaatagatgttttatgttagacttttggaatttcccctttcagaagaactgtatagctcagaacattaaagtaagcagatctataataaatgaatttttaaattaatatgtataacgtcctagataattttcactacataaaaatgtttaaatgtaataaatgatagtgtggttggaaaatatttgttctttctgaggactcaatgtagctttttaagtaatgctagtatgctctcattgcaggagaaccaggcctcctgtgtacacagtgcccttatatcccaggacctcccggtctcccaggattgccagggttacatggtgtaaaaggaatcccaggtacaaacaatttgcatgcaagtgtttttgcaagcacaaaagggtcaatacactggaagaaaataaaggcattggattggtggatgtcacaacgtggtttagatgaacttggagggagagtttcaaaaacatatattctattaacataaagtcagccaaaatccaagaaaagctggtatttttccctattccattttagttgctgacccctagcaaagtattgtgttaggcaggaattgtgaacacagagtcctacaagagaacagcagttaactgaaggcagtgaagcagctgcatgaaacacacaccctctttctcttccataaagaaatatgctctctccctttttttctcaaaagacacaaccctactcagtccattttttcatgttcctacttttaaaagagtcatagaaaaatgtggtatttcactttcttcttaaggatgcaaatgctctttaaaaaattgcaacatcctccgtgctggggacaagagagttgcagaaatgcaataaacaaactgagggtacatttgaacgggccagcgggcacttggctgcagcccattgttactgtgcaacatgtcaggccctgcattaataaatcttccaagttttcatgagaagaaaggaattggaatttttatttaaaatctcatggtgtttttttaaaaaaatattagccactaagtcaaattttgaaaggaaaaaaaaaaaacacaacattttatagccagtgtcctgaggcttaaataaaggatgagtcacaagccttctcttgacaactgtgtgccaggccaggactctccacaccacacggttactcccggctgtcaccacctctgctttcgacctccccgtcttcagtcacagaactgcctatgggcaaaactttgaagtacaaaacgtctctgtttactgactgggttcctctgcccctcgggccactcccctgactacacagggcctctctctccctcgctaccacccacagtcctgactctgccaccagcaccttggtcttcagacaatgtcatcaaattatgtatcattgaccattgagaggtgaagttacagagcccttggcctgtgtgttgggcgctgttctaagggtcttatgtgcctccattcctttatctctcacatcagccctagaggctggtgctataattaaccgcattggacagatgaggaagccgaggcatcaggtggcatagctaataacatggtagagactgaactgaaatctagacgcgtgctcttaccctccacgcctgcatcccctgactgcggtgctgtcgcctgtctcctagggggctgcttttggggagttaatccaaaggtctacctgacaacctggatagggaacattatacattatcactgtccagtagccatttgcattggcatagggtcttctgggagactgggtctcaatccaaagatgaaagactaatggcggcagccgtgaacactgtggtcagccactggatgacatgcacttgggcagggatcctttgtcccctcagatcccactcacttctcctttatgaaggcctctgctactttcagtggctgcccctgccctgactcacaggcttgtgagggaaggggcaggggggaggtaggagctgttcctcttgttactcctgttcagtatccaaatatccagcggaaatgttctattaaaacaaaaaccaaaaggaagaaaatgaaggagggaaataaggaggaaaaataataaaagataaaaaatcattattttcctatactctccttgagtctcctctttggctcaaggggagcaggtgagcagctcactgatgctgaccacttattgcattgttgcattttccatagtttctctacatttggcctatccaggtgcagctcaaagaagatatgtaagcagtaaaatggtttggatcactataaaaagatacaccccagctcaagatcttgcaaaaaatagaatctgaataaatatgtgttgattaactgaccaaagacccacccagaaggtcatttaaagggatcatcttgatagagatatttaaatacctatgggaagtataaaattgtacaataaaatgcaatttggcaagagacattcaaaaccttagaaaagtttgagactatttggctctgctattacacttttaaaaatttattataaaggaaataattggataaatttggagagctaaatacccagagacatttttcaaagcattgttcacaacagctaaaagttgaaaaatgtctacctaatgtctaaatgtctaaaaacagcatttagctaaataaatgatggctcgccaacacaataggcagcatgcagccatttaaaacgaagctataaattcatacttattgacatatgtatactataaatccaaaatagtgtgtctacgagtcctatgcacttatggatataaaaaatgtatcattaatttacattaaactttggcaaatattatcttctggtagatttataggtgatttttagtctcttctttctgcataattttcttataatgagcatatattacttttaaaagtaatatatactcagaaaaaataaagatatattcttaaaattatgaagataaaattttaagaagctaagatctgagttactttttacatgatctcttgttctgttatttactcccattctcttattgcatttatgttttatgatagaagttgtctttctttccccacaaggaaacactctattttcttcatacattgtattaccctgtctacttagagttggcgttcaatgaggagttagttaataattcgttgatttgcaggaagacaaggcgcagctggcttgaaaggaagcccagggtccccaggaaatacaggtcttccaggatttccagtaagatttcatgtttttaaatctttagcttcaatttgacaaattgcacactctagaaatatggttgcaacacacttaccagtttggtgccttgcaaacagtaggcacttaatagatacctgttgattaaatgaataaatctgtgactgattaagtgaatgagtcaatgaatttataaacagtttgaaatggtatcagaaacagaaagcagattagtggttgcctagggctgagagtgggaacagaggttcattgcaaataggtttgagggaatttgggagagtgatggagatgtttgaacgtgattgtggtgattgtggcataattctataaatttactaaaaatcattgaattgtactcttataaaggagaaattttatggtatgtaaattatacctcaataagtccgttaaaaattagaatcttgactgtcatagtgaatcaaaaagttatagataaatatacttagatcaaactattcagagaggcttgttaaaatttaccaatattcaaacataacctgtattatggtgattgttctatggtattaaattatattattgtctgtattgctttgaattatactatctaactgaattatttttcagttttggaagttaacaacaaagcaaaacaaacaaaatgcttgtaataatagttgtggaccaaagagtgtgttgaaaaaattcatgttaaaattgaaaagttcttgtccacactgtttttaagattgacagaagaagaattctaacaaaatacaatacagattcatttgtgtactaccctagggtttcccaggtgcccagggtgacccaggacttaaaggagaaaaaggtgaaacacttcagcctgaggggcaagtgggtgtcccaggtgacccggggctcagaggccaacctgggagaaagggcttggatggaattcctggaactccgggagtgaaaggattaccaggacctaaaggcgaactggttggtatttagcaactttaccctccctataaatgaagtactctgaagttaagagataaagtgatttcttttccaaaaatggttggccgctcagcacagttcatcactctaactgcagaatgaaacatcttcaaattagcaggaataacccaagcaaatagttatagtattttgacagaataaataggtagcattcagtgatttcaaccaatcaaaattctacattgataatgaccccatctcatacacaaattacagttccatatttgtatcaaatgagtctatggaaaagttcagaaaatgatgtatagtagaaagtttagtaaatattttggggcgatgtccatatttttaaataaaaataaatgcataagaagacagcatatttaggggtatggtagtcaaataaagagattaaatgttttgtcattcatttaattttatggaaatttaatcccttttcatgagagagtttctcacatatttaattgaggtaatacctaccaagattttttttttttttttttttttgagagggagttttgctcttgttgcccaggctggagtgcaatggtgcaatctcagctcactgcaacctccatctcctgggttcaagtgattctcccacctcagcctcctgagtagctgggattacaggcatgtgccaccacacccagctaattttgtattttcagtagagacggggtttcaccatgttggccaggctggtctcgaactcctgacctcaggtgatccacccaccttagcctcccaaagtgctgggattacaggtgtgagctactgcacccagacctaagatttattttaaaatgtcacagagtgagagggtgagcacctgtcatcataatgtatttacaagaggtttgcaagggatgctgcccaaactattactatgaaataccagtttctcccagggctaatctgtgttagccaataaaacagatcttacctcaaagaggtttggagaaacttggtaaacaaatttaaagattcatttacagaccctttaatatcagaatatgaactgtgagtcttccacatgaagataagctatctggtctttcctaaatgcttctgactacaaaaccctttttggctggcagcatctatggtgccagcagttctcagaccctgccttggccaagtcccaggttgttcactttgtggtagttatgcttataaagtgacagtgccagaattctgatggtctaatattaagagaatttgtatgatgtccctacttgcatctcactgatttttctttataagttctggtaaagatgctccataaagtaaatgagagaaaaatcaaggtggtgatttgttgagtcttacaccctgtcattaaaaaaggagacagaccacttagccatctgatgatattgaacaatgaaaaattgagtcaaatttatttcagagggccatgttgggaaggaagagggcttaaattattttgtcaaattcaatttcttttaaatctacaaatcattttcaaggttatagcatatgaagatttaaaaactagacagtttatgagagaaaatggaagtgggaaatcccctttgtcatgaaaatacctggtgaaaccagaaataaaggtttgctgtgctcattttatttcagaaatgtaacattatcatgaatatcaccactaaagtcatttgaactattggtcaatttgaacatagttttagtggctattaccatatgggagacccatcattgtaagatatctcaagtgggactcaagacagttccaagttcaaaaaatgttgctaaactccaaaggacacaaaacggaagaaacctgcagtgctcttactttagtaataattctcatcaaatgccaaatgcttttaattcaagatctcaatgacagcctaactggtattcatatttggaggatgattaacctgttgtaagaatatactggaatgaagcacgattcaaacacattcctgttgtcacaggctctgagtggtgagaaaggggaccaaggtcctccaggggatcctggctcccctgggtccccaggacctgcaggaccagctggaccacctggctacggaccccaaggagaacctggtctccagggcacgcaaggagttcctggagcccccggaccacccggagaagccggttggttagttttctttccagtcctgttttccgatggagtgggttgatggtttctagagctaacgaagcttctccaagactaaggaaaatatagaaacttgcttctaacgaatagaatatgtcaactcacagataccaggaaagaatatgtagggtatgttagagaaaactcattttttctccattactgggcaattcaactgaaatttcctagaatattctatatctattacatacatacatatatatatatgaaatgaatagatcctaagcgttattgcaaatttgttttttgtggttttctagagacagggtctcactgtgttgcccaggctggagtgcagtggcataattatagtttactgcatcctcaaacttctgggcttaatagatcctcctgcctggtctcctgagtagctggggctacaggcacgtgtcaccacgaccagctaatatatattttatttttattttttgtagagacaggatgttgctgtgttgtccaggctggtctcctactcccaaccccaaacaatccttgcttcagcctcccaaagtgctaggattacaggcgtgagccactgtgcgcagccacaaatttgttgattttgatccataactccataggcaggttacaaataaaactttaaaatatctaagacaaatgaaggaaaatggtctgataatagtttaaaagtccaggtaacttttgggatatacatatactggccgtagttctggattcaggagtgtggctgaaggtcagaatagcatgctactgatagttttgagcaaataatgccaacatggtcatgttttacttctaaaatcaccttaggctgggcacagtgactcacacctgtaatctcagcactttgggaggccaaggtgggcagatcacttgaggtcaggagttcaagaccagccgggtcaacatagcgaacccccatctctactaaaaatacaaaaattagctgagcatggtggcacatacccacagtcccagctacttggaaggctgaggtaggagaatcgcttgaacctggaaggtggaggttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15137 - DNA, 6388 bp, Human
gctggtctcaaactcctgacctcaagtgatctgcctgcctcggcctcccaaagtgctgggattacaggcatgagccactgcgcccagactttttttttttcttgagatggagtctccctctcttgcccagattagagtgcaatggcgcaatctcagctcactgcaagctctgcctcccaggttttaagagattctcctacttcagcctcccgagtagctgagattacaggcacgcgccaccaagcccggctaatttttgtatttttagtagagacagggtttcaccatgttggtcaggctggtcttgaacccctgacctcatgatgcacctgcctccacctcccaaagtgctgggattacaggtgtgagccaccgcgcctggccacttttttttttttttttggaggtggagttttgcttttttttgcccaggctggagtgcaatggcacgatgttgactcactgcaacctccgcctcccgggttcaagtgattatcctgcctcagcctcccgagtagctgggattacaggtgtgtgccaccatgcctggctaattttgcatttttagtagagaaggggtttcaccctgttgaccaggctggtctcgaactcctgacctcaggtggtctgcccgcctcggcctcccaaagtgctgagattataggcgtgagccactgtgcagggcccgtctctatttttggtggtctcctgtctggtacctcttctgtggtttgtgaataaatttactaggctattaacttcatcacaacattttatgttataataccttggtcacagagattcctagccccgaattttctgtgggcttaaattcctccttcacagattccagtaataggatgcttataaagaacctatattcccctgtaatttgggatttgacagctgtttcctcctgcatctacttcactctctagaactggacaggaccttgggaatgattcagctccagtttatatattaaaatacaaatatgggtcaggcacggtggctcacacctataaatctcagtgctgtgggaggtggaaggaggagaatcacttgaggccaggagtttgagaccagcctgagtaacatagtaagcccctgtctccacaaaatttttaaaaattggggccaggcttggtggctcacgcctgtagtcccaggactttgggaggccgaggcgggtggatcacgaggtcaggagatcgagaccatcccggctaacatgttgaaacccggtctctactaaaagtacaaacaattagccgggcatggtggcaggcgcctgtagtctcagctacttgggaggctgaggcaggagaatggcgtgaacccggtaggcggagcttgcagtgagctgagatcgcgccactgcactccagcctgggtgacagtgcgagactccatttcaaaaaaaaaaaaaaatttggcgtggtagcacatgcttctagtcccagctacttggaaggctgaggcaggaggatccctttagcccagaaactggaggctacagtgagctatgactgtgccactgcactctagcccaggcaacagagcaagactctatctctaaaaattaaataaataaaatataaatctggaaaaagaacataaatattggataacagcaattgacatgcgtgttttaatggaagattgttttaatggaagatttaagtggttatcatttataagtttccagaatggaatagattgttgcatcctagctcctgtcaggagtagagcttcactggtttcacaggtagggtatgaggtgctgtgtaaagctagaagcttcttttggaagtaattttcagacagagaatactaatggagaaatttcagactgagggaaagggcctgtgagagaggcctcagaattagagctccaaaggcagattcgaggatttcagaactcagtgctgaaaacaccaaactgctgaaagaggtggccacagtacaaccattttgatgagaagttgaacagggtgaccatgcctctttggagaaataatcccctaggtctggaggcggcccaggatcctgaaggtgagtaccagtgctggtggaaaataaggagcattcaaagtgcattaagacccactccggggtctttaacttgttaacatggaaaacaatagcaaagtactgctggggccccctgctgtgtgtatagaatataccggaagactaagacatggagatagcagctgggagctaccgcagagattcagacttgaggtgaagggctggccttaggggggcacgtgggtgtgtaggaagaactgctcagcaggccttagggatacatttgttgtgcaggtgcagagaggacacaggcatggctggggcgggagttcaggatgagaaccctgggacaggctgtaagatgatcgagccaggtgtgtgtgtgtgtgtgtgtgtgtgtgtgtgtgtgtgtgtgtgtgtgtgtagaggtataatgacatactgtaaaatgcaagatatgaagtgtagaatgagttttgatacatttctacatctgtgtaaccaccccccacaacctcagtttttttaatacatatgtttctttttaagtttgagtttcccgtgcctgcagagtctaagtttaaacagcctcacagacaagaagctatatgcacctgaagtgaacaggaacacgggctgcaacagtagatcgtaaagttatttggagcgaaggaggtagaagtgttgtgagcaaatgaagacaggtgcaggaagggataaacggagaacagaaagttccaacctttgagatttttgaagtgcttgtgccccacacactgaggatcttctttgccgtatatagggcaaatctgatttaccctataaatttctcaggccttccacctcatatttaattctcttaagcgagaaaaaaaatttttttctgacttggctgctgccaaggtcggctctatcaaatctggtgcgtctctctgggggaaagggagctagaagaccccatagggtggtttgcacctcctctaagcatgcaagcacggctctggtcttgacctggggagcccagcttcctcggtgcaccgtgctttggcaaccgggtcttggcgcctccgagagcggggggaggggtgccacgcgattcccaggccgctctgtatctctcggtgcgcttgcagggaccctgcagcaaagccctggatgcttgcagccggtgcaagtttgcaagcagctggagagcggtggctggagtcggggggcggtgggcgtggccacgctccctcccaggcagtcccgggaatgttctgaaaagtatccgaaagttctgagtcgcgcgcgcgccaaaagaaaaggcacaaccccccaccactccgggcgtggcgtgcccagacctcgccactccagctgcgcctccggctgcagcgcacacgtctcctgcgcctcctcctccggagcgtcgctgtccgtcgggttcatccctcgcagcagtctccaggcgagagagggggccagagtgctcgcacttctcctaggggcaccatgcccaacgacgaggcattcagcaagccctctacaccgtcggaagcccctcacgcccccggggtaccgccgcagggcagagccgggggctttggcaaagcgtctggggcgctagtgggggcggccagcggctcgagcgccgggggcagcagcagaggaggcggctccggctccggggcgtcggacctgggtgccgggagcaagaagtccccgcggctgcccaagtgcgcacgctgcaggaaccacggctacgcctcgccgctcaagggccacaagcgcttctgcatgtggcgcgactgccagtgcaagaagtgcaacctgatcgccgagaggcagcgcgtgatggccgcgcaggtgggtgcgggcgtgcgggagcccgggttcagccttagtttttttttttttttttttttttagatggagtctcgctcggttgcccaggctgcagtgtagtggcgcgatcttggctcactgcaacctccgcttcccgggttcaagcaattctcctgcctcagcctcccaagtagctgggactacaggcgcacaccaccatgcccggctaatttttgtatttttagtagagacgggggtttcaccatattggtcaggccggtctcgagctcctgacctcaggtgatccacccgcctcggcctcccaaagtgctgggattacaggcgtgggccaccgctcccggcggggcccgagtttcttgaatgaagtccccccagcatggccgttgccatgcgggtcctgggttgtggagagatgcggcggtacttgccgacagcggcggcgcttggggtcctgggctcccggccacgctacatcgccggtctgggagcgccggagacgcgtctgatcccgcccgccgggcagagttgcgggcttcgctcggctcggggttccccacgatctctcaccctgtgtttcggcggagttgcgggggttccctctgctcccgggtccctgagatccctgatcccgctctcagggcagggaattccggggttcgcccctctgggcttccccgcgatcccagagcccgcgttccaacagaattgggagggtttattgcgctagaggagtcttcaggatcttcgctcccgccctccgaggtgaggctagaggggagggttcgactccaagggaatcccagggatctctagccccgctcttctagcagagaattaaggaattctctccgctttggggtcccaaaaatctccgaccgcgccttgggagcagagggtttcggggttcgatttcctcgagcgtccccagaatctctgactctccctccttgctgagttgcacttaaattagaaaggatcttggagggcggcagcgctggctgctaggttagcgggaaagggaggctcggccggctgctgcttacgcgggtaacctgtcggaaagccttgtttgtttttctggaaaagtcgctgcaatggacacagcgttgcgcggtttccctgcgcgcctggggcgctttttgtcttcgccctccgtggatggaggctgagcgcctcagccattttgagaactctggaaattttattagcattttaaaatttgcattctcgaccgaagattaaagtgcaaattactttgaagctgttttaaagcacgcttaagaattttaaagaatatgcgcaggtggaaaaaagcgcgccagggtttgagatttggtccgtctgtggttttgtttttttgaaggttcgtaagtaggctggtaatttaacattttaacggaaagttaatgtctttagtattctaaaaggatttttggaaggcagtaatccacgttatttccagttaaaagttgtttcatctttttaagacaggttatttaaaatgaaaagataacgaagaaatgtttgctaacgatgtgctacttttgattaggaacgtgtaaatatcctccattgaaaacaaatgcccgaaggttatatgcttttatataatatatcagatttttacaaatgtgttttatactaaacgtattttggcttcacagatggcgagtgcagtcatgaaaatagatattgttttgcttaatttcttaatagatttttaaagcttaatctgtagtgggtgaaaagaatacactgggtgtggcagtaaaatgcatcacaatgagtttactgaaaaaaattaatggacttttaaattatactctgggcagaaaaattctctaaacatttagtcgttggcttatttagtgtggagaacatgcttgggggatttctcaaaatgtagtaaaaatattctagtagaggaattaattttgaataacctttattagtagaggaggctgcttacaccgttaaaaacaaaagcaactcaaggtcacttagaatgggaaacttcagtattttctacaccagaaggtgtgtactgtgccagatgaatccttaaaaatccataaaacaactacttctagtcatttttaaatagtttgaaattgatcttacgtatgattctaaaataattgtatagttgcatttttaatcaattgttatcccctttcctttttatataatattttctaagaaaccttgagagaaggtccttagcatatggagtagatacctgtgcattttggatgtgcttcagaggtttgcaggggtttaaaacttgtttctggtcagattcattgatgttctctttctaagcctcttggttagtaataggaaatccaagatttaagcttaattatttaattttaagtaattaattatttaagatgaatttttctaagtcgaagacttttttttggctatgaggaaaattacttcccaattaatcagcttcctgtgtttggactgtggttttcctaaaacaacatataaattgtag

SEQ ID NO: 15138 - DNA, 5705 bp, Human
cactgaattggaagctgtaactaccacttaggcatttttggcttctcataccactgcaccagcaggtaaagaaaagagtgccggctgggcgcggtggctcatgcctgtaatcccagcactttcggaggccaaggtgggcggatcacctgaggtcaggaattcgagaccaacctggccaacatggcaaaacccatctctactgaaaacacaaaaattagctgggcatggtggcacacgcctgtaatcccagctacttgggaggctgaggcaggagaattgcttgaacctgggaggcggaggttgcagtgagccgagattgtgccactacactccagcctggacaacagagcgaggctctgtctcaaaaataaataaataaagagtgacacatggtggggaaaatcagccctgattactttaagaagttgggggctgggcatggtggctcattcccataatcccagcattttgagagatcaaggaaggaggattgtttgaggtcaagagttcaagaccagcctgggcaacataaggagaagctataacagtcacaaaatttgccgggtttgggtggcactcctgtagtcctaactactctggctgaggtgagaggatggcttgagcccaggagtttgaggctgcagtgagctatgatcacaccactgccctccagcctggtgacagaggaaggaaaccccgtctcaattatttaaaaaaaaaaaggtcttgggtgtattttaaaacacttcccaactctgagctctatgattcttctttcagtttctccaatgagccatgctgtctctggcttctgggcctttggccatgtggttccttccaccaggacactatccccactttagccagctgactgcttgccgtctttctggtttcagcatagaaatcacttcctcagtgaagtcctcttgacttctctaaccagaattagcttccccttctccctgctctcgtagcccacgcacaccctccgcctctggacttcatttaggaaatggtagttttttgtttacttgtctattccccgcactagaccatgacttccttgagagaagagggtgttttatttgtcactctatgcccagtgctaaggggagttgcaggccccaggttttgttagaaatggtcccagttctgtctctgccctgggaggtttgagatccatatcccctggggagggctctgactacagaaatagtcaaccaccagctagaagccatgattgggggccgggtgcggtggctcgagcctgtaatcccagcacttttggaggccaaggcgggtgggtcatctgaggtcaggagttcaagaccagcctgaccaacacggtgaaaccctgtctctactaaaaatacaaaaattagccaggcgtggtggcaggcgcctgtaatcccagctactcaggaggttgaggcaggataactgcttgaacctgggaggcagaggttgcagtgagccaagatcgtgccactgcactccagcctgggcgacagagcgagactccatctccagcaacaacaacaaaaaaccatggatgtttgttgggaaaacaaagatctttgttgggaaaaacatctttcattagtaaaagaagagtttgtgtataaagaataactaatagccaaatctactgacttgtgagagagcatctaacaggttctctttaagtgtggtctttttaagtacttgttttttaaaaaattaatcagagggagaatttaagatgtggaatctaccaatccaagaatctctcaaaagctcaggcaaagaattggaaatgataatgattaaaacagacctttgtgcacctggttaggaattttctatctcatgacagaaaggcaaacatcttctgacctgactccttcccctgacccggggttggctgctcctaccctgcaccttcattcagctccgcccagtgttgcctggctgcagcctctctgcccatagaactcagagcttactctggctttgccgagatggggctgccccagccagggctgtggctgaagaggctctgggtgctcttggaggtggctgtgcatgtggtcgtgggtaaagtgcttctgatattgtttccagacagagtcaagcggaacatcctggccatgggcgagaagacgggtatgaccaggaacccccatttcagccacgacaactggataccaacctttttcagcacccagtatttctggttcgtcttgaaggtccgttggcagcgactagaggacacgactgagctagggggtctggccccaaactgcccggtggtccgcctctcaggacagaggtgcaacatttgggagtttatgcaaggtcaggaggctgccacacacttgaggggtgcttgaaatagcagtggtagagggggatgaagagatgggttggaaagtcctgaattctcctactacttttgctgctccttttggaccttcttgtcctcttcctgcttcctgaaactagaacttcttgtggattgtttctctaagtaacatcaccaccttcccaggcactcaaatcacaaaccatccagtctggcatttcagcccctggaacactgctcttactgtacaggctgatctgcctgggctgctctttgcccacctctctgcctggttaactcttgttcaatcttcagactgttgctcaatgacgcttctttcgagaagccaagcccaactctcccatactaggctaccctctctcatctgcctgcttaacatcctaaacttttctttattacacctgtcgcggtttgtaattatgtacggctggctaggattcatgtctgcttccctcactagtctgcaaactcaatgcaggtcgagaccattgctctcacccactattacacccatgcctgatggtggcacatggtagctgctcagtaaatacttgttaaagagctctcggctgggcgtgatggttcacgcctgtaatcccggcactttgggagattgaggctggcagatcacgaggtcaggagttcgagaccatcctggccaacatgatgaaaccccgtctctactaaaaatacaaaaattagccaggcgtggtggtgtgcacctgtaatcccagctactcgggaggctgaggcagaagaatctcttgaaccccggtggcggagattgcagtgagtcaagattgtgccactgcattccagcctgggcaacagagtgagacgctgtcacaaattaaaaaaagtctcagttttctctctctaactccatccactccccagtccaggaaaaccagtttcgtcgacttgagttcttgaccgttccagttttctcttttttgtcctcccagcttctcttcctgccagaacttccttctccccgacttgcccactcagccagcccagcttgtgaatggctgccagattgctcttctctgagtacataccagctcaaccactttcagcagctcccctctgcatttaggatgaagcccaggctcagccttggattccaggtcctccctggtcaggctccagcttttcttctcaattctacctctgagctccccgccacactcatttctttcggacaaactgttgggccttgtacatctcttgtactttcccttgtctttgcctttgctgacatcggctggtcaagaatgcccttcccctctccatcgtcgtctatatccccctcattcatgtgggtccagctctcctgacaccttgtcctccatgaagccacctcagcttcctacagctaggcatgtgctctctcccttcggctcatggctctctgtctgcacctctccttggacactgctgcttcctgctcagcacctggtacctaagcacaagtcttatttccctgcccagtggagagcctcaggagagggtgtgtgtctgatttatctctggattcctcagcatgctcggcccagggcctagatgcagcaggtagagaaggcacctgaggcagttggtttattccgtgtttttcttgtttttctttttctctttttttttttttttttttttttttgagacagagtctcactctactgcccacgctggagtgtaggggtatgatcacgactcactgcatcctcgatttaccaggctcaagccatcctcccaccttagcctccttagtacctgggacaacaagtgcacaccacaatgctcggctaatttttgcattttttgtagaggtggggtttcaccatgttgcccaggctggtctcgaactcctggactcaagtgatccacccacttcggccttccaaaatgctgggattacaggcatgagccactgtgcctggcctatcctgtgtttttgaaagaatgttctttagaacctaagttccacagatatgctttactatgtagtgttgcctggtcaaagtagttgggaaaccctgaatactatatccccctcctatgcaatttcatgtgcaatttcatgtgcacatgagtgtatgcacatgaggagtttacagttccatagaacagatggaggtaataaacaaatccttacagtcctatgaaatgggggaggctataaaaaaatagaacttttgcctggaggacttggaagttttcctggaggaggtggctctggaactaggtcttgaagaatgagtcagatttttgtagcctgacaaggaaaaagggaagagtgttttagaggggaaggcaggagcttcttttgttttgctgttcattcataattttaaaccacagtgcacaaatgacctcagtttattcaacaaatgttcactaattccattggtagtaagagcaatggtaataactaacttaccacatgcccatgtgccaagcactgtaacagaaccaggccaatttgctgaatgccagtcatctgcagttcagttccctgaaagccagcttgcctcatggccaattcatggaatgtacttgcatcatgtaactgtccactttcagtgaggcagtttacattttaaagactgttgaatttggtctgagccccgtggctcacgcctttaattccagcactttgggaggctgaggcgggcagatcacttgaggtcagaagttcgagaccagcctggccaacatgatgaaacctcgtctctactaaaaatacaaaaatcagccaggcatggtggcatgcacctataatcccagctactcagaaggctgaggcatgagaatcacttgaacccaggaggcagaggttgcagtgagccgagatcgcaccactgcactccagcctgggtgacacagcgagactctgtcttaaaataaaataaaataaaatataaaataaaataaaaactgttcagtttgtctctgctccctgctgctgcagctgagactgaaaattggtaggagtgaccagttgcagtggcccatgcctgtaatcccagcactgtgagcggctgagtgggaggattgcttgaacccaggagttcaagaacagcctgtgcaacagagtggaaccctgtctctacaaaatatttaaaaattagtgggatgaggtggtgtgagcctgtagtcccagctactcaggaggctgagttgggggggtcacttaagcccaggaggtcgaggcttcagtgagccatgttcatgctagtgcactccagcctaggtaacagagttaagaccttgtctcaaaaataaataagtaaataaaattaaaaatttttaatggtaagaggaggggactgaagcaaaa

SEQ ID NO: 15139 - DNA, 7026 bp, Human
gagacaggccgaagccatgggcttcgacgtggggggcctgagacagacacacgccacgcccgggactccctccattgagtcctgaggccacccaggaccatccccacggagggacgctctgcagagtgaccaccagctctcctcaatggtcccaagggctgagggagggcagagggactgcgcccgctggaggagaccctgacatctgaagatgggtggcttgtgtacccaggacccagcaaagggtggctggtgatactcagggggctggggcagagggggccatttggaatcaactttcgcgccctggcttcgatcacagcctggagggttgagcaagaggacagaatttagggaagctgggggagggaggccgggggagggagtttggggagcggggagggagtttggaccctttggacttctgtaagcgtgaaatcctttccaaatgaaacgttaaaaagctttttttctttttggcctccaagttcattcagtgcttctctccatttcactgtaggtttaaaccgttcagttataaataaataattttatcctctgtcctcggctttcccccgtttccggcactgcagacatgggggctggatttgtctctgcggcggggccatcctgggcactgcagggccctgccaggagctccctccaagtcgtgacaaccacggatgtctccaggcctcacacagggacccctgggggcagaatcaccccagggttagaggattccacagaccccaagagactctgagtcccatgatcctctgccctgctgaggtcccaggaggctgcacacattgaaatccacaccctgagtgggagggagagaggaggcgagtcccgggagctggggtcccccgggtttatgccgtacgccccatcgggagtttattctggtgtccggtgtgagcagggggcagactggattttttattttttatttttatttatttatgttttgagatggagtcttgctctgttgcccaggctggagtgcagtggcacgatcttggctccctgcaaccttcgcctcccaggctcaagtgattctcctgcctcagcctcccgagtagctgggactacaggcgcccgccaacacgcgcggctaatttttgtatttttagtagagatggggtttcactatgttggccaggctggtcttgaactcctgacctcaggcgatccacccgcctcggcctcccaaagtgctgggattacaggtgtgaggcaccgcacctggccatttttttccccaaataatgaacactggtctctcccctgggccctgtggacatcggggctggatccttctctggggcaggcccgtcctgggcactgcagggtgctaggcatcatccttggcctccacccactccatgccaggagctcccctttcgtgacagccacaggtgtcctcagacctcgcccagggtcccctgggggcagaatcacctcttgattgagaatcctggccttaaagggggaagaaaacccccagacaaaactggcaggaggatgttcgctggggcctcaggtgaggcactgagggcactcgtggtggggccctgccttcccgagctctgcatcctgtcccctgctacgtcctgctgtctgtccgtttccagctcacccacccacgggacacacctgccacggccggctttgctggggccacagggacctcgtcagggaggcgtctccttgtgggtggcacgtgggcatgtgttgctctgagggctgtggccatgttgcccacctggccagggacccccgacttgggtgggtgacagccagcctccccgcccccacaaaggttgggaccttgagcccaaagcccccacctcctccccggagtccgttctgactcccaggctcccaaggcaaaaggaggaagtggggacccagcctgggcattgggcaactcaacggcctctggcattgggctataagaggagcttgaccgtgggtgcaccctggaccccaccatggctcaccggccccccagccctgccctggcgtccgtgctgctggccttgctgctgagcggtgagtgagccacgtgcccatccatccagcctccaggccccggtggattgtggggaaatatccaccacgaggtccatccaaagcccttctggcacagctggggaaactgaggcagggtcaggggagactccactcactgctcgggaccaacgcttgcaggggtggggaggacaagggcaagggggagccctggccatttgactcagttgcctatctgtaaaacgggcaaaacccagcccttccctcctgaggagctgttttgggaattagctagtaacaggcgaattcctggacagcacccagccttcagcaaatgctcagtgaatatgcatgaatgaatgaatgagtgaatgaatgagtgagtgagtgaatgagtgaacaaatgaatgagtgaatgaatcaatgagtgagtgaatgaatgagtgaatgagtgaatgagtgaacgaatgaatgagtgaatgaatcaatgagtgagtgaatgaatgagtgaatgagtgaatgaatgagtgaatgagtgaatgagtgaacgaatgaatgagtgaatgaatgaatgagtgagtgagtgaaagggtcgaggagttagtgatgctggaatcaggggaagaagagagcatgggccccctcaggtccctatcctgagggtgattttctttttctttttcttttttttttttttgagacggagtctcgccctgtcgcccaggctggagtgcagtggcgcgatctcggctcactgcaagctcagcctcccgggttcacgcctttctcctgcctcagcctcccgagtagctgggactacaggcgcccaccaccatgcctggataattttttgtaatttttgtagagacggggtttcaaggtgttagccaggatggtctcgatctcctgacttcgtgatccgcctgcctcagcctcccaaagtgctgggattacaggcgtgagccaccgcgcctggccctttttttttcttttttgaaacggaatcttgctctgtcgcccaggctggagtgcagtggtgcaatctcagtttactgcagcctcagcctcctggggtcaaatgattctcctgcctccgcctcttgagtagctgggattacaagcacacaccaccacacctggctagtttttgtatttttagtagagatggggtttcaccacgttggtcaggctggtctcgaactcctgacctgagggggattttcaatgcctcagtttgttcatctgcaaaatgggtctctttgttggctgatttttttttttttttttgcttctttttttttattttgttttgttttgtttttttgagatggggtctcactcaggcatgagccactgcgcccaggattttttttttttttttttttttttgagacagaatctcactctgttgcccaggctggagtgcagtggtgtgatctcggctcactgcaacctgtgcctcctgggttcaagcgattctcctgcctcagcctcccaggcagctgagattacaggtgcgaaccaccacacctggctaattttttttttttttttttttgagacggagtgtcattctgttgccaggctggagtgcagtggggcgatcttggctcaccacaacctccgcttcctgggttcaagcgattctcctgcgtcaacctccggagtagctgggactacaggcacgtgccaccacgcccagctaatgtttgtatttttagtagagacagggtttcaccatgttggccaggatggtctccatctcttgacctcaggtgatccacccacctcggcctcccaaagtattgggattacaggcgtgggccaaccgcacccgaccaatttttctgcttctttaaaaacatttttttaaattttgttttagagacagggtcttgctctgttgcccaggctggagtgcagtggtgtgatctcagttcactgcagccttgacctcctgggctcaagcgatcctccctcctcagcctcccaagtagctgggacgacaggtgcacaccaccatgcctggctaattttaaaattttttgtagagatggggtcctcacaattttgcccaggctggtcttgaactcctgagctcaagggagcctcctgcctcggcctcccaaagtgttgggattacaggcgtgagccactgcacccagccacctggtctgcgtcttaaaagccttcctgactctcaggactgaaagctgccaccagggcgcctttggaaatcgtcgtaattataacccccccggcctgggcgctgagtccttcccaccagccagcaggcactgaccgggttgcagatcgggagacggaggctcggagaggcccaggggctgctctgccatcccccctttccctgcagcctgggggctccctgacgcctggactccccccctgcaggtgctgcccgagctgcggagatcgtgggcgggcacgaggcgcagccacactcccggccctacatggcctccctgcagatgcgggggaacccgggcagccacttctgcggaggcaccttgatccaccccagcttcgtgctgacggccgcgcactgcctgcgggacatgtgagcggccgcctccacacccctgtccgcccgccccgccctcttcctccagccctggcccggccactgtccctctgcccggggaggacccagctaagccccgtctgcagaccccaggccccgcgcgcgtgggcagttctggggggaggcccggggcagggtcgccgagggaggggtctggggctgcaccgcggcctcgggaagggccggctgtgggcggcggcgagtgtccagggcgccgaggagtgaccaccccacccccgcagaccccagcgcctggtgaacgtggtgctcggagcccacaacgtgcggacgcaggagcccacccagcagcacttctcggtggctcaggtgtttctgaacaactacgacgcggagaacaaactgaacgacattctcctcatccaggtgggcgggcagggccgcgagggctcggaggggcacggccagcgggctccgggacccccattcctgcagccagcattcattgagcacccactgtataccgggccacgaccgaggccgctgcagcctgggtccagtggcactggccgggggagaccgctccttggacaccaggccactcctcctccccgcctctcccccgcccgcgcctctcccccgcccgcgcctctcccctgcgcgcctctcccccgcccgcgcctctcccccgcccgcgcctctcccccgcccgcgcctctcccttgcccgcccctctcccctgcccgcgcctctcccctgcatgcctctcccttgcccgcccctctcccctgcccgcgcctctcccctgcgcgcctctcccctgcccgcgcctctcccccggccgctcctctcccccgcccgcgcctctcccccgcccgcgcctctcccctgcgcgcctctcccctgcctgcccctctcccctgcctgcgcctccgcccggtgtgctgttcccccagaaagccaggtgccctcgcctcctccggcgcctcccctgacctcactggaagtggcgaggacagccacagccctccccgattcactgttctccactgaaccgcgtgctcctctcattcatggggccctcctagcctcctcccacccagaaagatcagctccccagggcagaggatttttgtctgtgttgttcgttattggactcatgtggcttagaacgggactgggcatacaggtggtgctcagtaagtgcttggggctgggcactgtggctcacgcctgtactcccagtactttgggaggctgggatgggaggatcacttgaggccaggagtttgggagcagcctgaccaacctagtgagaccccatctctataaaagacattttttttttttttttttttttagacagagtctcactcagtcatccaggctggagtgcagtggtgcaatctcggctcactgccacctctgccttccaggttcaagtaattctcctgcctcagcctcctgagtagctgggattacaggcatgcaccaacacgcttggctaatttttgtatttttagtagagacggtgttttgccacgttggccaggctggtctcgaactcctgacctcaagtgatctgctctcctcagcctcccaaagtgctgggattataggagagagccaccgcgtccagcctacaaaagaaaaatttaaaaatcaaccgggcatggtagcacacgccaagccactcatgagctgagatgggaggatcacttgagcccaggaggttgaggctgcagtgagctgtgatcatgccaccacactccagcctcggcgacagagcaagaccccatctcaaaaaaaaagtgctttgaagatgaatgaatgggccaggggcggtggctgtaatcccagcactttgggaggccgaggcgggcggatcgcctgaggtcaggagtttgagaccagcctgatcgatatgggaaaccccgtgtctactaaaaatacaaaaattagctgggcgtgacggcaggtgtctgtagtcccagctacttgggaggctgaggcagcagaattgcttgaacccaggaggcagaggttgcagtgagccgagattgtgccactgcactctagcctgggcaacaagagcgaaactccatctcaaaaaaaaaaaaaagaaaagaaagaaagaaagaaaacatgaatgaatggccgggcactatggctcacacttgtaatcccagcactttcggaggctgaggaaggcagatcacttgaggttgggagtttgagaccaggctggccacctcacccaatgggatggctccgggaggttccagtgagccgagatcacgccactgcattccagcctgggtggcagagcaagactccatctcaaaagaaagaaagaaggaaagaaaatgaatgaatacaatagtgacaaatgggacaaagggggtcgtggggcccaggcggaggga

SEQ ID NO: 15140 - DNA, 69737 bp, Human
  misc_feature (1)...(69737): n = A,T,C or G
attgtagcggtggtgggtggacaaggtgtttcaatctgtagtgttcccttatagttctagcacaccttgggctctcttctcacagtgactctccctccatgctccagagatcctgactcctcagttttcccattgctaccagagcccaggccggcctgaattccagatgatgaccaccactagatgagaaaaaccagatcagaagtcaccctcttcaccagcacccaaggcttcttcacctacactccccttaccacgcccctgtatcacactgcatcagaggcaggcaggcccgggcaggtttggcacagccagctcccaggccgatgtgggaaagttaatatcgccccggagtttactcaaagtgtatgtgccttagcagagcatgttttctggagcttccctgggagctcgccagcgccatcagaacatttctcagtctttgcaaacacaattgatttacaatcccaccactgaagtcacaaagacagaatgaaaatcagctccccacaaggatattatttccttgaagagacctagaatgatctcagtgacagagtttcttcataagtgggtaagaaaaagtccctgcctgcctccattttctattggaacatctcttttctctcataatgctgttaaatataccccagcaaagtggagctactaaattgaaatcattaagaaaggatcagttctctacccatctcagctctagagactagaggaaaggtgagatccattcacaataagatgctcttctttctggaaaaaggcagccacatcacagacctctctgagctgtgaaattgagcaggaccctttggtagaggcctagagagaggggcccatggcggtcaagaataatcatggccgctcacccagcactgccgaacacccagacatgggacctctgctcacagctctcaaaggaccgctctgatctcacccaggcaatatgtggccaactccatataaaacaacagaagaataaaaagagattttttttcctaataaatattcttctgccgctaatccaccctttataactgtcaggcttcatggggctggcagaaagcccatcagataacaaggcagctgtgacctgagaaacgtgagaagaggagcagattaataaagatgaaaaacatgtttggtaactgtgtctgaggggaggtctcaggggagtctttagagggatactctggcagctcggggaccccaaaaccaatgccacccagaagctgcagctaccccaaggggaggggtcagtcaaatgtggtccctgaaagcaagcagctgacttccctgactttctgcacaggcatttgctacctgagccttcctgggttgacttcatagaatatgacaatagagtgacagaggcgtcacatcacaaggcacaggcttttggttccccccaccccgaacattagactgaggacacatacagctctgtggggaggcagcccaaggcggtggcattctcccctcctgcttgccgacaagcccccggcaagcagctgtgacaaagcaaggatgaagttatagggaggaggatttgactaatggccgtattttcctcgccaagagctaggataaatggtccaaaaagtgcataggtaagtatggagacgtcaggacagaaaatttctgagttaggcctgtcctgaaatatctgggatttggtagagtatagaatggaaatactggtcttctagactgtgagatgacaaggattatcacaaagatggaaggggaagaggaagaagatgaaggaactgagttcccttttaagaccctacacccttctctatgatgacgtcacaaagaaaagtcccccaattcagtccctccagatttcttcaaaccccactgtattgtttctgctgcttttccttgcatctctgtcctgcaatcctcagcaagccctgctgacctacagagttgtgcagagcctccagtcagggacctcttccttttgccaatgcctggggactatggcattgggccacacagtcatctccccaggggagcagactgacagcggacctggggagaaaaacaatcaggtatcaacaggttcttcctgatccaaattaaattctagcccaggggacctgagccctaggacacaaagctcaatgttaggtcctatctctgaacttctctacgcagagttactcagcccctgactatctgctgtttggagccattcaggggaagtgggggtgcaggcattcattccactcccactcctggaacaggctaccagggtctaccagtgtgagaggcaggaatttctgcaaggctcttcagcttcatggctgcctcaggttcgtggtaaccaggaatacagtgtgagggtctcattagctccaggaaaaggaaggccagtgatagaccgctagctaaataattaagcgaatgtgcaatcacccgtaatatttacagaccactcactatgtatgttccaaacatcgttctgagctctccccattcacgaatttgtcccatcctcacaacttacttttcttaaattgaggtaaaaatctatatgacttaaaatttgccattttagccattttaaagtgtacaagtgagtgacttccaggatagttccaatgttgtgcaaccatcaccactatctaattccgggacatttcaaaatacccagtacccaagaaacagttactcacaaaaacctacttttgagggaggcgccccctactgacaaagcttaacatcacgctctctcggtagaaaggagacatcttgagagaccagtcagtattgcagggcaggtcccaaaagatgaactcggaactgagaggcaataaatgggtaactggcacgttactcaaattttacacatgaggaaatggaacaagggaggttaagcagcctgctcaaggtcacgtagcaactgatgaaatcaggctgattccaaaatgagacagacatttgtacctagaaggtaaaggtaaaagccaagaagaaagatgctttgtatcttctcaggcataaacaggggtttataattggtaaacagataaggtatccctggacttgttgagcagatctaaaactaataggaaaagggacatttctggagctttgaatcagatagttttaggaaattcagtgaagaatacaaaaaggtagtaaactcccaaaactcattagctataagagaaacggggccacacaattaggccaagaagttctgtagcaactgctaagcatttgttgagcaaagcacactcctagacaaaatggagaacgtaaaggggcaactcccccacttcaattcttctgctgctgatcccacctgctttctcatatcttccaaggttatacactttcttcaagtcctgctgtacatcccaccatccttaacactccagaggctttcctgagtctgtgttattgttgttggtgttttttgttttgtttttcccttgtcttagtgtacttaaatcctatctcttctgattagtacaggcctcagtgagctctttctgctgaacacagcaagcacatcataatagtaaacgcttatggtgcattgtcatgtgttgttaacccaaaatatcggagataggtcacagtcaattcagaaagtttattttgccaaggttaagaaacaaccatgatacagcctcaggaagtcctgacgacacgtgcccaaggttgccagggtacagcttgcttttatacattttagagagacatgagacatcaattgatatatgtaagctgtacattggtttggtccagtaaggtgggacaactcaaaagtggagcctaccaggttagaagtagataaaagacaaaaggttgcattcttttgaatccttgactagccttccactgaatacacaatttagtttggcttagtgaatctgcatttttatgtaaacactagggcagaggaagtaatcagatatgcatttgtctcaggcaagcctcagagggatgactgaattctgtctgtcctttgtccacaagcaatttccttgtaggcaaattgtaaggagggtaagtatcttcttaccttttagctaccttatttaggaataaaatgggaggtaggttagcctgaccacacggacaccattaccatcttgacttttcccttggcttagggatttggggggtcccaagatttattttcctgtgtcaaacaattgttagcatatgacttcattttgtcctcaccaaaagaacccagatgaggaaactgagacccagaaaggttgaataacttcctcaaagtcacacagccactaaatggcagaatcaacattagaatcttggttgttttgatgccaaaacctcttaaccccagattaaagtgcctctcaattgagttttcacatcacaatgcaacccttcacatacggagctaatattgcctctaattcatttatacataccagccttttctttttaccagattaaaagaaggcagtcaccacgtatacaaaagcagctcagcatggtctcacatacagtgactaattttgttctcttctatgcccccatagtgcctcagtcagtgacgaaagggtttgatattcaaaagcagaaattaaaggacttatctgaaggcagaacatatttgtgtaccttaacccaggcagtaaaggagggctatattgttcagtattgtattgagaggtgaattgaaggatgggggttcaggtcaacacattgctttgtggctggtctagaaccccaggctcagtattaatattagcctaataaacataatgataactcccttttttggagcccttgatgtgtcaggcactgttctaagcactgaatttacagtatctcatgaatcttcatagcaagcctatgatgtaggcactgccattattaccgcttcatagatcagggaattgagactcagagaagtaactttcctaaaggggcatagccagtaaatgatagaattggaatttgaacacagagcattttgattccaaccaagaggcccctccaaaacctacttagggaataatacctcccacctaagttcaatattcaagcttttcatattctcaaatattcactgtttaatcaacagaagttaactgattcacataatatacggcccatcctgtgcagaggcttagcatctagacaagaggagggatggaggacaacccccggggctggaccacagtgaaatgggctgtcctgtgtaggaaatgaccagagtggaggacaagcatgggaagtttagctaagggatctaattagatgacctctacgttttcttccagcacccaatcagagatgtaagaactgaactctagcaacttgcagagctggggacacatacttgacagcctccagaatgaaagtagtagatgctgtcacgatgcttggttgggattcccagtggaggatacagacatggaatcagggtagaagccagagaactaaatatcaggaaacaaagctagagccaaagagactgtcaggaaggtcagaattacaaaaaaatagttagagcacaccagcacatcagtgcaaatcagtaagcacttatgagtacctactattgattcctttgacatttgattcattcaacaaacatttactgagtcttaatgtgtgttcctggagctagagagaaaggagaaagcacagctagagccctgccctcaggtagctgacactctcagagaatgctgataggcagggtatttcgctgtggagccacgtgaaggagttggatcctggtccctgcctcccggatcacttaaacatgggctatgggtaccaaacaaacacacagcaagcagaattacaatccaacaattaagtaatatttaaagaaaataacaggccaagcacagtgtctcatgcctgtaatcccaacactttgggaagtcgaggtgggtagatcacctgaggtcaggagttcgagaccagcctggccagcatggtgaaaccccatctctactaaaaatacaaaagttagctgggcatggtggtgggtgcctgtaatcccagctacttgggaggctgaggcaggagaatctgtagaacccaggaggcagaggttgcagtgagctgagaccacgctgttgcactccagcctgggcaacagagcaaagctccatctcaaaaaaataaagaaagaaaataacagacatgagagaaactagcaggtcaaataaagttttgttctgccagatagaagggaaacaaatatgtttggtggcacagaacagagctaatgaaatattttgaattgctttacactgtgtgaaaaaattaaaccttcatcttcctcagaaaccagatcttactatttctacttcttaagtaatatatcttttttttttcttttttgtagagacaaggtctcagtatgttgcccaggctggtctcaaactcctgagctcaagcaatccttccacctccacctcccaaagtgctggtattacaggcataagccaccatgcctggcctcaagtaatatatctgtctcccctggaagtagttgtagaagcccttgtcatcttaactgggccaagccaggcagactctgacttggaggtaagacaagaaggagatagtggccagaattcattagtaaaccagcatctattgtttgcaatgggcgcaatataaaatacactaaacagtcataaaatgtacaacaaagatggaagagaccttaaagatcatccaatctgattttctgatcttacaaatgaagcaactgtggtgtgggggcatgaaatagtttgtccaaacctgacaaaaacaagcaacagggaaaggattccctatttaataaatggtgctgggaaaactggctagccatatgtagaaagctgaaactggatcccttccttacaccttacaaaaaaattaactcaagatggattaaagacttaaatgtaagacttaaaaccataaaaaccctagaagaaaacctaggcaacaccattcaggacataggcataggcaaagacttcatgactaaaacaccaaaagcaatgacaacaaaagccaaaatagacaaatgggatctaattaaactaaagagcttcttcacagcaaaagaaactatcattagagtgaacaggcaacctacagaatgggagaaaatttttgcaatctatccatctgacaaaaggactaatatccagaatttacaaagaacttaaacaaatttacaagaaaaaaacaaacaaccccatcaaaaagtgggcaaaggatatgaacagacatgtctcaaaagaagacatttatgtagccaacaggcatatgaaaaaaatgctcatcactggtcatcagagaaatgcaaatcaaaaccacagggagataccatcccatgccagttagaatggtgatcattaaaaagtcaggaaacaacagatgctggagaggatgtggaaaaataggaatgctttcacactgttggtgggagtgtaaattagttcaaccattgtggaagacaatgtagcgattcctcagggatctagaactagaaataccatttgacccagccatcccattactgggtatatacccaaaggattataaatcatgctactataaagacacatgcacacgtatgtttattgtgtcactattcacaatagcaaagacttggaaccaacccaaatgtccatcaatgatagactggataaagaaaatgtggcacatatacaccattgaatactatgcagccataaaaaaaggatgaactcatgccctttgcagggacatggatgaagctggaaatcatcattctcagcaaactgtcacaaggacagaaaaccaaacatcacatgttctcactcataagtgggagttgaacaataagaacacatggacacagggaggggaacatcccacactggggcctgttgtgggagggctcggggagggatagcgttgggagaaatacttaatgtaaatgatgagttgatgggtgcagcaaaccaacatggcacatgtatacctatgtaacaaacctgcacgttgtgcacatgtaccctagaacttaaagtataataataattttaaaaataataataaattttaaaaaaaataaaagccactatactttaaaaaaaaagagttggtgtgataaataagtgagataatacatatcaagtactccatgtaaatatacccatctatggtaaacaataaatagtataataattgtttaaaaaaaaaaaaaagtttgtccgtagtgaattagtagcattggcagactcaaatccaagtttcctggcaatccctcttcctatagatagaaagaggaccacccatccaggaagaaataaggagggcagggaatctcagaggtccttcccagcccaagccctgaacaatgccttcattgacacctctcacctttcactcatcctgcctgacccttattccatcagccatcccagcgctggctgcagaataagatctcacctgacaagcctctaaagttcagacctcacctggccctgggactctccagcaagacacaactcggaagggccggcccagcactggtgcaggcttccccagggctgcccggttctggccagaactctgaagtgtagcagtacgtgccctggaggatctaaaatccatctcaagttctcaaagcaaacagaagatgtgtttggtggttctgttggccagagtacactagcaccagctggaactgagacagacacccagcaaccctgtcccgttctccactgggccaagggaagccacaagccctgccccactctcaagggctcagacctggatatggaaagcactcgggggtagtgagagagaatccaaggtctcttgagggtaagtggggacaccaccgccaccaccgccacgggtgggaaggagaaagaagggctgctgtttccccaggaggctgcaccctgccctggggaggaggcagctccccagagatgacacttgaggacttggcttggcaccacgaaagcataccgctcagggttttgtttcccctttataaatggaggcaggcgaggaaaggaattctttggctgagtaacataatacttctgggtccagcccaccaggcttggccctgggaagagcaaacaagctgcctaccctgtcccaacaggtttgtggacactcgtgcccactgccactcactgtggattctggggaaagggggaaacgtagatccccaaggggagcagagatgttggggaagatctatagcccagccctcaaccccccagggtgaggccacagccagatatttagtgttaccatgcaatcaaacacaactccaccccacccgccctaagccatctcagctcccactttcctcactgacctgggcctcagagcccagctgtaagtccaaggtttatgctcacaagccccacaagctgcacgatttcccaaatgctcttcacccaggctgaggacctcccccgcagaagagttctgcatgtcacaaagccagaagcaaatacccagagccacaaagaaaatgttaataaccaccagatatatttttgcaaagtacttttgaaagatattatttccattctcataacaacttcccaggttagccattattatcaccccattttaaacataaggaagcaaggggctcacagaagtgtctacagaaatggctaagtcaggtcttgagcccaatccgtcttactcttcatttcaccctcgatcagtagctgcaaatccagcaccctgattatctgaatttggtgatcaatagaactggtgacgaccacctccagctttgtaactcctggctttttagacctggcaactggataaatgggggacttttggacaggcacagtggctcacgcctgtaatcccagcactcccagcactttgggaagctgagatgggtggatcacctgaggtcaggagttcaagactagcctggcaaacatggcaaaaccccatctctactaaaaatacaaaaattagctgggcgtggtagtgggcgcctgtaattccagctactcagggggctgaggcagagagaatcgcttgaatctgggagacggagatggcagtgagccgagatctcaccattgcactccagcctgggcaacgagagcaaaactccgtctcaaaaaaagaaaaaaaaaaaaacaaaagaagggctttcacctaacaggcctgaggggtccaggcagacatgggtgcagaccgtacctgaccttgctggcccaggggcaggcggctagcccagcccctcccccggcaggtgccccttcaccttcccgcgcctgcccctccagtccacacacccaggcaaggcgccctcgagcgagcgccgtttgttttgctgagagtttccgttggctcgcgtgtgggtgtttgttgtatttctccggcagatggcagacagcatgccctccccaccatcaccccgccccaccatcaccctgccctggggctgtgtggcaagcagacgctgcagggcagaacaaaagcctagcaggtgaacagccctgtctgcggagacttttatccaacccaagtcgcagacaatatctttataaaattcctttcaactccctcatcatctggaactcttcctgcctggctcccaacctgctgcagcccccagcagcccccaccctcagaagaacatctgctcctctgacagggcacaggacacggtgttccaaagagcaattttttctttggcttccatccactacaccccctcagagcccagagaccccctgctcccagaagcttcctgcaaaacgggaggagtgtattgatctgtggaatggaggagatcattctcctcctccagtgctcagaactcctcagcaaaaatgaccctcagtttttaccacccctgaaaaaccccagatgagtccagggactcctgccaggaactgggttgggggatgagggggatgctggaaagggatggagtttctcaatttctaaagctattgtttctcattcccaaatcaccatgctccaatctgggcccaagagctgtgctcaacttgaggactggtgtggctccctctgcaagaaggttaggccaatgccagtgaaccagccactgaaggctggaggggccggagagcctctgagcatcctcaccgccttgcctgaggctagagctacaacagcgagtgcctagacccccacctgtatccccattgcatccccaccactacccagcagctcaggagcaggctcttccctccactcctaggcgacactctgcagtttccatcctggggtctcttacttgcttctgctactctgcccagtttctcgtgttgatagcttagctactcagccttcctgggttttcttttcagccctggtcatatctttaatgatctctatcctcaacatgtctaatagcccaaggaccaagctcattccactctcatcctcaacccagatctgcaggaccccagccaggcccatagccccccaagcagaggggaactgacagctatgactctgactatactagacaacattctacacccaccaggaagtagagccttggagatgtccaagctgaccctgttattaagggctgagaagcagttgtagatgctgcttaaaggaagaggggaagggggctgccagggcagccacagaggcatcaacagacgggacacagaggtctctggtgtcaccctgatggcagttctgcaagtgctgacacggggtcccagagtccctagacctaactttgtgggttagacatctgactccaatttgtgtgggccaaattctagcctggaacttgggccccaatatgcacaatctgtcttccccacagcccctgagacaccatgtgagccagggcacacagccagcctgcaccctgcccttctcaacaggaattccttggctcatgcagcctccacctctggcctgactctgttctttctctgtgaaaccttcctcgaccccttcagttagcctctgtccaaagccaggcactctcatgggccatttcccccagcgcttaccaaatgttgccaggtattttagttatctgggtaaacatcttctctgtaaactcctcaacaacagagacattttattcatctccattctcacccaccaccgccagcacctagctctgcaccttgccaagagtaaacattaaacattttctggatcaataaactcaggataatcctcccaagtccttattctgaatggccacaggaaaaccaaaacatttcctcatctccttggtgaccccatacattaccctaagcttcaaaagagaggatgctaaagaaggcgtgatgtggtcagggggtccctggatatgtgaacctcccccgtcctaactggacactgtcttaggtttccatttataccttcccggtggcacctctgtccctgctgtcctatccatccaccagaaatctctggccaacacattaaacatattttcaaatccccaattccctgaacttaagggaaagcaggctgccccggcctgggtactgggtgttacctgactagcacgtgggctgccccctgtcccgcacacccacccgctgggcagctaagcctctgcggttgggaccccagggaggcttcctggtgatttgcatataatcacacaatgccaggcacaacaaagccactcaaacagcagagccttctcagctgagtttaaagtttaatctccttaatacaaaagtttctgctttgcttttgatgggttctggaactcttgctgatgatgctaaacaaatagtcaccctttctccccctctggaggctttgcccagcgcattgtggcagcacaggccccagttgttgtggtttacgggccagacctgcacctgcactgtttgtgtgagctcatctggatgcccagaagggctctttaaagagagcccagcacagccgcagatggagcaggagaagacaccagcccaaggactgctacaacccttggccagacaccagctcaaggctgcctgtactctcggtgccccccaccgccctctacttcccttacagaaacattcatccccaagtcctcctcccagaacccagctccctcctatgtgtctctcaggaccttcctcttccagatgccgtccagccccctcgtacttcccctcccagactcacaccccctctcagtttctgcacactttgcctcatcatctggaggccattcctaggtcagttttcctatttacttcagcacttcacctataggagtcatagagccatcccaagcaaagagcctctagaagaccctttcaaagacatgctcagcactttacgttttggctccagctcctccgcccggtcgttttgagaatgagccatgatcctccatctctcatattgatgcgggaattggaagttggtcattgaactggtggcctgaataggggtgccccggccatcttggttatctgtttttgtgtagcaaacaatctcaaaacttagcagcctaagacaacggttgttttattttatctcacagtgctgtagttcagaaacctgttcagggctcagctgggtaagtctgctctgttggcattggctggggttactctgtgatctgggatctaagatggtttcattttcatggctggtgacttagtgagtatggctaaaaggcttggctcagctgggactgttgagcaaagggcctgcacatggcctctccagcctagcagatcaaggctcccagagagagtgtcccaaaagaactctgcagaagcttcaagccttcacatgacctaggctctaaaatcccagaatctcacttctgctacattctattagtcaagcagattcaaaagaaaagaaattgcaacatctttaatctgtcacaccagctaaagaggtcttttcagaagccaccagcccctgtaactagttcagagacagagtttcctggtcccaatgtctaaataacctatccttgcaaatagaacatcacagttaccagcctgcatgtactaggagctgacatcctttccattctttccccagagactcaaaccaacatcctacccctgggcggtgtccccatttgaccccgtttggcctgcctcttacctaccttggctgttggcaggaactttggtttttctcagttgctgccagacctagatctgcccttttcagatttttgttcacagatagctttagatgggagataaggaagcttgagtcaggtcagtgctgaggcgaagatgctgccccaagacagggggaatgccccagacttgtcccatccagcccttgcagaatggcaccagcaacaagcacctgctgtagagaagggttgtcactatgttgcagctctgagactctacagaagtcagaggtgggtcatggagatgaggggacaaggagagtgaggaggggataggtgactatctgccacaccacttaggtactgagtcacatcaacatgtatgcaatacctggtcagacaggcacccgcagacccatctggcccagaccagctgcactttcccaggcttaggctgggagtggcagtcatctggcagagtcttggttcctggagtgagggcacaaggtcacacaggccagggccagagaccgctctcttttctttttttttttttcacaaatacatttcaaatgttattatgaaatatgcaagccatacaaaaaggaatgaagaatacaataataaacacccatgtacccacaacctaacttaagaaataaaatattagcaaagaaaatctcataatgtaatatctcagggctctggggagtaggggagagaacagggtctgctcatgttcccacaggaaggaaggagtattgagaaggaagagagaagcaaactagagcatcagcagcggctcctccgagagagagatggctccttgagcaccagagtcaagggagattttatgggcttgggaacagaccacagagaatacaccacccttcttctttcaactctcagctcagagacttcccagatcccacagtctgaattagtcatgagttccttagagatgccttacggattgacttctctgtccttgtctgctcttgggctgtttataatatatccatgcctctcccacgcctgactataaactccgtgactgtgcctcgcttttgatctcatgaagttcttgtacagggtaagaactccttgttattgacttgaatgtgtgactaatcctgggaaacccccatggttgacgggcaggggacagaagcattaacagaaagggaaaagcaaagcgagttgggccgggcatggtggctcacgcctgtaatcccagcaccttgagaggctgaggcaggcagatcacttgaggtaaggagttcaagactagtctggccaacatggtgaaaccccatctctactaaaaatacaaaaattagccaggcatggtggtgcatgcctataatcccagctactcaggaggctgaagcatgagaatcacttgaacccgggaggaggaggttgcagtgagccgatatcgcaccagtgtactccagcctgggtgacagagcaagactccatctcaaaaaacaaaaaaagaaagaaaagtgagttgaacataagagaccagagcatagctaacacccagactttggtttctaataacattctccaataaaaaggaaccagaactccttggggatatggccaattctaggacggggacaggaaatatacgagatgagatcaggtgcggtggctcacgtctgtaatcccagcaatttgggaggtcgaggcaggtggatcacttgaggtcaggagtttgagaccagcctggccaacatggtgaaaccccatttctataaaaatacaaaaaattagccaggcatggtggtgcacagctgtagtcccagctactcaggaggtcgaggcaagagaatcacttgagccagggaggtggaggttgcagtgagccaagatcgagtcactgcactccagcctgcatgacagagtaagattgtttcaaaaaaaatgtatacacacacacacacacacacacacacacacacacacacacaagatgagcctggggcatcttatagtgccaaaaatataaggaagtactcgaaaaacaacaacaacaacaacaacaacccacaatcatgaggtatgtcaaaaggacccagtagccaactggcagagctcacaacaaccagcactggatcattttgaaagacagggaaaaaaaaaactctctatctaaatctaaagtatgaaatgaatacctataagtccatattgatataaataaatgttcacgtgaataaataaaaatgaagaagcaacaaatctcacatgcagaagaatctcaaataacttgcattcgattaacttacgttaatttcaaataacttaattccaccctcggggagggataaggcaactgcccactccttaagtgtgggctgtacatagtgattttcttccaatgagcatagtgtggaaagggaaaaagagtaacctctacagtggaggaaacctggccaacgctacctcagccaggtgatcaaggtcaacaccaacagtgatacatcatgttgattgcatgtacccttcatacaacgtgatgaaaatggcaccttgcctctgtggtcttcctctcaaaaacccacacctccagtccaagcgttagaaaaacatcagataaatcctaactgaggaacattctacaaaatatctgaccaacattcctcaaaactgtcaaggtcatcaaaaacaaggaaaatttgagaaattctctcaactgagagtaggcaaagcagacatgatgactggatgtcatatgtggtcctggaacagaaaaagacaataggtaaaactaaggaaatcagaacaaagtatgggtttcagttaataataatgtattggttcattaattataacaaatgtaccatattaatgtaagcagttaataagagaagaagctgggtgtgaggtatatgagaacactgtactatcttttgaaatttttctgtaaatctaaaactgttcttaaaaaataaagtttttcaaaaaaatatcagcacattctaggaaaaacttacataacttaaaaacagagggaaaaaaaagagagacaaaagggactttgggatcatggaaattaagtcgtcccccacctgtcagaccagtggaaagtcaggtaaaatcagaactgaaagtgacatcccgggggcactgccagggtcctgagagaaggcagtttggggatacagtgaaagtcagacagctgggggcaacaggacgaggacctgggtgcaacaagtgtagggcagcaatcagaaagcgtggtctttaggtatgggcatagatgaagcaggaagcctcacttagaagcctccagctcgaggacgcttagcaacacaggtgagtatttaaaacagtgcagagtggggagtaagaaaccagggtgagacagcacaaccacctctgcaagcatttaaaacggacatgtgcctaaacgatgcctgctttgcaggaactcacagacacacatttggtttaacagaattattttttatggggagatggaaataagaataaatggagaaaaataaatgaacaaaataggagaagtttcctgcccaaaccacaccagcaatgacaatgttccatgaactgagtgtaattaattcaaaccactaccctgaggggtgtgtgtgtgtgtgtgtgtgtgtgtgtagagacagtgtgtgtatgtatgtgtgactgagagacagagagagaggagaggagagggagggaagaggagagaaggggaggggaaggcaggggaggggaggggagagaagacataggagagaaaggaaaagaaacaggagagtcctaagaggcaatgtctcacttatttgtggaatctaaagatcaaaacaattgaattcatggacatagagagtagaaggatggttacccgatgctgggaagagtagtggggggctgggagggaaggtggggatggttaatgggtaccaaaacaaatagaaagaatgaataagacctactatttgatagcacaacagggtgactatagtcgataataacttcattgcacattttaaactgacttaaagattgttattgaattgttggtaactcaaaggatatgttttttgacacatgagatgttttaatacataataccccataaatatatacacctactatgtacctacaaaaatttaaaaaataaaaattaaaaagtagaagaagaggtaagggaatcaaatgagatttttttcagaactggatgaaaggcaacagaaaaaggaatggtggaaagagggtggctgaagacgttaggaaagaaaggcaggagagcgcagcagtaaaagctggcgtgggggattcctctgtgagaggcaggggagtggtcaggctctctccaaggcaacggtcaaccaagaaagtttgtttttgaaaaccataaccttctctgtcaaacgggacaaataggacataagccttagaggacaaagacaatagatattggtgaggggatagaagaagcagtggcgaagaagagagatggggagcccaacggctaccctcatggtaccgtgctaaggttaaggttgccctcgtggtacagtactgtgaggaaattactgatgggtattggggacttgccctcattctgccatcaaccagttatgtgaccttgtgaaaatcccaaacctctctgagcctcagtttcctcatctttaaaatgagatgttggaatgaacacgctcccttccctaatccagcagttaatgcagtctgggagttcatgcaggaaggaagactagtggcattacctccttgaggctggattcacagcaaagcctccagcatctatacctccactcctattgtgtatcgtgccaacagggtccggggatcctctgagccttttcagcctgtgtgggctgtcacacagctcagttccacatctttcatcgtgccctcctttgttatatacgtggccctataagggcagtcctctgtattcccacaggactgagcctaggaaagaggttcattaagtattttgccacattctaggcccaacatatccccaattgctaaaggctctgaggcaagacatttcaaagcagagaacaattgttctctaattaggatctgatttttaatttaaacttcaacctgaaaagcaacctgaactctattttagtcttttccggtttgccattcctagaaatcctgtccagtgacctgaccttgtgggaattttccatcttgtcttgtgttgactcaggacaagacacttcctccctctgggtctgagtttcttcatccacaaaataaaagagctgaaggacacagcccctaggatcccttccagctctactactctcgccagttggagtaatctgaacctacttaggcccccaggacctttcaccagccaagtacaacctccttgtcccactcaccaggtaagaagttacctttgagatggatttcacagaagggaggagaagtgcagagagctaatggccatgattataatagaaacaggatagagagaccacaaggttacagaacatcccttaagacctcagagcagtaggaagctttcccacctacctacccagagcagaaggaaggttgacaacgtgaacctactttctactacctgggaaatgtatgtgattgatatggagcgaacagccttcagagcaagaatacctgggctctaccctggcctcacctcctattactggtatgatcttaggcaagtgatttcatctttttgtttctccatttcttaacacaataagtggggttcattacaatgtcaatctcacaaggtagttgtgagtaccaaaaagcgtggtgcatatcaaagttcctcgcaaaactttgatactgaaagcatggtccaatgaggtcagccttcactgagagcttcttagaaaggcagaatcttgggccccaccccagatcacccatactgttgaatcagaatctctgtctttaaaagatcctcaggtgattggcagggacaggaacgttttggaattgttgcaaaacattacacagatgctaatcttacttcctataaaaaataattaagatcatgacaccaataaacacacacacacacacacacacacacacacatcctcccctgcaacagcatttcctcttctccttccactggactcctccacgccctgctcaccacttcctgcaagctcacagtgccaccatctggacaaacaaaggcaaagcagatgactgagatgtgcagggaaggacactcaagggcctggaacacccagaagagaagtggctttgtgggaggaagtcagcctgtgctgaacattatggtaaccaccagccacctatggctactgagcacttgaaatggggctactacaagctgagatatgctgcatatccaaatgcactctggatttgaaagacttactacaaaaaaagaatgtagctcctggaagctaagtcttagtcctaattactgcgtggctgtccccccacaggtagtctctgtcacaactcaccacctgctccctgtgccccgggaactttcctctctggagcaggaccctacaacgcctccttctgccacctctgcccttttgaaaagtaattaatgacaaggccaggacctgagcctttctctccaccacctgctgaatgctttatccgatacatcatgtggttatccaaggattcactggcagttttacagtttccagtttttctgggtatgcatattctttaagagcacttgactggttgcctgaattttcagtctttctggaccgcagtcttctttataaactgggagaagagaactaaataatctccaacatcctttctaaagctaaaaccatatgggtctctgaaacctggctgtacacgcaccaaaggcagaagcctcgggttttatttcctttgcatctctcctgcagcatttcacacacggagagtacttaaaggaatctggctggctttgccttgcagaagaagggaactgagatgtcccttgccctcactaagcccagttatgcacacgcatgcacacacaccccaccagcttctctaggaaggaaaaggagataggagatagagaagaaccgtggagagcagaggcggcagatggaggcattcctccggagaggaaggttcccggaagacagggaggtaggaaaaagagagtggagacacttaagttgtctgggccaaagctgctcagaggatccatatcttagatttcatcctcatgaaatattcagtgagtgcatcccggagctcccatgggtggcagaggctgcccttcctgggcatttctctctgagttgggatcctgggtccacttgtccctgtgcctctcctgtaccgccaccctcatcttgttttctcatagtgttgctggcactgggcctctgtgctttgctgccttctaactctccatctgcctccccagcggtctttctcagcatctgtccaccctcttacttctatgcctacctctctctctgccactgtcaccccacccaagggtgaggatgctcccctttgagggcaccccagtgacatgggcttccatagctgtcttctgccatgccctccagagtgccacatgcctgagcacagagaaccctcaggactgcgggaatgagacgcctcgtgcaaaagaagagcgagacccaccaggatgcagagagggtaggagctgggggtatagttgaggagtggggaacagaaaaacagctctgggggaagatgctggctttatgagacacctgggctgggctagggctcagaagccccctaatgggagaagagcactgtcaggggtccacttgtgcccctgtgggatcgtgggtgacccaccgctcctggaagctaagtcttagtcctaattactgcatggctgtccccctacaggtagtctctgtcctaactcaccacctgctccctgtcccccgggaactttcctgtccggagcaggaccccacaatgcctccttctgccacctctgccctcccaggttcttcaacccctggcccggccaggatgcctgtttcccctgtggctcagaggccacccagccagagaagggcaaggacacgtgtgtctgccgggggcctgggcgagtgttccaagtatgtcctctggcaggggggcccaaggacaggctgcgtttccaggactgttttggtctcaagtcaaactcggctcaggtgtaacttgaccagggttggctcaggtttccaagtgacttggggatagggttgccagataaaatacagggtacccagttaaacttgaatttcagataaataacaaacttttttttagtcttgcatgggacatagttataccaaaaaaaaaattgtctaaaattcaaatttaactgggtgacctgtgttttcatttgctaaatctggctcgccttctccaagaaaatgacagactttatgttgctttttgccacgatcacttccaaaacacatcctagcccaagcccttccaacttgaacgttctctgcaagccaacaaatgtgcatgtgaattcttcctttgctgaatgtctcaagtctctttttttattgaaatgatagcaccagccagacccttaccagaacaggctggtctccccctgactcctcccctgccctgtttattgctcatttccccgcccctgcccttgtcttctggcccatttccaaaagggtcacagccaaaaacctgggcatggttcaccacaacgaagtattaaccaaccaacatgaaccagcactcctccctccccctccccgcccccagcccagtgacagtcggtacccctgcctcccgggccaccgagactttggagagccaatgggctgtgtccagtgggaacacaggagctgcaaggacggagccactggaatcaggaggggctatgtttgaccaaggctcagtggaatgaccactgtgcccacgaggtaggagaatgcccatctattatgtccttggccttcctgcccctccaccctcccattcaaatgtccaccattccagccactgggctcattccattgcccctctctggaaatatagaggtcagtactttgcactctcaggcagttcctagaagcagctggagagaatgaggaagagcttccccagggaggtgtccccaagaagtttgagtctttgtgcaggtgtgtgccacaccaggagatgcccatggacatgacccaagccctggggctctgcctgtgctggggacaacagtcaagcagaatgtgcagccctctgtgcccagagagacagagacacatcttgcagctcagctgccctgatggcatcccacagatttctgtcactgaaggcatggggagtcaggtacagtactctgaggtcctacctcatgcagagccagggcctgtgacttctgcctccaaagagggagcatgcaggacatgcctatgtgcagggtccagaggctgctgctgcctggcccacatcactggcacctcaccaacatcagaggctcagaaccagagcaaggcccctttgttgattttatttcatcctacaaaactccttgaataagaggtcattgtgttcatgaaagaagagggacactgtccaagaggtcatgactccaggctgcccctgccccatggagttcttggaactattcccacccccacctcccttgtgtcctttcaggacactcagacacagctcagggaaggggctgtgttcgccctcccttcctactgggcaagtgtgtgactccgtgtcttgagggaagatctgacactgcctcttttcgtttccaggatttttaccttctggaccagccttccccaccacgtgctgtgggccatccctgcaacttggacttagggcagaagtctgtccccctctatgtggtcaagatggatggtaagagagctggacagatggaggccacagggaggcctgtggctcgggaccacacacatgcaagccttgtccttaccagggcgtgtgctctgtcccatgaccagaagctgaggtttgacagggcaaccactcccctagggagggctccctgagaactgcatgcaaattctgacccccctcaatgtttcagaaagttgaagctaccacgtgcaaaccaggctgaacagctgctgattatatacatgctcttgggaaaactcttaccccggtccctgcagggtcagagggaatccctgcttgttctagcgcttggcttcctgggcctgaccagaccagatggtgagctactacactccctaggccttcccctcggggatcccaggtgtccagaccaggatccaggtgggcatcgcagctcacctgttgcccctcctatccctcccctacccttcccaggtcccagcacaaacccatctgaagagtggcagctctccctcattctctgaatcttacctaggaaagtctagggaaggacatctggactcttcttggtcactgagcctcaactccacacatcttggggatctgctgcccccagagccaggcatccgaaaccccacagtctgcctccaagtcaatgataccctggccttcctggtgactcatgagcattacccagagtatgacctgtgagtgtccagagaccacagccccatcatcatggaggccctagagaggaaatgcccctgcatcagccaccactcccaaaggcaacgtattccctcctttctctctcctcaggggccacttctataacacactggagcaatatgactggcggcgcttccgggccctggctgaggagtcccagctctatgagcaaagcctcagcctctttctgcagcagttccaaaagccgggcatttatgtctttcgtctgagcagcaaccgacatcggaagatggtttgtctacgataatttgcctcatttaagacattatcccattatttcccctctctttaaaaaatactgctgcaggccaggtgtggtggctcacacctgtaatcccagcactttgggaggccaaggagggcagatcacctgggtcggaagttcgagaccagcctgaccaacatggagaaaccctgtctctactaaaaatacaaaattagctgggcatggtggtgcatgcctgtaattccagctacttgggaggctgaggcaggagaatcgcttgaacccgggaggtggagattgcagtgagccgagatcgtgccactgcactccagcctgggcaacaagagtgaaactctgtctcaaaaaaaaaataaatactgcctcataaccagctcagacagatctgcagggaaggagatgccctgatgtccctatcagtttcagggtcccacaatgctaacagatggtcctgggatgccaaagttcatttcacagcaacccagcatgtgctgtgcaaggaggggaaggttgagaggatgggaacacaagtatgtattcagggacatcaatggcattgagcggcttaggacctctggctatctctcccaatcctccactttgtctccccccgacccccatctgccaagcccacctatgcatggttttatctgtgtgacctgcacattgcaccaccacactgatccaggtgtgctgttagtgccacacacagcatttagtatctccctgtcagcacaacatccaagaggttttactggcttagtcccagaacatgcacacagctccctcatacagatagtcatctgatttgagtcatctgatgtgaacaagtttcccaggaaaactctgattctgcctcccagtccccaggtttacacagtcatccaactatttggtcggtgttggccggcgtgggtcccactctgtcttgtggccagtctctggcagacagtgggacaaagactgaacagacttctttccatccattatgtccgggccctcccgccagggggccagtgctgtggggaagggccctttgcctccacaactcccaggtatctcatccagactggcatcgccaggatcccccaggccctgaagaggtctggctggccaggactcctgggggagattgtgctgctcctggggctttgagtaaagccagacaagcgacatcttaaccactccacaagaccacctctccaatcccctataagtgggtcttccattcctgtttatgataagcattctaatagttgctaagatgcaaaggtgacaaaggtgcagtttcaagcctccagggcttgaaacaaatacatgtcagcaaatataatggagctagctaaagcatgtccagggtgcacaccaaggcaggagttgactgttctccctggagagggtggaggtcaggacagactttccggaagagttgatccctgaatgaggtttgaaacaggagaattattaatataatgtggtccctgtactaccagagggttggtaagttgaggagggggtacgcagtggggaggaggaacagagatgagaaggggagtattgtgagcacagcaagcacataggcatgaaacaacacacatctcctctggtgaccaaacggggtttcccatgactggagctgaggtgtgaggacaaggataaggctggaactgggagggagactaaaatgggatggcctccaggccctgctaagaagtttggactctaacccctaggcaagggataagaactttcagcaagtgagaaaacctggtccaacttttatttgtactctagcagtagggtggaggatagagatggatcagagggggaaaaacgacagagacctaaacaattagtccaagcaagagaggatgaggtgctccctaaccacggtgaagtgcgacctgtttcctttcagagtcttcaggaaggatgctgctccctcagctcgcccttcccttcccactccccattatgtactctgtagatgcagtgtcacagcctgagctgggctcggaaggctgctccccaccccaccttcaggagacatcagcaagaatgcaacctcgatgcctacacttccccaagaactgggataatgtcaataaggagaggccgatctcaccaagactctgacgcccccagggttgaggggggtcctggtgagtgacaggtgggctagaatcccagaggcacccccaaatccaactagccagctcctgcttcttttttccatcttccaagattgctcaattctcaattcctcttcattcatccactgatttgctcaaaaaatcttttctgagtggtactgtatgtcataacactgccgggcactaggcataggcaatatagagcaggaaagagacatctaaacacactttccaaaagaaacatagtataaccgtgtacaaagcagccaagttacacagtgaccagtactatctagaggagcaagttgcagaaggtatttattgtatgtcacgctgaagggttccccttctatccttgctactcacagcatggtcctcagacagccacactgggatttgtttgtgctcctagaactttaatgtagatatgaatttcctggggatcttctgcttcagtaggtcttggatgaggcctgagattctgcatttctaacaaattcctcagtagcactgatgctccttacccaagaactacactttcagtagcaagactgtgcctggactgttgaggctctataggaagaagatgcatggaagatctgtagggaagctcatatttgcatttcaggaggataatccttcttccctccgacccccacaggtgggagctgggaggctgaggagcaggtagatctggagtggtttgacacagaggccttctttggagactgcctcaggcagtctctgtcagtgacagccaaactcagccacacgaaggaagaggtaactggcagctccaggcaacacttctacccaagactggaggaacatgtggggctagaaagagtctcctcttcaggagagttggttataggacatagagtccaaagaatatggaacatagagtcctaaaggaatcagaataaaggagagtatatgggaaggggagatagaggatttcagattaaaattagaactgatttcatgaaacctagggcttcggaccagtaatagggattctaccaaggccaccattggagttccttctcagatctccatccctagtcctcggtagcccaactaggtgagcaaatttatgccagtagatggcaggcattagaagcaaaaagaatacattagaagtccaagtaccaaaactgggccagggcttccccagcagaatgtgcatgctgagactggctgggacgagccagtgtctgtcctcattcactctttccaagtgtctgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcaggcagggttgtctctgacccaggctgctgaggcagctgcctgggctgcagaagagaaggccagccggaggaggcacctggcaggcgagtacgcagccagccttcgtcaccaactcaagctccttcgccaaaacctcctcgggaggcaggagcagtgggcctctttctgctccacgctgagggaggttcagcagcagctgaaagcacagatgggctccaggtcagagaaatcctctccggctgggcagaacccagaaaagtgtggatctggccaacctggatcagacttagggagacatgaaatggggaggagagaatgtggctgcagggggtcccggaactggccaaaacaaaacgtccttttcccacccctgattgctcctgtgcccctgcagggcagttccccagctggacacggtgctgggccacctgtcccaggtcgtgctgcaggagggccaccgcctgaaggcctggggcattctgggcaccggcactggggcggagctactgaggccaggtgagctttgcttgggcctcagccagggccccccaggaaacctggccctgaatcagggcaactagccctgtagaaactccagttccacccccagacacccagcaggggaggagaggtagaagagggcaaaacagagcggacaccccaaggtcgggaggggcttcccatgcaatgcctgcccaaaagaagaaggagcctcgaaagtgggaagaaccaaggaagaaacaaagccatggcaagtcatagctttatagatccggaggcacttcctgaaaataaaagcctggcagatgaaggcaaacggccaagtttggtaaatgatgaacctgtcttggggtctcgcaggcctgctgagtcctgggaatcccgtagcccccctgtaggctgttgccaccatttcccgaggcttttccagtctctgccggcctgcgcaatgatatcacaatggcacgtggaatactgctctggagttagcaaagatgagacccctgccccctcaggagcacaatgtctgtggaggctggggaggagttctcaccagctccttccagtcaccagccaagggagtccccgcatgttccctctcccaccggcccccagcccagggctaagcaggcaatgattgctttcctgcagccccagcaggccctcctggtgctgatgacatcagtgtgaaccccgtcaccaagttgatggtccctggccccaactccttgatgcttccagccagcggccacgcaggctccataccccctggctacttcatccaccctgacactgggagggtgctgcccgaggctggacacctgggatatgatctgctgagagctaccctggtgcccactatggacaccaatgccggtgagcccctggcccactgactatccccaactcagctctgggcttcagagatgaggcagggcttgctgggactctcaggaatgagctcccagggagcacagcacaggacgcagggctctctccttggacagtggggcttggtgaccagcagagtagtaaatacttccttcccctcctcatcttgacattcttgctggatccagaaggtgccatgagctgcatggtaaaaggaggcaggtcccaaggcccctctgtcctgctctgcagggctgaaggaggctggtgcattaaagggtaccaacagctccctgtatccctgtccaggtggtgtccgaacatcagaagctgccatcctgccctatgtgccctacccaaccagtcccaccacaggttcccctccagccacgcacctgcccatcctgcagccaagaaggacgtccccgctgggggctctcatgacagaccccgtcacaggcatcaaggtgcccgtgctggctgtgaatctgcacccccaaacaaggcagtggctcactcttgggaggacatactgcaatcctctcaccaagaccttggcccctctggagatggggggcccaaggaggatccagtcacaggaggcatctcgcccatcctgggagtcgggttggatgaaaacacaggtctcccggcagccctcagcattgtcctccctcgccctcctccatgcctggcctggcctcccagtccccttcctctcagccccctacaccctccatgttctgatctgagccacaaactccacccacgaccctctttccacccttcatcctctcagcctcttacccccaaccttccctctccccttccccatctctactccagtgcccctggggaggggaagagaagcaaggtacttctataaagttaatggacacttttcaaccaaaaaggaccatttctccacctgccaccaccatgctctaccccctgccccctccctctccccctcctccttccctcccacagctcacttccacccttgtgccctagttccccttatgccacacctgcctacatccctgctggttccccctcccaccttgcccccttggtttctttcttccagctcagctacttgtactgggagggctgcgagatgcttcggggaacctcttgctgcctggtgacagctttgtggagccactgagcaggaagacagtccggctccagggggcttcctgacgagagggccagacattgccccatatgggagggccacaggccctgctggacaccaatgtgctagtggcccagaggcaagtgattgcagtgcttcagccgtgccaggagagtccagagtcgggtgtacaggaaactctggaggctgccattaaggacatgagacagccactggccttgactctgcaccatgtcctgcagcaggctcagaggctggagaggcagctggtgacagcagatgacattgaagccagtggtggcaggataggtatggatgaatctgggccagaggctctcaggccccgatatctcgggcccagaatgacctggtgctttgatgctcctaggcccataagctcagggacagggctgcagccctactggccatgcacatgcgtgaccaagggaagagagaaggaactccatgacttcataccccgaccccatgagtgcttgactgcctccctgtcttaatttcttgccaatgccattgagttatgttatggagcatacattctcttgttacttcatggctcatgaaacaccaccaacaggtgctatgatacccattttagagtgggaaacctgacattcagagagttaaatgagttgcccagctggggtcctctagctgcaaagcctgaatctcctgagtcctcaatcccttctcaccttcattctgcagcagtcttccacttcccacgaataaacgcaagaaaggagttcatcccaaaactccacctcccaccgacagccctgatacaaggaaaggcaaggagaagtaggagtggcatcttcctggagttaatctcactcattctagaaattaccctcttcccacaaataacaacaaaacaaaaagaaccaggtcagaattgacttgagtttgaagacctgccccacaatttattaactctttgaccttgggcaagttattaaaactaacccctccctgccactgttttaccatcttttaaaaggaagagtaaaatcgtgcatactggccgggcacggtggctcacgcctgtaatcccagcactttgggaggtcgaggcaggtggattgcttgaggtcaggagttcgagaccagcttgatcaatatggtgaaaccccgtctctactaaaaatacaaaaaatagccagacatagtggtgggagcctgtaatctcagctacttgggaggctgaggcaggagaatcgcttgaatccaggaggtggaggttgcaatgagctgagatcacatcattgtactccagtctgggtgacggtgagattccgtctcaaaaaaaaaaaaattgtgcatactttatagcttgggttgtaggactgagtgaaatataacttctacagagtcctgagttcagattctgaggaatggcaggtgctcaagaacacaagcccccttcttttagaagttgttctcagcttctcaaaaggtctgatgccactcaattcccacttgcttcttccaaaacaggccattagggcattgtcctttcttcctttctgaattcagaatgctaagttgagcctaaagaaaacaaatgtagtgtttgcagggaagcctctctggtcagggacgtagtactttgaacctggaaagacttcagggtgatgcttaacccgcaactcctcctcttcactccctctccccctggtgttgggaatgatgcgctatcctgggacagagctgtgggccccagccctgtatggaatggagatcccagatcctgagggctcggggctcatggtgcctatcctgggcatggagcatgatgagaattctggcgatgccacaccgctggcaggctcaatggaagacgctgatggcaaaggtaggagagaactttggacctctgagagctcaggaatgtgacttagctctgggagagaaaaccccctaaagctcaggaggggtacccatgtgccaagggaaggggtcattctggtcttctgctagggctgctgagacccaaaattaaaggtgcccaaagattccaaaaccccaggaccataaatcatgtatgtctcccctagattattgggtcctttcaaagaccagcacttcagaaactcaccacccacccccacgccagggctgtggccaccaggagccctataatccagcttagagccctttgaagggcaaaaggaggtcaggggctcttctggcttcctttttgccagaaaaaggacctgccttccttccccatctctggtttctaaagccagtggtgggcttggcatcccacaggtctaatcccaatctcgattggggctcaagccatagacccctggactagaaagcctggtcctgtcattggagctcaaacggatctctctgccagagtggtggtgcccgttgtccaggtgctggaggctttacctcggggagtgagagaccctggtctggtatgtaggggggtttattgtattcatttattcattcattcattcactcagcaactacatattgagagctgtgttccaggcaacatgttaggcattgagatacaaggacaactagatagggctcccaaggaactggctggccatgggtcccaaacagtgggtggttcacaagggtgttaagaaagctcaggggagggcatctcaacacacacaggagagctcaaggcttcccaaatgaggtaatgcacgcagcagagagacagcagagaaagtcactccagcctcggggaaagcaaatgcaaaggcagcaagtatgagaaatgtatcttctatcatgaaagccacggggagctgctgaagggttctcagacatgggatataatcaaatataaatgcaagactttaaatttttgaaaatatgaaacaatacaaaacataagttactcatacaattttaaagtatgtcaatgaagaagcaaaagctttcctgcccattcctctccctccacccacagtcaacacccccatggcatccccatccaggcactctttacctctccccctgtctctcccaccaaacccagccacttcacaagttggcacacctcctcccatttatttttatgtttatgtatgtgtaggtacagtcagcgttctagaaagctctccctggcagctgtgcggaggatggatgggagtggggccagactagcagaggaagccccgtcaggaggttattgcggtaattcagccattggcagatctccaccacaatgaaaatgatttagggcccccatacattctcagtctggttacgtttcagaaactgtgataaaaggtatgtgataaataaaaggttcttgttagaagccaagaaatttcaattctagccctgacaccactgtttcacaggtcagtatgtcttcacgatatgaggagggtgagaacaatttcctgccgccacgtgcctgtctcctctggacttcccaagagaggagtgggggcaggaggcatgggggactctggagcaggtgtcaccaggagggagggaggaaccagggagcttgaagaaaatgtatggttatttttctagctaaaaccacgttgttggaaggcagaggtgggaggatcacctgaggtcaggaggtcaagaccagcctggccaacacggtgaaaccccgtctctacaaaaatattagccgggtgtggtggcagtcacctttaatcccagctacttggggggctgagtcaggagaattgcttgaacctgggaggcagaggttgcagtgagccgagattgcgccattgccctccagcctcagcaacaacatgagactccgtctcaaaaataaataaattaattaattaaataaaaccaagttgatggcctcaccaagtttagtcatagatacccaaggtcagggagggccattaccctgtgaaactttggggatctacggctggaccacgtggggccatgagcagaaaaagccagtaagccctaaacaggctggatattgtagctggacatcctggagcaggagttgagagcccaggagcagtactggtgccaccaggaacaggaggaggagcagctactggaacagctggggcacctgagccaggagctccactccacggcagaaagtggcgctgagcagcaggtgaggcccagaggcaccacctcacagtccccacccatctgccaagattgcacagttttctctttgaaagtttggagtccttttctccctcaaccatgggaatgaaatccatctcagaaaagacacagtcccaagattccccagccccaggcccaagatttcagtcacccctaagtatctaagcaggacagaggtaggggaggaaaagcaaacaggagccccacccagagctcctgccttcccctccgaggcccattcctttgtcccttctgtcctacatagctgaaggctgaagaggaggcctgccaggcccttgagtcccgctgcctgcaggagatggagagaagagccagggctctgagcacacacagcagcccagagcggggcctgctctctcaaggtgggaaagcatctcctaggctcagatccccacagcagaaatctccagggagtgcatcaccacagatagctgccccgtggggagcccctcctgccctctgaatgtgctcagctctcccaggctcagccaggccctggctcttacctgcaggttcccctgactccgataatctattgtcttttcttctcctccctacccctggtggtggtcgctgccatgtggccttttctctgccatttgcagcagagaggagtgggaacaggaggcacaggtggtgctaggtatgcagaaggtcctgcagtttagggcaggcagcagaaaagcttaggcaagcagctggccggctgcagggccaggaggaggagatgcggctgcagcaaagcaggaatcagagcccacaggtctggaaccgccccaggaaggtgacgctctgaggctgacaagggtccccacatgtgatgagcacatcctcccacatcatcagatgtggctcttcagggcaatgtaatattcaggggtaggtgggctcaaggaaccttggatgtgccagaaggggagtgagaagaaagaaggctcatcttaacttggccattacgttccctgtgttgtaggtggttcagcgtccctctgatgagtttcagtgggtggtgagggagagacagaacttcctggctaaggccctgggtcagctgcagtaccgacgggagtggagctgcctccagctgttgcacacccaggtgctgatccctggactggacttggctgaggagatctgtatttccatctttgatagggggcctcagaaagagactcccaaggcaaccacgtgggacaggtggggaccaagcatggaactctgtgctatttcatcctagatgattgcctcaagaacccctgtgtgtttggagaattaccctggagacatattctatggaacagtcaccacttctctcagggaccgggctgctacctgccccctgttgatcccattcctgaagcagctcactgcagcgctagtaggagctccagggctggaggatcagaggccagaaacaggtcaggctggtccctattccagcgttgtcttctgcagccaatcctggccatttcaataggtcctaatgctacacttagaattcccagcaccataggcgtgtgtccccagtaggttctttaggaagaacattagaggaaccaaatgcattagttattgattgccatgtaagaaatgaccctaaaatctgatggcttaaaatgacatttattttctcacagtttctttgggccaaggatctgggtgcagcttagctgggtacctctggcccagggtctccacaagctacactcaaggtgtgggccaggactgcagtcatctcaaggcttgactgctggaggattcacttccaagctcactcttatggctattggcagacctcaagtccttgcctgctgttggccagagacaacaattcctgccatggacttcatgggcagctcacaacatggcagctggcttctctcagaggaaggaggccagagagtgagagagggcgagcaaagtggaagccaacgtctttttttgagatggagtctctctctgttgcccaggctgtagtgcagtggtgcaatctccactcactgcaacctctgcctcccaggttcaagtgattctcctgcctcagcctcccgagtagctgggattacaggtgtgcgccaccatgcccagctaatttttttgtatttttagtagagacagggtttccccatgttggccaagctggtcttgaactcctgacctcaagtgatcagcccgcctcagcctcccaaaatgctggcattacaggcatgagccactgttcccagccccacagtctttttgactcaatctcagaaatgacaacccatcacttttgccatgttctattcatttggatgaacgactagatccaacccacatgcaaggggagggaatcacacaagggcatggatacacattagggggtcactggggccatcttagaggctgcctgtcacatccaatgctacagctggctccttttggctttggccacaaccctaggccctcacctcaataactattttattcccctctgttcggatacagataaagctgacatcatctggacttcaccattcttctccatcctgaagaaaacagacatctggtcccaagcccacaaggaagaagctgaattgcaaaaataagtgtatcacaaaccaggtaaccttttcccttgtagctcctgtttgggattctcatggggggcactgaaggtatgtgatggggtaacccctgggatctaggaatgttagaatcctgccttgccaaacatctctttctctctacccccacactaaagttccccaagtgattttcccatataaggaataacaaataggaatcaaagtacccttataactataactgagcaaatttccaaaagggaatttccaaaggccccctgccttccccatcaaacatgaatctaaatcttgggacttcaccccataccagccagccacatgttagaaggagctaatgtaaaggtgtgaggcaggaaagggaaaaaatgaaaagggaaaaaaacagaagaaatgaacgaagagaagaccttgctccccaaagggaccccagatcactttaccaataccactccttggaattggaagtcaagagagcacgtggctttcctaacctgaagagccaggtccgtttcaactcacacacatcccaagtggaagagaagtaacagaaaatgcatgtgtgcctttcagtagaccacagtgcagggctccaggtaagcacagcaccatgaacacccctgaacttgagcagggaagtgcaaactatggcccactccatacctccaactccaacctgctacctgtttttgcatggcccacaagctaagaaagattttacattttaaaatgattagagaaaaaatgacaaaagaagaataaaaattttatggagtgctttataatatgccacatactattctaactctttagatgtattaactcatttactttttacaacaacccagtaaactatgtactattactcatcttatagatgagggaactgaagctcctggataggtcaagaaagtattcaaagatcatattgctagtgagtagttcagctggaattcaatccccaagagtctttccccagaccctgtgctcctcacgtgcttcctcaaatgaaaagttgttcaacactatgaaggcagtgccaaaagaagatgcaggtaacacattttggtgagttcccaggagggcagatcacttgcttttctggaccagagaagcaagagaaggctttgtaggagaatgaggccatgcttctaccgtgaggaaagggaacactaactttgaaccctaattttggcttttggctaacaaagcctaaaatacttactatctggccctttccagaaaaaaaaagtttactgactccagagaacttgaccaatctcattattaattcctcctttctttgggtgaaactaggaagggaatggcagagaaatgagctctcctttaagggttcccagccccacttcaaccttcgtcttgccattatactggccttgtaattttgagagtaattttatatacattatcttgtttatatcttctagttctagaagatagtagaaggttattaattactttttaatagatgagaactgatgctcaaagaagttcagtgactttcttggggtcttatagaacctgggccagaacacaggtcttctgactgctacttcagcagtcttccctaaactttgctaccaatccattctttattgttctctcaaaaacaattaaaaaaatagaaattttaaatactcaaggccattacagacattccgtacagatattgtagggaagtaagattcttaaatatatttaacatttgctgaatgctttctatgtactagacactgttctgagtatattacatttaatgctccaagcaactcaaggaaatagaagaagaaaatctgttgccatcttctgtggaccctcattctgtcctagcccctctgttcctattgactgaaaatcattttttccataaaggtggacagaagaccatgtagcatgatgcatatatagcacaggaggatggatgggtgggtggatggatggatggatggatgatagatggttgcaataaaccttttcctaaattgagttgtgttgttaacatatcattattgtacagaaaagttagtgaaattattactggtttctcctgatctctgtagacccaaagagctctctgcaggatcttctaaaacctcagacactgcagaaggaagagttgataactgtgcaacccactgacctttctgccagggagtttgtggtttaccagtatggcctctccatcctgcacctccttatcccccagcttcatgtaagtcttgtttctggcctctctatggagcagttactcatggagcctagaaggtcagggtagccaggaagaagcctttgagatggcagatattccctaggattaagcacctggaacagcaaactttctagtctctcctttaaggggatttatgggagttattttaccaatccaaagtctaatctctcgaatgatattaatcacaggtagaatgaattagtcactttctacatgccagaaaatattctaataacttccattaattaactcatgtaatcctcaaaaaaccctatgagacagatactattatttttcctattttaaaattgagcagaagagacacagtggttacataaacttacccaagatcacacagccaaaaaggcagagccaaggttaaaatctaggcatcatggctcaaatctctctagtctagtcaagttctatttagaaaagtagtaaattgattgtcatatttagcataaatattaaatatgcagttactctttccattttcctgtatactaagcctacttaccctgttgcaatttaaattaatgccccaatgcatttacttctcatcaatttggctgatgccacgtagctgagatgcatgagaattttttagcaaaaggataggtttggttttgttttttattcttttcaggctccagaaatcaccctgaagatttcttctcatcttcctgccatggaagcccaaggcagtgccttccaaggtgccttcttctaccaggtgctgcaaattcattcccagatgtgggttataaaattctggggtccagtatagataaatgaaagcaaaaagaacaaattttataattttttcctaaaatcctgacatattttattccctcctggaaataagtcatttagctaaggcataataaatgtcacagtgtaagagctttctctaatcagtaaaatgaatatgttctggcttgtgcccagagaagcataatagcttggtgccctttaatagatctctgtcattatcaaagccagaggttccaggctggtatttcctataagagtcatggttccagcttcagaaaatcctggacaatcagcatctttctacagaaaaggatctaaattgttcctgtcctggcagttcttcagatatgtagattggaagtgccttgctggtaactgccttaaacactgatgacagtctattgctaaacaattctgagaggagaaactgctcatcgatactggagggttagaaaaaggtttatacttgactagtaggttgttggggggtttaataaaaccagaaactactcacatatggtactctccacacatttcacttgatcctcaaagcaactcgatgaaatagacgagaatttaatcccattttatggatgggtaaacgaactcaggttgtggtgcaagtgccgtgtgccaggaactcagccaggtgccttacaggcatggtctcatttacgactcacaacactatggggtacttttgttatctttgttttagaaattaggaaattgaagcccagagaggctaagtaacttccccaagatcacagagttagcaagagttaaaactcgagcccaggtgtgtttgacaccaaaaactcataaccatgagtctatgcagctgccactcacagctgagtcaaaggatagatctcagattgtctgattccaaactacctgaagttttttcatgccaacctactgtctcttaagagaatgaacaagagagttacttcaaatcaacaggcaagagaggcgatttgaaaacttgattacaataaaggcatggaagatgaagaaagccttgagagccctctaaggcagtgattctcaaactgtgatccttagacctcctgaaccaaccacttggggaacctgggaaaaatggaagcacatagaccccacagatccaggaatttggggatgggtctcgagaacagaatcacccccttgtgattcttattacacaaaagtttgaaaaccactgcttaaggaaacagtgattggaggatattgacaaaagagatacacaagtaactctgaatttctaagtttgttttctgtaagatggaggcagtaggaaaacttgggagacagtggagcaaatgacttattcagagagttgaactcaaacaatttttccccggtcatctgaatcttcccttcagcaaatttccattagggccagagagtattgttttagaccatgtgccataaaccctgagaaagaaacgggcggtgggaatgttcccaggggcggacatctctgtgtttgggtgttttctcctctcacagtgctgaaaacacactgttcattgggagagaatgtttggcctctgtgggaagctttgttctgctgctgatccgctgcctggcccacatcactgctggggaaccccaccaggactccagccctgcctttctggggtcattttacaaggtatttataacatgtacagggcattttgcttctctttctctgtgactcagaccccgttccccaggagaataaatgctttaggctttgcaacatttcaaatctacttgagtccccttgtggcctttggttcctcctgcctggccaggaagaggattttcctaatcagatttcccgtggcagcatatgacaaaatgcacgtaccactgcttcacagaagtggttttcctatgagcacagcatctcagctttctgtggctgtttaacagttcacacataaactgcaccagaactgctaaagacaatgataacccatggtgagggcaagtaaagatgagaactctcaagccccatttttctttcaactattattttaaagctttaacagcaattgtatagaagccctactgatctgtcccccttgccttctcttcccttgaccaagggcctggaggcctatttcagggaagcattccctatcacactgagaatggcagcagtttccagggacagtaaacttgaccaaagcataagtgctatcctgctggaagagcagcccatctctgacagagaaagggatcttctgtctaaactcattgaaatgaagcatgtatctcccttggagccagaatcactagaagaggtaactaactttatcatgtgtatcacatggtcttgactaaaatggacttcttcacagagtaaatgcctcagtgtattcagatatttctgacctcaagccacatatgacaatattttttgttttgtttttgagacaggatctcgctccgctgcccaggctggagtgcagtgatgccattacagctgactgcagccttgacctgctgagcttaagcgatcctcccatctcacccttccaaacaggtgcacaccaccatcccggcaaattttcataattttttgtagagacagggttttgtcaggttgcccaggctggtcttgaatgcttgggctcaagcaatccacctgcctcagtgttcccaaagttctgggattacaggcatgaaccatggcacctggcctcatgacaataaaaatcctattctacagggcagacagtagttacatgactgagtcatgaggagtacaaatgtgggctaacttcatgtctcactaatgtattatcaataattaagcagaatcccatctgtaaaactgtgactcatactaactttagatgcccaagtggcagcatgtttacccaaacttatggtgtgctgttttctgtgcaagcttgataatgatattcttaatatcttgttaaagcacttttgccaggtgcagtagtttacacctgtaatctctgcactttgggaggccgaggcagaaagatcacttgagcccaggagtttgagaccagcctgggcaacacagtgagaccccatctctacaaaaataaaataaaaataaattagccgggcatggtggcacatacctgtagtcccagctattcaggaggctgaggcagaaggatccattgagcccaggagtttgaagctgaggctgcagtgagctatgatcacaccactgcactctagcctgggcaacagagtgagatcctatctcaaaaaatacaataaaacacttttttgaaagtatctcagcattttaactattaaaaataaaaatcataaaatttaagtctatgataagaaaaatatcatcctgcactaaaggttaattcattcttatgaacaagaacatatcatgtttcaatatttatatcaaactataattttcaaagccacttttatatatagtgtcactcgatccacccagcaatcctgcaaagtaggtagtgtctatacttttagccacattattgaaaaagaagataaggaatttgcccaaagttataaagctatttgtagtggtggatctgagactagattctagatttcctgaatcctgctaagtaattgtcccgtacacatatctccatcattgaatctctattagttactaaggcagatttattttgtgggtttgataatgatgtcggtaatccagaccacagaattctgttggaccccaattcccacaaatcacagagaacagtccattttctgtgctcatccatcagcagcatttgacatatctgaccatattctcctccttgacatatttttttcatttggctcccaagacactggcctcctctggttttcctccttctctgattgttccttctcagtcttctttgctgatccctgctcttttctccggcctcttaatgttggagggccaggactcagtcccgtccccttctccagtctatattttctgcccttgaaggtctcttctagtcttccagctttaaatctcatctatatgtcaatgaccctcaaatttctatcttcaaccccaattctctaacccatacctccaactgtttattggccatctccacctgactgtttcaaactcaacatgtccaaaacgcaatttttaatttctttccaaacctgctccactcaaaaccttcccccatctcaactgatagaaactgttcttcaggtttttcaggccaaagcatcccttgaaactcatctgttacacacacccacaaccaatccatcaggaaatcctgttgttctactttcaaagcatatctagaatccaaccactgctcatcaactacaataccacccttgtgaaaaggccaccattgcctcttgcccggattactataatccttactaatggcttcctcaagtccacccttgtttctcttcagcctacttgcaacacagcaaagtgatcctttcaaaatggaaattggatctgctcaaaatctgctgtgtctccccaatttactcagagcaaaagccaaataatattgtcatgaggccttatatctcactctcttacctactacccttcccctcattcactcaactccaaccacactttcctcctcactgttcttcaagcactagggacacttctctcgagggttccctgtgcctggaatactctttcccctagggcagtgtttctcacccaggaggaatttttgtcccccaggggatatttggcaatacctggagatgtttttgattggcatgactcaggagaaggggttgccactgacaactagtgggtagaggccagggatgctgctaaacagcctacagtgcatgggacagctcccagagcaaagagttactcatcccaaaatagtgccaatcctggtctacccctgactcccttacctccttcttatcttggttcaaatatcaccttctcaatgaggccttccctgactatccaatcttaatttgcaactcttttccccctactcagcagctttctcttaagttttcctatatcctttcctaacacactacataatttacttacacttgttattactttccttcctcagctggaatgtaagctccatgagggcagagagatttgtttcatttcctgatgtaggccatgtgccaggctcacagtaggcttgagatgtatttactgtgttaatgaacaagtagatttatatgggccctgatgcaatatactgaaaccacaatctacctgagctaactataagacagataatagcaaacatttattaccttgccatgtgctacatgccatgttatgattgagagttttacatacatcatctcacttaatcttctcatgctcttataaggtggaagccactcttattcctaacttatggatgaggaaaccgaggcctagaagtgaaaaaaaaaaaaacaccaaacttgcctaagacatagcaatagttgtggagctggaatgttagtcctctgctaaccaccccctatgaagagatattgctttaatttaaaagcaaaattgtacatagtactctcaggtccacattctggctaacaagatccaagggcacttaaaataaatggtaacaagagtattaactctgtcttccacattctctacagtatattcataaaaacaaagatcttctgctcttcaccagtatggaacatttcctaaaaagcatcctcgctgcagaacaacaaatcctaagaaaaccaagaaatcaatttgggagtgaagataaggtgagatacccttatgatcaatagcattaagataacaattagctatatgccaactattatttattattgtgtttggaccatatttataattgaacatgtccacagaataaaaggttggaaatgagtgatggtatgaataagtggcatcacttcctttaagagcttctcccacaacaacagagggtggatcttatatttcagaaaggatccaagagagcatagagcattggtcatcagggaaatttaaaactacattgagataccacacaccagaaaaatgaaaatagtaaaaaagttgtagtttaaagcatagtttatccctttccctttaggcaggtaacatattaatcctagagagaaggaactgaggattagacttgcccccattcatcaagctggaggagaacaaaaagtagctagaacatgggtccactgtcttctcattcagggtttcttccactacaccacaaagataccaactgctgttttacaaaagtttatttttaatcctaagcatttaaaatgttgtatctttaaaaatcacacgttttggttccaaatcatcactaatattttgtaaggtcaatggaaaatattagcaaagagagaaccccaaagtcttcatcttccccatgcacagtagagacctatcatgtcaagatcaagatcagaaactagcaacctagagaaataaccaggcactgactcctcctgggccccaatccactttatttaaagttattgccagtgtctgggatgaaaacttttaaacctttattaaaataacagctttaaaagtgaacagataataaatttatacctcaacgagttgtccaatgtgaatactcccatataaccagccccagatcaagaaatagaacatcaccagttctttagaagcagcttatgcctccttctagtcacatgttccaagatagagtaaccaccatcctgacttcaaacatcatcaatagttttcgcttattcatgaacttcatataaatggaaccataagatatgagttactttattgcttattttgctccactttctgagattcattcacattgtgggaggtagttgtagtttgttcattctctttgctataaactatcccactgtgtagatacattactacttactcattcaactgttgatgcatatgtgggtattttccagtttgggattattacaaaacagccttgcacaccttctggtgatgatacataactatatttagccaggtacatacttaggactagaaatcttgggtcttaggacatggatatgttcagtgttagtagatactaccaactagagttccaaactatttactgccaacagtgaaggttctggttgctttccatttctatcagcacttagtattttacatcttttttactgttttcatttttctggtgtgtggtatctcaatgtagttttaaatttcccagatgaccaatgaaactgagtgtttttcatgttgatataccatttagataccttctcttgtaaagtgcctaatccagtcttttgcccattttccattagattgtgcctattttttttcttgctgatttgtaggaattatttattctgcaactatttcccccattttgtggactgtctttataaaacaactatataatgtttattttttccattttatttttagatctagaaagaaaatggtaatctcatttcagtctgcattattaaaaggtcttaaatacatcactacaacatctgatgaagctgataagaattattggaaaatctataatattcatggtaaatcacataaatgtgtatcatagttttaagtgtatatataataggggctaatatttgccacagaggttgaggacccctgctcactgtgactaaaattttcagtgtgactaaaagatcattagatcacgtatcttattaaaatatgtattaaagatattgactaaaactttctgggaatgtaaaacttgtatatgtcattattcaatcaggctaaggttgtctattactgaatcacaaagtagatggatatatatatataatatttggtgatctagaatgtgtacttaaaatataggccatgtcacacaaaattcactttggaggccctggttgaaacaccacaaagagataagcagtcatctgaaagtgaagttttggagtgctgatcaggagatacaacaccatcacatgaatttaggttaaaaaaaatccagatacaaacttcaactcaaaagctgctcagattacaaagccaatgcttgaaattcaaactgcttctcacatggataattctgtatcatgccctgtatttatctgttctcatgctgctaataaagacatgcttcagactgggtaatttataaaggaaagaggtttaattgactcacagtcccacatggctggggagacctcacaaccatggctgaaggcaaatgaggagcaaagtcacatcttacatggcagcaggcaagagagcttgtgcagcggaactcccatttataaaaccatcagatcttgtgagacttattcaccaccacaagaacagtatgggggaaaccaccccccatgattcaatcacctccactcgaccccaaggaaggatctcttaacacatagggattactacaattcaaggtgagatttgggtggggacacagccaaaccatatcatgcaccaagagaagtaccagaatagatacacacacacacacacacacacacacacaaaataaaacatttgttaacaagtctcctaagcaatgcaaggaagatagacgatagactactaaagaattaaagctttctttttaaaaatattatttgggtagataatgaaagatgactaatttatgaattcagtgtccatctggtattcaacatttttagctctgtaggtcttttgtcataattaagagacatccatacatggctgaggatttagctgtcaatccaactgatgaaaatactaatggtagattactttcaagaaaataaaataaaaacagtgaaataacatgaaaagaagatttacaattaagttaaacaaggatttttaaatcaagctatcaggaacatctgctcagaatcaagtcactacatctaactcctctattttgagttttttgttgttagaattggctacttagtcatcttaattcagctcacatagttagattagtcatcaggtaagtaccaaattagacagccttaaaaatacctcattagttaccattttgattgaaatcgtgctttcatggcacagatactaataaaatggtaaaatagtcattgcccataagacgggctatgagggagctgtcctcccatttattccattaacagggaattcttaaacagagcacgccctcaaaccaatgcataactttataagattaaagactctctagtattttaagaagaaggcaagtcttagtttgatttaatattgggtatgtgtcttcaagaactttatttagctacccacataaattatgaaatgtatttcccagaaagcagagtgaagattaattaagccagacacacaagactatttaggatagttaagccacgagtccagggcccctgggagaggtggcaaagaaaaagtagtacagaacttaaagaccttttttctatattcctcattcttggctgatcaaggcatctaccaggacatgatcctattaatttcctggctgacttcttgggctctgtgtcttatttccattaatacactaacagctgcaggcttttagtaagcacatgctttttaatggaaatgccacagattacaagacagggatcatgttctccttactgctgcattatgcgtttttattgctgaatcaaatcaatagcaagttcttttttaaaatcgacattctagttatctgtaaggaacaagcttgtgtacacacacacacagcccactgactagaaaacagataagaaaacctcaataaatgtagaagccatatttaccaactattatcaaaaaagacccttttccaaaaatatattcaattgtcttaagatttattatttcaaaagtgatacatagaattctatctttgaggaagatgggataggtgttttttctgtactcctcccactaagaacaactaaaatccctgggcaatacacataaaagaaagaagataagactctgaaaggtgtagagaagaaggcagactggctagggaacctcagattccaagggaagatatggaggtgagttctaaagattttctttccccatcgtatattccagacttggaaataaagaagccagcaacccataaataccaatggtaaccaaccaaaagagaccacaaaagcctgctctttagcgaaaggaccaggaaagggacagcgcagcaaaaaagaaaactttaacaataaatcctataaactaacaaaacaacaagaaaaaactggccctacccacaccagcataagttgaatggggagtctagagctccatctttgccagtatggatcaagtcatcccagcctcctgctaggttggtatcagagacgaccgagcagagaactgggaattttcatccccacagggtagttcaaaccctcctccacctcatggtatcagtagaaaccacatagaaagtctagacatccccacacctggcagtaataacctctcccctccctgcagctgccatcaccaccaccacctccctgctgtagtggaatcagaggaggacaagtagagagttagggcttatgccattgtccagtgataatgaggccaccctggcctcagtgttagtggaagccacataaggagctagaactcctatacctgcccagcagtaatgagagaccctttcttgggtattaatggaggccaagagggaaacccggacttttacttccactaggaagtagcaaagcagcactcccttctctcccccactggaatagggtcaaaggaaaccagttgaaacaaagtttaaataaaatcccaagtctcatggtatcaaaagcatccaggtttggcaaaaatcattcatcacactaaaaaccagaaagataaacaaagagtgaggagaaaacctaatcaacagattacaacaccaagatgacaaagatgttagaattatgacaaagattttaaaggagcatcagaaaagtgcttcaacaagcgattatgaacatgcttgaaacaaatgagataagtctcagcaacgaatggtaaagtcacagcaaaaaaatcgaagacagaactaaatgaacgttttagaaatgaaaaatgtaaaaactaaaatataaagcttcgtgaataggctcaacagtaaaacggaagagatagaggaaaaatcatcaatgtttttagatagaacaatcaaaaattatttaatctgaatgaaagagaaaaaaagactgaggaaatgaatgcatagagcaccaggggcatatggtactatagcaaaagatggagcattcaagtaatcaaagactcagaaagagaaaagaaaggggtaggctgaaaaaaaatactcagagaatagctgaaaacttccaaatttggaaagagatataaccccacagatttaaaaagctgaatgaatcccaaacaggaaaacccaaagaaatccacaccaccacatcataattaaatttctgaaaacaaaaagcaaagaaaaaatcttgaaagcagccagagaaaaatgacaccctaccactagaggaaaaacaactggaatgacagcaaccttctcatcagaaaccaggaagccaggaagaagtggcacaatatttttctaatgctgaatgaaaagagctgtcaacccaaaattctatacaaagggaaatattctttaagaatgagaaggagaaacaatacattctcagatgaatcaaagctaagaataagccgggtgcagtgactcatgcctgtaatcccaacacttctggaggccaaggtgggaggatcatttgagcctaggagtataagacgagcctggacaacagagtgagaccctgttctctatttttaaaaaagagctaagaatatatcaagcataactcacctaaaagaatggctaaatgaagttctctaaatagaagggaaacaaaagaaagaacttgtaacatcaggaaggaagaacacaggaagtgaaattatggataaatatgatagactttccttctcttgagtttctaaattatgtttaacagttgaagtgaaaactataacatggtctattatagctctaaatatatgtagaggaaatatttaatgcaagtatattataaatgggggaagataacaagacaaagggaagtaaggtttttatattttacttgaacttataaaataacactggtagactgtggcaagttacatacatataatgcaatacctagagcaaccactaaaaaagctatacaaagaaatatgctcaaaaacactaaagatatgccaaaatgaaattctaaaaagtgttcaagtaacccacaagaaggtaaggaacagaaaattgagaaatgaaaaagaacagaaaacaaaaactaagtggtaaactcgaggcctaacatatttataattgcaataaatgcaaatagtctagaaacaccagttaagagacagaaattggtagagtgaactaaaaataagacacaatatgccatctacaagaaactcacctcgaatataataaaataagcatattgaaaataaaaagatcaaaaatagatactatgcaaacattaatcaaaagaaagcaggaatggctatattaatatcagataaagccgacatcacagcaaagtagattaccagaaacaggaacattacataatgatgaaagggtcaatctaccaagaatacatagcagtcctaaatgcttatatacacaacagaactgcaacacatgtgaaacacagagaaacggacaaatcacaattatagttggagacttcaatacctcctctcagcaatttatagaactagacagaaaatcagcaaggatataaaagaactcgacaccatcaatcaacattatctaattaacatttatgggacattccccccaacaacaacaggatgtacattcttttcaagtgcccacaggatatgcatcaaaaatcatatcctggggcataaacaaacctcaacaaatttttttaaattgaaaacatgcagagtgtattgtccaaccagaacagaaccaaattagaaataaataacaaaaaccggtaaatctccaaacacttagaaactaaacaaaatacttctaaataatccaatggttaaagaagtcttagggaaataaaagatacattgaaatgaatatcaaagaaaatacaacatatcaaaatttacaacacacagctaaagcagtgctgagaggcaaatttataatactaagtatatacattagaaaagagggaaagtgtcaattcaataatcttagcttctaccccaaaaatctagaaaaagagtaaaataaacccaaagcaagcagaagaaaggaagtaatagcaaaaataaatgaaactaaacacaaaacaatagaaaaaaacacagtaaagcaaagagctatttctttggaaaggtcaataaaattgacaaccctctagaattaaaccctctgacaattaaaaagaaagtgaagacacaaattaccaatataaagaatgaatgtagggataccactgcagacctgcagacaccaaaaggataataaggaaacactataaacaactccacatgcataaatttcagagataaaataggctaatttgttaagaaacacaaagtattacaactcacccaatatgacacatattatttaaataatcctaaaactattaaggaaattgaatttataattttttgatttccaaggaagaagtctccaggcccagatagcttcataatataattctaccaaacatttaaaaataggattaacatcaactctatgcaatttcttctataaaatagaagagcattacattctgatctactttatgaagtgtttacagtatgtatataataaattacatattgtactatatatttatagtattactctgataacaaaaccaaagatagtacaaaaaattagaactgtagaccaatatatttcatgaatataaatgtaaaaacccttgaaatattagcaaataaatttcagcaatatataaaatgaattatatgccatgatcaagttgggtttatttcatggatgcaaagctggttcagtatattttttaaaaaaatcatagtaatccacatgtcaataggctaaagaagaaaaattatatgattatataaatggatgcagaaaaagcatttcacaaaatccaacatccatttatgattaaaaccctcaaaaaatgggactagaagggaacttcctcaatttgatttttttaaaaggtagtatctacaaaattgatgagtatctacttaatggtgaaggattgctttctcccaaaaaaaggaacaagtcaaggatatctgttcttagcactcctattcaacatagagccaaaagttacacccatgaaaagcacaaaaaaaagaaataaaatgcatccatattgggaaagaaataaataaaactatccctatgcagatgacatgattgtcaatacagaaaatcccaagcaatctacacagagataaaaaaaattcctggaataactaagttcagcaacatctagaaaggacaaaaggaaaacacacaaaaatcacctgtatttctatatattaccaatgaacatatggatactgaaactaaaaatataacaccatttataattgatcaaaaaatgaaattcttagatataaatctaaaaatcatgtacaagagttgtataacacacacacacgaagaaattgatctaaataaatggagaaacatattgtgttcataaattgaaatactcaacatagtagagacatcctttctctccagattgatatatagggtgaatacaattcctttcaaaatctcagcaagatttttcatagatatagacaagatcattccaaaatgtacatggaaagggaaagaaactggaatagctaaagtaatttttagaaagaataaagtgggaagaatctatccagtttcaagatttacacagctacagtaatcaaaactgtgtggtgttggcagaagaataaacacacaggccaagaacacagaacacagaaatacacccacagtgatatactcaactgaattttcacaaagatgcaagaacaatttgatggaggaaagatagtcttttcattttaacaaatggtgctggagtaagtggatattcatagaggagaaaaaagcactttaatctaagtctggtatctcatacaaaaaattaactcaaaatagatggcaaactaaatgtaaaacataaaactttagaaaaaaaaaaacttcaggatctagagctaggcaaaaagctctaaaacttgacaccaaatcatgatctataagagaaaaatgaatgaattcgacttcatcaaaattaaaagattttgatctgtgaaagacgtcattaagaggataaaacacaacgtagaagtctgagcaagatggcctaatagaaccctctagcaagcatccccctacaggaacaccaaattgaacaactacccatgcaagaaagcaccttcgcaagaaccaaaataacccagcccaccaaggcagttcctcaaggagccagcagaaattgcagcattcctgtgcttagggtacaccccagtgctgatacacctgcagtgaccacaagcttagatcacaacactcaatccccttttaatatgtggaaagccttctcaagaagggcaggtacaaataaatccagattacaaagattggaatacttaattcttcaatgcccaaacattgatgagtggccacaagcatcaacaacatccaagaaaacatgacttcactaaataaactaaattagacaccagtgaccaatcccacagtgatgaagatatcatctttcaaacagggaatcagaatcaccaccttgaggaagctcagcaacatagataaaaagataacagagaaggaattgagaattctttcagaaaattcaacaaaaagattgaaataatttgttttaaatcaagcaaaaattctggagctaaaaaattcaactgataaactgaaaaatgcatcagaatcaacagcaaattgaccaagctgaagaaagaatcagtgagtttgagtcaggctacatgaaaacagacagtcagagaagagaaaagaataaaaaagaagcacacctacaagatctagaaaatagcctcaaaacagcaaatctaagagttattacccttaaagaggacagacaaagagagacagagagaaatatcagggtagaaagttcattcaaagaaatgacagaaatttccaagcctggagacatgaatatccaagtacaagaaggtcataggacaccaaaaagattcaacctaaataagactatctcaaggtatacaataatgaaacccttaaagaacaaggataaagaatcctaaaagtagtaagagaaaataagcaaataacatagaaaggatctctggtatatctggcagcagacatcttcatggaaatctcacaggccaagagagtggaatgacattcgaagtgccaaagaaaaaagaaagtctaacctagaatatcatatctagcagaattattcttcaaacatgaaggagaaatactttcatagaaaaacaaaagctgagggatttcaccaacaccagacccaccttacaagaaatctaaagaaagctattcaatctgaaaaaaagggatgttaatgaaaaagaagtaatttgaagatataaaaattactcgtaaaagtacacagaaaaataaatacactaacactgtagttgctctaacagtatagttgcactaacagtgtcatataaaccacttgtatctttcataggaagactaaaagacaaatctatcaaaaataattacaactacattttaatagatacacagtataaaaagataaataaagagatcaaaaagtgaaagcagggggtagggaggagatggagttcaagtgtagtgttttaattttatctttgctttgcttttctttgtaatcacagttgtcaccattgtcaccatttttaaattggttaataaatgctatttgcaagcttcacggtaatggcaaagcaaaaacctgtaagagatacacacacacaaaaaaaggaaattaagacatactgtcagagggaatcacttttacacaaagaaagacaggaaggaaagaggaccaacaaaacaaccagaaaacaaacaaaatggcagtagtaagttcttacctatcaataacaacactgaaatttaaatggactgaattctccaatcaaaagacatacagtggctgaatggagtttttaaaacacccaactacatgctgcctgcaagaaactcatatcacctataaaggcacacatagactgaaaaagatattctatgcaaatggaaaccaaaaaagcaggagaagctacagttatcagataaaatagatttcaagacaaaaactgtaaaagagacaaaggaggtcattatacaatgataagggggtcaattcaacaaaagcatataacaattataaatatatatgtacccaacactggagcacccggatttataaagaaaatattactggagccaaagagagatggacctcaatacaatatctgggaatttcaacacgccactttcagtattggacagatgaccccaatagaaaatcaaagaaacactggacttaatctgtactgcacaccaaaaggacctaacagacatttacagaacattttatccaactgctgcagaatacccattcttctcctcagcatatggaacattctcaaggacagaccatatgttaggccacaaaacaagtctcaaaaattttttaaaaaatgaaatcatatcaactactttttccaaccacagtggaataaaactagaaatcaataacaaaggaaactttggaaactgtacaaacacatggaaattttaaaatatgctcctaaccgaccatgaggtcaatgaagaaattaagaaaatataaaaatgtattgaaacaaatgaaatacaacattccaaaaccaatggaatacagcaaaagcagtactaggagtgctagtttatagcaataaatgcctccgtcaaaaaataagaaaaacttcaaataaacaatctaacaatgcatccttgaagaactagaaaagcaagagcaaaccaaactcaaaaaccagtagaagaagtgaaagatcagagcagaagtgaatgaaattgagactttaaaaaaatacaaaagaacaaaatgaaaagttggttttttgaaaagataaacaaaattgacaaacctttagccagattaagaaaaaagatctttcctgtaggagtagctaaaaaggaaaaaagagagaagaaccaaacaaataaaaccagagatgaaaagggaggcattacaactgataccacaggacaactatgcatcaataaattggaaaacctagaagaaatggataaattcttagacatacaacctgtcaagattgaaacctgaagagatccaaaacctgaatagaccaataacaagtaatgagatagaaagctttttactactgcttctatcaaagaaaagcccaggacctaaaggcttcactgctgaattctaccaaacatttaaagaactatgatgcctgtaatcccagcactttggaaggccaaggtgggtggatcacttgagcccaggagttcaagaaccagcctgggcaacatggtgaaaccccatctctacaaaaactcaaaaattaatcagacacggtggtgtgcacctgtagtcatagcacccaggaagctgaggcaggaggattgcttgagcctgggaggcagaggttgcagatcacaccaagatcacacccctgcactccagcctaggtgatagagtaagaccctgtctccaaataaataaataaatacacacatacatactattcatactattctaaaaaattgggctaaaaaattgagcagaaggtaatacttccaaacccatactatgaggccagtattacttggatatcaaacccagacaaagatacaacagaaaaaagaaaactacaggccagtatctctgatgaatatagatgcaaaaatcctcagtgaaataccagcaaactgaattcaatagcacattaaaaaagtattcatcatgatcatgatcatgtgggattcatcccagggatgcaaggatagttaaacatatgcaaaaaataatgtgatatatcacattaagagaatcaaagacaaaaccacatgcttttaattgatttttttaaatatttaattttatttcaagtttggtgatacatgtgcaggacgtgcaggtttgttatataggtaaacatgtgccatggtggtttgctgcacctatcaacccattacctaggtattaagccccccatgcattagcattttatcctgatgctctccctccccccgcctcctccctgacaggccccagtgtatgttgttcccctccctgtgtccacgtgttctcattgttcagctccaacttatgagtgagaacatgcagtgcttgacattctgtttctgtgttagtttgctaaggataatggcttccagctctatccatgtccctggaaaaaacatgatctttcctttttatggctgtgtagtattccatggtgcatatgtaccacattttctttatccagactatcattgatgggcatttaggttggctccatgtctttgccattgtgaatagtgctgcaataaacatacacgtgaatgtatctttataatagaatgatttatattcctttgggtatatacccagtaatgaaattcctgggtcaaatggtcatatgataattttgatcgatgctgaaaaagcactcaaaattcaacatcccttcatttttaaaatactcaacaaattgggtatagaaggaacatacctcaaaatcataaagccacatatgacaaacccacagctaggatcatactgaatgggaaaactgaaagccttttctctaagatctggaacaagacaacgatgcccactttcaccatttttattcaacatggtgctggaagccctacccagaacaactagatgagagaaagaaataaagggtatccaaattggaaagaaagaagtcaaattatcattccttgcagacgatatagtcttatatttagaaaaacctaaagactccacaccaaaaatctattgaaactgaaaaataaattcagtaaagttgcaggatataaaaatcaacatacaaaaatcagtatcatttctatatgctaacagtaaacaatctgaaaaagaaaccaagaagctactcccatttacaatagctacaaataaaatacctaggaataaacttaaccaaaaaagtgaatgatgtccacaatgaaaactataaaatattaatgaaagaaattgaagagcacacaaaaaatggagacgttccatgttcatggactggaagaatcaatagtgttaaaatgtccatggtacccaaagcagtctacagattcaatgcaatccctatcaaaataccaatgacattcttcacagaaataaaaaaaaattctaaaatgtatatggaatcacaaatgacccagaacagccaatgccatcctaagcaaaaaagagcaaaactgaaggaattatgtaacctgacttcaaattatactacagagctatagtaaccaaaacagcatggtactggcataagaacatacacattgaccaacggaacagaatagaaaacccagaaataagtccatgcatttatagtcaactcattttcaacaaaggtgcaaagaatatacactagggacagtctcatcaataaatagtgtggggaaaactggatatccatacacgaaagaatgaaactagaccactatctcttgccatatgtagaaatccagtaaagatggattaagaacttaaatataagatctgaaactatgaaactactagaagaaaacattgggaacatgttctagaacattggtctgggcaaaggtttcttgggaagacctcaaaatcaggcaaccgaaacaaaaatggacaaatgagatcacatctcactaaaaagctttgcacagcaaaggaaataatcaacaaagtgaagagacaactcacagaataggagaagatatttacaaactacccatctgacaggtattaactgctagaatagataagaagctcaaacaactcaatagggaaaaaaattcaatttttttggacaaaaaatccaaacaggcatttcttttgttctctttgtttttatttggctcagaaggtactgaatagagatttcttaaaagaaaacaaacaaggccggccacggtggctcaagactgtaatcccagcactttgggaggctgaggtgggcagatcacctgaggttgggagttcaagaccagcttgaccaacacggaaaaaccccatctctactaaaaatacaaaattagccaggcatggtggtgcatgcctgtaattccagctactcgggaggctgaagcaggagaatcacttgaacccagaagcagacgttgtggcgaactgaggtcatgccattgcactccagcctgggcaacaagagtgaaactccatctcaaaaaaaaaaaagacaaatggccaacaggtatgtgaaaaaaatattcagcatcactaatcagagaaacacaaattaaaactacaatgagatatcatctcaccccatcaaaatggcttgcatcaaaaagacaagtaataactgttgctggtgaggatgtgtagaaaggggaaccctcatacaccattggtgggaatgcaaactcctacagccactatggagaacagtatggaggttcctcaaaaaactacaaatagaactaccatatgatccagcaatcccaccgctagatacatatccaaaagacaggaaaacagtatatcgaagagatatctgcactcccatgtttattgcaaccctattgacaacagctaacatatggaatcaacctaagtatccatcaacagatgaatggataaagaaaatgtggtacatatacacaatggaacattattcaatcatgaaaaagaataaaatccttcataaaaaagaataaaatcctatcatttacgaagaataaaatccttcataaaaaataataaaatcctgtcatttgcaacaacatggatggaactagaggacattaagtgaaataagccaggcacagaaagacaaatattatatgttctcattcacacttgggagtgaaaaaaaaaaattgaacccatggaaatagagtagaatggttggttaccagaagccgggaagggtagcagggaggggttgggtgagtggggattgttagtgggtacaaaaatacagttagaataattaagatctggtacttagtaatacaataggatgaccatagtcgataagttactgtacatttttaaataactgaaagtggccgggtgcagtggctcatgcctgtaatcccagcactttgggaggtcaaagtgggtggatcacatgaggccaggagtttgagaccagcctggccaacatggtgaaatcccatctctactaaaaatacaaaaaaaaaaaaaaattagctgggcgtggtggcgggcacgtgctactcgggaggctgaggcaggagaatcgcttgatactggaaggtagaggttgcagggagctgagatcatgccattgcactccagcctgggcaacgagagcaaaactccatctcaaaaataaaaaaaaaataaataaaaaactgaaagtgaaattgagatgttcctaacacaaagaaatgatcaacgcttgaggtgatgaataccccaattaccatgatttataacacaacatgtgcctctatcaaaacatcacatgtactccacatatataactattatgtacccataataattaaaaataaagaactttttaaaatacaaggtacaaactggaagaaaatagtttcaggccacacatctgacaaagcaccagtgtctagaatatatcaaatattctcaaaactcagtggaaaaataaacaacgcactcaattagaaaatggccagaagacttacacagatatttcatcaaacaagatattcagatgccaaatgagcacaagatgttcaacatcactagccatgagggtcatgtaaattaaaaccatactaagataccctacacacccatcagaatggctgaaataaaaaattatgacaataccaaagactggtaagtgtgtggaaaagctgaatcactcatacattgctgatgggaacataaaatggcagtttctttaaaaactaagcatgcaactactatatgacccattaattgcactcatatgtttttatttctctggaataaatgcctatgttcacacattgtctacacaaatgtttgtagcagttttattcctaataaccagaaacaatcggttgttctttgacaggtaaatggctaaactgtgatgtatccataccacggaatactgctcagcaacaataaggaataaactaccaatacatgcagcaacctggatgaatctccaaagaactatgcttagtgaaaagagccaattccaaaaggttacctacagtatgattaatttataacatttttgagatgacaaaattaaaagaacagggggaagattagtggttgccaaggggttaagaaagggatgggagtcggaggaagtgtgtgcaactatagaagggcaacaagaggaattcttgtggtgatggaagtgttctgtatcttgactgtagcaatgtcaatatctggttgtgatactgtactaaagttttgcaaaatgttaccaagggggaaaactaggtaaaagaatgcatgcaatctatgttatttcttacaactgcatgtgaatttataattacctcaagataaaaatttttctaaaaagagaaggccaggcatggtggctcatgcctgtaatccctgcactttgggaagccgaagcgggaggatcccttgagctcaggagttcaaggccagcctgggcaacatagcgagacctcgttctctactaaaaatcaaaaattagccaggtgcctgtagtcccagctactcaggaggctgaggcaagaggatgactcaagccagggagtcaaggctgcagtgagctatgattgcaccactgctctccaacctaggtgacagagtgagacctgatctcaaaaaaaaaaaaaaaagaaagaaagaaagaaaagaaaagaaaaataagtggtacatactcatcatagaaaattttcaaaatgtagattaggaagatctaatttggttattatacaaatagactaatagatatgacattaatatatttaggggcttttcaagtatattgactactttttatcacaataaaaatatatagttgattatattttttcccctacacatttgctcagagcctcctgagaggctctaaaggattacacagggatcatatgctcatggatggctgcctctgagccaaaccctagcacattgtggaattggtttcttcctgagtaccaatttggaacaattaattataatggtcatctcaagtactgtgctacaagaattatgaggcaatctctgaacccaaatcagaacactgtgattgactagcagtgtccatcagcagcatggggttcaggggtacagtgtcacctctgctggctggaagaaatgtttttaaaccaaccttgcaaactgcaagggacactattaataaaaccctctgtgtaaaggttcttgaaaaatcactcagtcttctgtcatatccaaatattatgttgcattttttatctagcaactattatatatggttgatttttctttttttagtccactaaattgtacatgtaaagaccaaacagcttcagatttttacagcgattagttctccatgcccagcctagaacacaatacttcttactctgctgagagaatgatcaaccaacaagcattatttaatgccgtgtatcagattatatattaggcaagcatttaatcaccaataaagtcattcagtctataaatctgaacactgctatatgccaacattaaatgggaatatgaggtatctgtactctgaaaactcagtctattgggaggatactgataactatgaaacaattataatagataagtgctcttctaggggcagacagaatgctgtaaggaacccctaacatatgactgtaaactggacttggggatcaggaagtcttcctggaagaggtagcatctcaagtgatacccaaagatcaagagggaagggagaacaatgaggcaaggtgagaagtatcccaatcaagaagtctcaaataccagagtccccggtaatcccagcactttgggaggccaaggtgggcagattacttgaggccaggagtttgagaccagcgtggccaacatggtgaaatgccgtctgtactaaaaatacaaaaattacccgggcatgggggcgcacgcttgtagtcccagctactctggaggctgaggcacgagaatcacttgaacctgggaggcggaggttgcagtgagccaagatctcgccactgcactccagcctgggcaacaaagtgagactctgtctcaaaggaaacaaacaaacaaacaaacagagtccaaaagagtcgaggttaggctgaaaagatatgcaagaactcaagtcattaagaccagaagtcatattctagaatttgaataatttcctgattgaaacattttaaactggagagtaaagattaccttaggatagggaacaagatgagaaacagttactgttgttagtagactgttgcaataatcaggtaactaatgacaattgcctgcacaagggcagaaggtagggaggcagagaaaatgaaatgttaccagaaattctaacttgatggttaaggattaaactaaagtacattcacatacatgccagcatcctaaagcctaatacttacacccattgctggtagtcttgtttctgccccattatctggagaccagaattcacccacacacgtatggaggctggcaaacatcacaaccacctccaggagatggtttgctgaggggccagtaaactagtgttgtggttgccttgagagaaatctagggaggttcacaacaactcccacactatagtagaaagctcttcaagacaggacaaactcacttttcagcagagaaacttgacctcatatgccattaagggtaggtgagtttgtcccacaaaataatgctgctatgtgccctaatgaaccatcgtttctagaaaaaaaagaaaaaatgattactaagagctgcacccaaagtaatgaggctagaatcaagctccctcccccttcatcagcactagcatgactgctggcatgtcgtacccaagttgggactcaaggtcacaactttttgtatccactcagagccactggcccaaagcacaagtctactcacaagagaaccaagctgtgactgctccaatgctaccagcttcctggatccagaatcacctaacagcagaaactcagcaagaaaaccaagatgtagggagaagatacaagcggctggagaagagcaaagccttaaaatggagatgagagaggagaagggagggataaagttttgaagtaggagaaaacaaaaagaacaagtcccctgctgagagcacaggagggtggagtaaaaagagattgagaagacagctactaaatggcttaagtggagattaacaggatctgccaaacaacagcaaggacctggctgagaacaaacagcatgagtaggaatgggtccagtcaacaaggttgtgggaattttctaacaactagagacacagaatttagaagagtcaaactatttttggctaataaagtgaagctggattgtagaatctcccttcctaattttaaaatctataaaatctaacaaagataaaattcaccagcagcagcctaatgggcatttcctcataccataaacattgaaaagtagcagccaaaacaattctcactgctatcaaatttgtagagacatggactgcagagtcatcaactttccctctagcaagtggtagagggtgaggggagaaagaatgaatggtggccgggcacggtggctcacgcctgaatcccaacactttgggaggccgagacaggaggattgcttgagctcaggagtttgtgaccagcctttacaaagatagggagaccccttctttacaaaaaataaacttttaaaagtttgtttcttgcaacaaactgaactaagaagtattaaaaacactgtacgtttatttaaaccattacttttcataattcattgagtcttattagaggtcaacatcttcattctgttaccttactgggtacattcactgatgttacataaaacttcatgtaaaattaaataagaattaaaagtacagctaagaacagtgatgatctgtatgagaggatttaccattgtgtaccctagtccctaatatggtcattttttgtttcatgggcctctcaaccttaaattcatttttattttagagagaataaaggcactcctctgagctcttgcccaccacgtgcccagtcgctgcgtcatcggtgtgtgttgacccagtggtacctgtccagccggtgcatagcaggcctgtaacacttaggatgcttctgcgagccatggtaagtgtttcccaggaggccaacacggccgtccaccacattctttttgcgggggatttgtaaccaagattgaaagggctgtttcaagttttcaacctggaaaaaaaaagtataaagatctctaataagctagctgtaaggactaaatatgaacccataattcaaaagtcaggcacttcaaaagcatagggagcacaaatgaatagaattgaaagtgcataaccatctttgaaaaaaatttctagcacttggcgggaacataaatcactttatactgtacctttttaaaaagttaattaattcaactaaaaactttttaatatgcttattcaagtttatgtttattcttgaattgtccctcttccatccctacctcaccactgccaacccaatccaaaactgcatgttcatgatctctggggccacagcctagaaatcttcattttaaacacctaagatgatggatacagatgttttacagatcacactttgaaaagacattgctgtaaaagaatatagctgattacaggtctgatccccaaatggaagaagacctttctaaaaataaaaatagaattaagggcaaatactgtaaatcctcactcaacaacctcgataggttattggaaactaattttaagctaaatgacatatagcaggtctttgaataacatagtttggttataagactgaggaaaaaaatggctttgtcatacatcattttacttaaagtcactgtttccaagaaactatcaatgacacacatagtttaaaaaactagggacaaaacatttgccagaaatatgtcaaggggttaaaatcgttctggcatataaagaacctacaataatacattagaacttcaaataatgaatggctgaataagagaaaatttgtagggcagtaggtgctaaaacatttgg

SEQ ID NO: 15141 - DNA, 34534 bp, Human
ggagacggaggttgcagtgagccgagatagcaccagtgtactccactctgggcgacagagcaagactcagtcttaaaaaaaaaaaaaaagaaatcttgcttactccaaggtcagaaattttctgtaagatattgctatgaaagatattgctttacttttcttatttaggtcctgggttcatctcaaattaatttcggtatatcagacataaggtggagaatgactgtttttttttttttttttttttttttacttagggatgttggattgacccagcaccaggaactaaaaagaccatcctttctcctcttaactgcaggggcacttttgtcgttaattagttgaccacatatgtgtgggcctgtttctgggccctattctgtttcatctgtctatccttgcacctttaaaataagtcttgatatttgatcatgtaagtcctgaggaagaggatttttgttttttttttttcaattggagatatttgagcaaggatccagttgagagtgaggagttgaataaaaaagagagagaagccaagcatggtggctcatgcttttaatcccagctacctgggaggctgaggtgggaggatggcttgagcccaggagttcaagtccagcttcaaccagggggttgagcaagatcctgtctctatattagaaagaggtcgtgcggtgactcatgcctgtaatcccagcactttgggaggccaaggcgggcacatcacttgtggtcaggagttcgagaccagcctgcctacatggtgaaacctcatttctactaaaaatacaaaaattagctgggcatggaggtgggcacctataatcccagctactcaggaggccgaggcaggaaaatcacttgagctaggagacagaggttgcagtgagccgagatcgcaccactgcactccagcctgggcgacagagtaagattccatctcaaaaaaaaaaaaaagtgagagagagagggagaagataatctgcacttttcttagaagacagtaggagctgggatccaggtgtttggggaaggattggccctaggtactcatccactaattcattcaacattgatgtgtcagatagaacatttatgtgccagacacaagtatacagcagtcctgggatagatgaggtccttgttctcatggagctcccattgtagcattgagagaaaggtaataagtaaactgataactcaggcagcagtaaatgccatgaagaacaggaacaggatattgtgatagagagtaatggaagactgccctaactgggagttaagatttgaagatggagccagcctttatgagcagagtgaagagcatcccagacatagggaacacacaatgcaaaggcccttggagtagtgagagcttgtagtgctcgtgggaaaaacaaaagaccagtgtagagccgggtgcggtggctcatgcctgtaatcccagcactttgggaggctgaggcgagcagatcacctgaggttaggagtctgagaccagcctgaccgacatggagaaacccggtctctactaaaagtacaaaattagccaggcatggtggggcatgcctgtaatcccagctactcaggaggctgaggcaggagaatcgcttggacctgggaggcggaggttgtggtgagctgagatcgcaccactgcactccagcctgggcaataagagtgaaactccgtctcaaacaaacaaacaaaacaaaacaaaacaaaacaaaacaaaaaaaccagtgtaggggaacacaatagaaaagggggtgaggagcagggtaaataaatgatatcagagaggtagagaacagacttgcccagggagggtatcctttagggttgggcggaatgtgaatttttacatgcatgtgagttgggtagattacttgtgggtggtgggaccgtgggtatgtgctggagaaggggggattcattttgtctcctttttgaagctgctctcatacctaccctttctccctgcagcctcctgaatgatgccagcccagtatgctctaacctccagcctggttctcctggtgctgctgagcacagccagagcaggccccttctcttcacggtccaatgtgacactgccagccccccggccccctccccagccagggggccacacagtgggggctggagtgggaagcccctcttctcagctttacgagcacacagtggaaggaggggagaagcaggtggtattcacccaccgcattaacctgcccccttccactggctgtggctgtcccccaggcaccgagcccccagtccttgcttcagaggtacaggccctgagggtccgtctagagatcctggaggagttggtgaaggggctcaaggaacagtgcactgggggatgttgtcctgcctctgcccaagctggcacaggtgagcaggtgatcacagaagagggtggagaggtggggtggggtgggcattgctagtccataaaggtccttggtatgaattagaagaaggcactccttcctcaccatgaggggtgtggatgcagcccagaacacaacttggagagcagagctgggctacatgtcaaccaaagcatatgcgagggccctgagaggctgcatacattacacatactagcaactgggagcagacatggccttatgagatgaggctagcctggctaggggcctgcacataggagcactacataggctcagcctctctcccaggagagagactgagacttgcctctcccctcctactccaggtcagacagatgtgcggaccctctgcagtctccatggtgtgtttgatctgagccgctgcacctgttcctgtgagccaggctggggtgggcccacctgctcagaccccacagatgctgagatccctccctcttccccaccctcagcctcggggtcctgcccagatgactgcaatgatcagggtcgctgtgtccgtggtcgttgcgtgtgctttcccggctacactggccccagctgtggctggccatcctgtcccggggactgccaaggccgtgggcgctgcgtgcagggcgtgtgtgtgtgccgggcaggcttctcaggccccgactgcagccagcgctcctgccctcgaggttgcagccagaggggacgctgtgagggtgggcgctgcgtgtgtgacccaggctacactggtgacgactgtggcatgaggagctgccctcgcggttgcagtcagagggggcgctgtgagaatgggcgctgcgtgtgtaaccccggctacactggcgaggactgtggggtgaggagctgccctcggggctgcagccagcggggacgctgcaaggacgggcgctgcgtgtgtgaccccggctacactggcgaggactgtggtacgcggagctgcccctgggactgtggcgagggcgggcgctgcgtggacggccgctgcgtgtgctggcccgggtacacaggcgaggactgcagcacgcggacatgtccgagggactgccggggccgcgggcgctgcgaggacggcgaatgcatttgcgacacgggctacagcggggacgactgcggcgtgcgcagctgccctggcgactgcaaccaaaggggccgctgcgaggacggccgctgcgtgtgctggccggggtacactggaaccgattgcggctcgcgcgcctgcccacgcgactgtagaggtcgcgggcgctgcgagaacggcgtgtgtgtttgcaatgcgggctacagcggcgaggactgcggtgtgcgcagctgtcctggggactgtcgtggccggggccgctgtgagagtggccgctgcatgtgttggccggggtacacaggccgggactgcggcacgcgcgcctgtcctggcgactgtcgcgggcgcgggcgctgcgtggatggccgctgcgtgtgcaacccgggcttcaccggtgaggactgtgggagccgtcgctgtcccggggactgccgtgggcacggcctttgcgaggatggcgtgtgcgtgtgtgacgcaggctactcaggggaagactgcagcacgcgcagctgccccgggggctgccgaggccgcggccagtgcctagatgggcggtgtgtgtgcgaggacggctactctggcgaggattgcggtgtgaggcagtgcccgaatgactgcagccagcacggcgtgtgccaggacggtgtgtgcatctgttgggaaggctacgtgagtgaggactgcagcatccgcacctgcccctccaactgccacgggaggggccgctgtgaggaagggcgctgcctgtgcgacccaggctacaccggccctacctgtgccacccgcatgtgcccggctgactgccggggacgtgggcggtgtgtgcaaggagtgtgcctgtgccacgtgggctatggcggtgaggactgcgggcaggaagagcctccagccagcgcctgccctggaggctgcgggccccgggaactgtgccgggcaggccagtgtgtgtgtgtagagggcttccgaggccctgactgtgccatccagacatgcccaggggactgccgtggccgaggagagtgtcacgatggcagctgtgtctgcaaagatgggtatgctggcgaagactgcggagaaggtgagcaggcagccttccccagtgtactctgggactgtgattctgtgaacaggagccatggggaagacctgagcctgaggaagagtggagggagagcatgtcattccaaggagccagtgcccaccaggggcagcagaaccacaggggtggggctttccagtgggcaggactggccttcagatctctgaggagcaggttggggcccatttagttgcatttagggagattctgtgctcctgaagatggagagaaggtgaaggcgatccaagccccgttcagccctctgtcagctattctccactagcagagaggagtgggagttaggatgggcctcttcgatgtccctgagtaaaaggggctgtgggtgggggtggttgccttgtgctaaccagctttccctaacccattctcttgggcagaggtgccaaccattgagggcatgaggatgcatctcttggaggagacaacagttcggacagagtggaccccggctcctggccccgtggatgcctatgaaattcagttcatccccacggtgagagagatgccaggctccaggaggggactgagtgggcaggacaggggggcagggctcacctcctggaggaagttccaggtgatcattggttgagtccagatggctgggtacctgaagctgctgtaaaggctttcttagcctgcttgacactgggcactgaggcctctgcagcatctccagcaagcattggtcccacacagttggaacacctggtaacagagagctcagtacttcctgaggctgtccagtccattgttggtcatcactgttagctgttatcattgttgcagaatccgtctgcccctattctagcacctgtccgttggccctagctgggtattcatcagcagctggaatgttttttgctttccctgtgtcctacaccacaggccttcaggtatttggagacaccagcctgatgtcttcattcctcaggcaaaacctcccagtttcttcgccccttttccctaagtctttattctctgaatcctttaccttcctgtgattcttgcttttttcatgtgcccccaaaatgtggggacagagaggggcccactgacttactctgaatttatggacacttttctcagagctggcgtatagcaatttgtagtcacacaagcaggcagctgttttggtcatatttggttttttaagtaacttttaattataaaagtaatataggccccgtgcagaaaacttagaaaatacagattagcagggaaaaaagatggaaggaaagaagacaacattcaactatatacacttttttttttttcacctaaatataggcctttgcatttggccctgttcaatgttatcttttttggtttgggccaagctgtctaggctgttgcaataattttgagtctgtgaacttcatctcccacctccttgtcatcagtacatgcaaaccagttttttctctgtctccctccaacttgctctttttttttttttttttttttttttttttgagacagagagtctcactctgtggcccaggctcgagtgcagtggtgccatctcagctcactgcaacctctgcatcccaggcttaggtcatcctcttacctcagcctcccaagtagctgggactacaggtgtgcaccaccttagcctgctaatgtttgtatttttagtagagacggggtttctccatgttgcatgcccaggctggtcctgaactcctgggctcaagtgatctgcccgcctcagcctcccaaagtgctgggattacaggcatgagccaccactcctggccatccaacttgctcttaaaacattagagggaacaccctaaggacaaagccttgtggtcacttatttggggcctccctttgtgcagactgggcttttaagatatggtcgtttccccagctgcaaatcttctgacatttctaccatccaactcatgttttcctgcatcatcccacaaatgccatatggggtgtgggccatgtcatcctcatcttcatcagcttagccaggactctgtaaaaataaacaactccctgggcctaaagcctcggaaggcactaggacagaaggggacagctcagaggaactgtcatcctcactccactttgctttgtcttgtcattatgctcctcaggccagccccctactatgttctgcctctcctcactctccagccaaagcagaagcagaaatctcaacttcgtggcgcaaccaagatagcttgaattttttcttctgtttaaacatctttttttgttgttgttataaaaatactttaatcacgagacaagaatttggcaactagagaaaagaaaaacaattcctggctgctcctcactaaaacaagcactgctaacattttaaagtgtttctcccactctcttcttctctgtatatattatttacatagctctaatcttgaaagggtgggacttcgaaaaggaagtttcttaagaaatttcagggaaagaagaattaaaataaacacttgagataagaggagcttttagggcagcagttgtctcctgctctgagtaaataaatacaaaccgatccttggtgttgtcaagggcgccgctttccagttgaagccctagactttctccctcactcagagccaggatggtggtgccaagttggcctgtgccaggcttggccatgttcttagctcatccattctgctctcggtatgggcatctgtcacattctgggtcttctctgagcctgggtgtggaaaacactcctgtaaaattggtccccagacactcctcttgggcctgggctacccaccctcagaccatgctttctgctgtctgtagctggtccctggcatcgtaccttctgccttggcaagtgccatctatttcttttcttttctttctttcttttttttttttttgagacagagttttgctcttgttgctcaggctggagtgcaatggcgcaatctcggctcactgcaacctctgcttcccaggttcaaacgattctcctgcctcagcctcccaagtagctgggattacagacacctgccacaatgcccagctaccctttgtccatttctgtgggtacagagtatattcaatagctgtctgtcctctggctgctgctgtcatcctagaagcctatctctacctcttaccttccctcttcccagaagcacttctctctcaaagcccaaactctgctattccagatcaagggacatacctagttattggaattatttttcagaatgcagaagaagaaagtttctcctctccctgtatatgtggcactgttactctgactcagtggttctcaaagtgtgttccctggacctgcagcatcagcatcacctgggagtatgttaggcatgcaaattgtcagactcccccactagatctactgagtcagaaagtctgggcacagagcccagtaacctgtattgcaacaagccctccaggtgattctgatgcccctccagcctgaggccccctaagtgaaggaatgttgctattttgcaaagtgctagctccactatgaatgtgagagaaagcatggggaaactgagggagatgagttcctgaatgagaaagaggttcagatattccttgtctgggtgtgtcctgcagcctggaaatcagggctaggctaagtgttcactgggactcaaaacctcacagcctcagagaagtttttgcttgggtctagtctaaaaacagcaatgagggtgagataagctccaaggaccagccaaggtagagttcatctggagccacgaggttaatattgagataaactctaaaacttcccaagaacaaaatcagtgaagcaggccaggcgcagtggctcatgcctgtaatcccagcactttgggaggccaaagtgggtggatcatctgaggtcaggagtttgagaacagcctgaccaacatagtgaaaccccatctctactaaaaatacaaaattagctgagcatggtggtgtatgcctgtaatcccagctacttgggaggctaaggaagaatcccttgaatcttggaggcggaggttgtagtgagctgagatcgtgccattgcactccagcctgggagacaagagcgaaattccgtctcaaaaaaaaaaaaaatcagtgaagcagccaagctttaccaaggggcagagccagctgccagcatctgtttagaaagactgcttcagggccaggtgtggtggctcacgcctgtaatcccagcactttgggaggctgaggtgggtggatcacctgaggtcgggagttcgagaccagcctgaccaacatggagaaaccccgtctctactaaaaatacaaaattagccggacatggtggcgcatgcctgtaatcccagctactcgggaggctgaggcaggagaatcgcttgaacccgggaggcggagctcgcgatgagctgagatcgcgccattgcactccagcctgggcaacaagagcaaaactccctctcaaaaaaagaaaaaagaaagcctgcttcagaccagtaagatggtgctaggagacgtaggagacatgggttaggttgatggactttcaggggactgttcccagatggatctcaggaggaaccaagaagtgtctaaaggatatatatagggagaaggagaactctggggataggcttgcctcactgaaagaaccagacatcatcagggagcatccaaggtgtgtgtattgcggctgtggggatggggtgggtgtggataaagagaaagagacatacacacacacagagaaaatgaacaaataaattctgggaagggtaaggatttcatgggtcttgagttgaggccaacccaaggcttcctaggctggggtattctaaggcagggtgaataggagagggctggaggtcctatgtgcccaggaaaacttttcaacccagaaaactgacaaagctttacttcatcctcaacccagaaatctctacgtggccttctcatctggttttatacttcggtatttactatgttgatttccccacagttctcttggtttaggagagtaccttttgaaatttccaatcctacttggctgaatggaggtgtccccatcacagccaacatagctaggcagaacacagcatccttagcggctgtcctagctggacagcacagcaaaatgtggggctgttagaatgctcacagatgtacagttcctcctgtttccccagtggtgggcattccaggagaccctgcctggagcagggtccagtagattccctttggaggcaccacacataatcataattccttaaatgtacacttgtaggagtgttgttttctcacaagcatttgctaagcatagagattgttgtaagtatctcatatattcaagatgtggccatacatttagctattagagtctcagctacctgaggacagggaccatatattttatttttgtgtctccaatgcccagcatgatgccaggtacaaaatcaacaatcaggaaacatatttgtggaactttgagcaggtggttcttgttttgaggagcctacaacccgggtgaagagacaagaaaagtccctcaagggaaaggttgtgatgcgggtcccactcctgttacacagccatgagcaggcatctacgaggaggttcagggtgaggcagaccctttaaggagaaagtgcaacttgaaggggcatccttgatctacttcatttgttctgacaggaccaagcttaggaaaaggctcctcatgcccaggtagtcagagttgccagggcaaagctggagggagagtcctggtgcatgttgggtggaattctggcagatgaacacggggtgcccatgagaggggactctgacagataaatagggggtgcccatgagaggggactctgggatcacactgctagggcctaaattcttgccattttcttggtgttggtgacgttggcaagatacttgtccttctgtgtctcagtttccttatctgtaaaatgggactaataggacctgtttcgtagggttgttgtgagaattaagtgagttcatgtgtgtacctcgcctagaacagtggctcacaaggagttagcgctctcagcatgtttgctccccagcttgtacagggtcaagttccacacagtaccatgctgacactgtttagaattggagaaagaagagataagggggattgagcagcagaggcaagagtgccagcccctgagccacctggtgctctctctcacagacagagggggcgagccccccattcacagcacgggttccaagctctgcctcagcctatgaccagagaggactggcccctggacaggagtaccaggtcactgtccgagcccttcgagggaccagctggggccttcctgcctccaagaccatcaccaccagtgagagctggggctgtggggaggggtgtcctgagtggagatctggactagagagggaatctgccctccgggagggcagaaggaaggggctggatgggggctaggctcttggaaggaaagatgatgattgaagaaccagacacccacctgagtcctcctctttaacctggctagtgatcgatgggccccaggacctccgagtggtggctgtgacaccgacaacactggagcttggctggctgcgtccccaggctgaggtggaccgatttgtggtgtcctacgtcagtgccggcaaccagagggtgaggctggaagtgccccctgaagcagacgggacgctgctgactgacctgatgccaggcgtagaatatgtggtgactgtcacagcggagcggggccgggcagtcagctacccagctgctgtcagggccaacacaggtatggctggccagaggttagggaagggccctggtttcccagccttggatcctcctcctcaggagcccaggctcagggctcacagactcctctgaatgcttctggcaggtgtgtggcagtctcgaggcacctgctgggggccttgctctgtcctgaggccactggggagacagagccctcagatgcctggagtcctgtaggaaggttacaggttagcctatgaaaggaatggccccagggagagaagtgaataggagatgctgcctgatccagtcagttaagggaggttcttttttaaatttaggtaccgggacaggccttgtgctgatagatcttgtgggactggaattaggcagattagagatcatcagtcctgttgacttttggattgggattgctgggaggtgggtctcacagcagtgattttccactaaacctcgaggtttcttaacagatacctggatatttttcttttcctgtgacagggggacacccacctcgctgtagctcatgttctcttccccgactcccctttctctccttcagctacagggccccacccacgggcttctctcttctttctagggcaccaacagtggtgggcttggaggggaatgggggggctgcgggacactgaccgatttccctccgttctctttccaggtggggctggggcacagggaagaggcctctggctctggtgggagggatcgagggaggggctgccgcgggaaggagtgccgggagggagctgccactgacctgttctccccttttttgcccctggcagcaccaggccactacagttacccggaggtgcgccccccagccccgccccccaagtcccggccccggccagccccagccccgcggcccccacggcccccttggccctcgaggccagcagaggaaagggaggaggagtccccgcccaggccaagcctgtcccagcccccacggcggccttggggcaacctgacggccgagctgagccgtttccgcggcacggtgcaggacctggagcgccacctgcgggctcacggctacccactgcgggccaaccagacttacacgtcggtggcgcgccacatccatgaatacttgcagcggcgtctgttggccgccgccccagccggctcccccgcacccccgccccgccacccccgccccaccgccagccctgatcccggcaccaggaaacgggactccaaccagggaatctacggcctctcgcctgaaggcgtcgaccgggtggctgcgtcccgccaccccaagccagaggtgctgggcagttccgccgatggcgcgcttctcgtgtctctcgacgggctccgcggccagttcgagcgcgtggtgctgcgctggcggcctcagccgcctgcagagggccccggcggtgagctgactgtgccgggcaccacgcgcaccgtcagcctgcccgacctcaggcccggcaccacctaccacgtggaggtccacggggtgcgggcggggcagacctccaagtcctacgccttcatcaccaccacaggtagtgtgggctggggccacgggacacctatcccttgtccagcctcacctgccgttggagcctgcattcatgaattcctcccactgccaccccccactgcccccttctaccttcaggccctacctggccggggctccagggggcccccaggacaaagcacgagtccattgtccctagaagacgtccccaccccagggtcctggcatccatcctgtggatgcctaaggtcaaggcagcgccttctttggggtttcccgggacacttccaggattgttattttaggcaatagagggtgatgtggttggggcacctgcaaagattcactggagcagtttgagtgggctgggaattgaaaacagtgattcccgttctgactcactgtggtgagagtggctgaagactgtggttagtggttactgttttccacaatttggccttgaccttgaagggacacatcagaactgcgtgggggtggcctgggtgccatcaggcagcaactgtatattggggaggtgaaaccactgcttcttaagctggcttttcagaccccctggctcactttatgctggtctctcccacaggaacgatgtctgggcttggggaaagggcaccctgtggctgctgtggggagggtggtggacctcttcttcccccatagggcccagatgccacctgacctggatgtccacccccacaccctctctctcttcccactgcccactctcctcttgcatcctccctctctaacaccactgtctttcttccaggcttctcactgcagcactaatggaagccacctgaccaccacccagtgggggggatgtatgtggggagggacatggaagtctccgggggctggaggtcatggaagccttgtggggtgaaggatagcaggctttattttacctattacctgcctgaagcacaggcccgtctgctcaggaatgtggtagatgggggtgtttggaggattggctgacctttgggaggagggagtggcccaggtgagggaaccagaagtagaagtagaacaaggctcttagaggctggagggcagaacctggggactggggattcctttctagttctcatactggactctcctctttttctcaccctgccccttcccagggtcctcacccttgggcctcttggggactaccgatgagcctcctccctcaggcccctcgacgacgcaaggggcccaggctcctctcctgcagcagcgcccccaggagctgggagagttgagggtgctgggcagagatgagacagggcgcctccgtgtggtctggaccgcccagcctgacacctttgcctacttccaactgcgcatgcgggtgcccgaggggccgggggcacatgaggaagtgctgccaggggacgtccgccaggctctggtgcctccaccccctcctggaaccccgtatgagctgtcacttcatggggtccctcctgggggcaagccctctgaccccatcatctaccaaggcattatgggtacatcttggactctgctcagatcaatatcctgagattgggggaggagctggggttattgggacttcagaggtaggatggatattgaggggccagtgaagggcagggctgatgtttggggctggatagaggagaaaaggagagaaaaggaattgcaggttcagcaggaagatggatcgagggggatcttaaaacaatgataaggatgggtggggagaggggaaagaggcagaggtaaaaaggccgagggtgggacagagattccaggagagaggctgaaggtccctggccctccacctgcagctttccttgccctgtcccctgcccccactcttcggttgctcctctgcccttccctgccctataaatctttcagggtgggcatgggaaggcctctggacactgaccctcagcccccaatacctcgtccctgggagcctggtttgcagtggacagcagtccatggtcccatcagccagtttctgctgggggtgaaggctccttggggcagggggctccacagccatcaggacttcagacatggatgaggtttgcaggaccagtgaaagacaggtcctggggtacctggctttcacatcccctctttgttcctctctgtgggaccagggtggctgactcatcccccagctccaggtcaagctcaccactggaagagagggtggtaagagagacagcagctcaggtgggcagaggagctttcagactgctctgatgctgcagcagggaggcttgaaactctcattcagaaccagggggacctgaaacccccgcaaagatcctggtgtgcagagagaccaagaccttgtgagggatggagaaactgtcacaagggaagaagcagagattgagagggaaatgcccctcttccagaagagctagtcactgaggggtgggcagatagagtcttccggggagggatctatccaggatggagtgaggtgggcaggggagagggaaggagacacagacaagagaacggttgagtccactatgctttgcttttgcctctcaaactccagacaaggatgaggagaagcctgggaagtcctcaggcccaccacgcctgggtgagctgacggtgacagacaggacctccgactccttgctcctgcgctggacggtccccgagggcgagtttgactccttcgtgatccagtacaaagacagggacgggcagccccaggtggtgcccgtggaaggaccccagcgctcggccgtcatcacctccctggatcctggccgcaagtacaaatttgtcctgtatgggtttgttggcaagaagaggcatggtccgctggtggctgaagccaagatctgtgagtgacagcagtaacaccctgccctctgtactgccctgaagaggttttctcagtgctttgggaacctgctttgggagctccgggaaggcttcctggaggcagtggtgcatgagctgaattctgaagggaaagtagtggtggggcaggcaaagagtttgagaagctcagtgcagcctgagggagtcacggtgagtaaggtggggagagcatggccagtaagagaatcactgttacagtttcctctggctggagaacagggcatgtggggggtgccaaagggcctggtctcagggcttcctgtgctgtgctgaggggcttgggcctcattcgaaggcccctagagggcctctgaagggtaaagtgggagagtgatgagactagatatttatcttgcaaataaccgggtggctgctgagactagctggagaagtgagttaagagctggtaaaggctagcagggttgatcctgcctataatcccagcaccttgggaggccaaggcaggaggatcgcttgaggctaggagtttgagaccaacctggcaacatagtgagaccccccatctctactataacaaaagatattagccaggcgtggtggtgcgtgcctgtagtcccagctacttgagaggcttgaggtgggaggatcgcttgagcccaggagaccgaggctgcagagagccatgattgtgccactgtactccagcctgggtgctatccacactctgcacagagcaacaccctgtctcaaaaaaaagaaaaatgatgatgggtcagctgggatggtggcagtggggctggatgggggaggcgaaggaaagcaaggtgtaccaggcagcccccagggttctggatgagacagtcccattccctgaggcagggagcagcagaggtggggaacaacgccttagataaacttagatcaatatctaagagacacttacataaataccttttgtgcatttattgagagtcagttgtgatcaagatgttctctaagtggatcatcacaccccataaagcacacctgggaggcatgcctactttataggtcaggagaattgaggcaccagagtagtcgtgtggggttggggaagagacagggccactggaaccctgtcgacagcctacactcacagcggaggcagaggaagaagagcccacagggtagcttgcggagtgacttgcagggaggggcagaaccagggagggtgctgtctggactccaggaaggagggtgcggttggacttgtcagattccggaacagtgattcaagggctacggagcgtccacagaatttagcaatggcaaggccacccctggcctgcatgagagctgctgcctggtggaggggtggagctggatcgggagggtggtggaggtgaggacatggctgcaatcagtgtagacatcactttctggaatctgggctgggaatgagagcaaagagggaagatggaggctagagagagatgcacacagagtgggggtgaggaggggtgtgacagtagcttgttgaaatgctgatggcacagctgctggggagtgaagggtcagtgctgcaggcgagggagtccatccatgggtcaaagttcccaaagaggaggagaggcctgcagcatagatgagggaggctgtcccacattaaaacgcttcaaggattgtgctctcctctcttggagaagaagccagctagtagttaggcttggaagcagtggaggttgtactgggaagatttccctggctatggagatgtgaaagggcctggctgggctcccctctttctgaagctccctgctgctctggtttgtggttggaggcagagccacactagtccacgcagtgcttccatgccgtttgaaagaaggcacccattccttaaagtggacaccactcctcaccagggcacacagctcggcaagcagagtgctggctggatttcagtccctctgtactccctcagcaaatgcacttttgtgcagtgaacaacctgcacagcctcacacagcattcctatgtgggatttggcttccccattctccttggacctaagtctctcccttctctctacccactcttcctagtgcctcagagtgacccaagtccagggactccaccccgcctgggaaacctgtgggtgacagaccctaccccagattcactgcacctctcctggactgtccctgagggccagtttgacaccttcatggtccagtacagggacagggatggacggccccaggtggtacctgtggaagggcccgagcgttcatttgttgtctcctcactggaccctgaccacaagtacagattcactctgtttggaattgcgaacaagaagcggtatggccccctcacggccgatggcaccactggtgagtagcagccacctcagcccccatgtgaccccttctcagccccatgcacacttcccttcagcccaaaaccagctggggtcccccagcaagacagctgactccagcttcccggccccactccagggctgaggggcagccagactcccccgcactgctgggccccttccatcccaagcagcagctccccgtggcccagaaggtgtgtcataccctggctgtgtcaggcttcccagaagtttagcactcgaattaatggactagtgaccccccaccccccataggtgtgacatcccgtcgaaaccccaagccccagtcccaggctgccagttcagcacctggctggatctccttgtttacagctccagagaggaaagaggagcccccccgccctgagttcctggagcagcccctcctgggggaactgacagtgaccggcgtgaccccagactccttgcgtctctcatggacagtggcccagggccccttcgactcattcatggtccagtacaaggatgcacaggggcagccccaggcagtgcctgttgcgggggatgagaatgaggttactgtccccggcctggatcccgaccggaagtataagatgaacctctacgggcttcgtggcaggcagcgtgtggggcccgagtctgtggtggccaagactggtgagtcatggctgccaggcctccctcccctgctagccccatcctgtgagcgggacttggctggggctccttccagcctccctccatcttcgccttctcagctcattttgccaaagcctccacccacttcctcccgcactgctctcctgtcctctgcatgccaggtccccctcatccagcctccacctcctcatctcttcctcagcctcacttcttcatctccaagggcaggtcctattttcccccattccaaacacctggactcatccttccacctggggctgtcctccccacagatgtcctcaccattcggtcactgtgttctcacccctcagtttttactgggctccttcatggtctggtttgggccatggtcacttctgggcttctgtcacctgctgcccacaacctcctgccatttctgctgtgttcagaggtggcagatccaagtgacaagagcaccacgtttctctagcctttttgcagcatgaagaggactcctctcagctcccgactccttgactcccagcccccttggaacagggcaaagggattgtgttcagcccagcatcccagcctgttcctccatgtccccagcctttccctgtccagtgccattcccctggcctgtgaattatttgatgagagatagtgtggatagtggttaggagcaaagactccggagccaactgcccgagtctcactaccagccttgcaacttacttcctgtaggaccttgtgcaaattgcttaacctctctgtgcctcagctttcccttctgtcaggtggctggatttcagtccctctgcacagagctgttggaattacatgagttaatatatgtataacacttagaaaggccaggcacagtggctcatgcctgtaatcccagcattttgggaggccaaggcgggtggatcacgaggtcaggagatcgagaccatcctggctaacacggtgaaaccgtgtctccactaaaaatacaaaaaattagccaggcatggtggcaggtgcctgtagtcccagctactcaagaggatgaggcaggagaatggcgtgaacccgggaggcggagcttgcagtgagccgagatcgcgccactgcattccagcctgggcgacagagtgagactccatctcaaaaaaaaaacaaaaacaaaaacaaaaaaagcccacacacttagaatagtgcttggagcagcaaagcattttcagagtgagctgcaatttctccctgactctctcacttcccagtaatcttttttgctccccacctccctcccttcctctgggttgtcattcttgccaattctttcctcaatctgctatcccaaagtagtcccccatgtagcaggtcacagaagggctggtttcccttgtgccacagtctccccactccatggagcctcagcagagacctaactgtagggggcgggtaggtgcccacagggctgtgattccagagccagccagggaaggacatgtctctccttggatcccactcaccccagaatttttctcccactcatgcctggagccctgccttagcaattcattccttggggttaaaggggagggaggggcagggctgcctggggaggccacagcaagagcacattccatggtcagatcctcatatgaggggtggggcagccagagtgccctggggagggcacaggtaggaagaggcctcactgccctcctcactgtctgaggtcagcactgtcagtgaacgtggtttggaagaaccctcagaggcttcctctcttcccatctcagctcctttctcagacacgaagggagacccctcacccccacagaacccaccagagcaggatggggcaagggctgtctcagccttctccatccgtgagtgaccgaatggcaaatacaaaggctacagagcccctgagcccacagcgtaagggcatttccatggctgtcatctgtgggcagcagcagcaaagccagcagccctttatgcctctatctcttctctcagctcctcaggaggatgtggacgagacccccagccccacagaactgggcacggaggccccggagtcccccgaggagccgctcctgggggagctgacagtgacaggatcctcccctgattcgctgagcctcttctggaccgtcccccagggcagcttcgactctttcaccgtgcagtacaaggacagggatgggcggccccgggcggtgcgtgttgggggcaaggagagtgaggtcaccgtgggaggcctagagcccgggcacaagtacaagatgcacctgtacggcctccacgaggggcagcgcgtgggcccggtgtccgccgtgggcgtgacaggtgagtgaggggcaggggcctgctttggttccctcccactgctggctcccagcttccctgtagccagttgctctccttgctccagtggaaccttgaggctgcctgccaggggaagacctagaaagagcatgtcactggggactggcgtaccaccagctttcatggccctgagcaagttttaaactttctgcacctctgtttccttgtccgtaaaatggggacacctacctcacagagttattgtgagggttaagtgagttaacagatgtaaagcatcaagaatgggcctggcaaaagtaaatatgctgccagtgtctgctgtgagaattgttataaatattcttactctgaggtctgctttgtcccctttggctggttcagttacttggtcagaatgcacatgaatctaaggccataccaccctgaaggtgtcctatcatctcctctgatctcagaagctaagcagggtcaggtctggttagtacttggatgggagaatgcgcgtgagacattggcctcttcatcagtacagcttgaagcaagctttcttttctttcttgtctttttttttttttttttttttttgagacagagtctcactctgttgcccagcctggagtgcagtggtgcgatctcagctcactgcaacctctgcctcccaagttcaagtgattctcctgcctcagcctcccaaatagctgggactacagatgcgtgccaccacacctggttacttttttgtatttttagtagagacggggttcaccgtgttggccaggctggtctcaaactccagatcctcaagtgagccacctgcctcggcctcccaaagttctggtattacaggcgtgagccaccacgcctgaccacaaagctttctctttcttctttctctctttttctttctttctttctttctttctttctttctttctttctttctttctttctttctttctttctctttctttctgtctctctctctctctttctttctttttttcctttctttctgttttttgagctctgttgcccaggctggaatgcagtggtgcaatcttggctcactgcaacctttgcctcccaggttcaagtgattctcctgcctcagcctcccgagtagctgggattacaggcatgcaccaccacacctggctaatttttgtatttttaatagagatggggttttaccatgtcagccaggctggtctcaaactcttgacctcaagtgatccacccgccttggccttccaaagtgctgggattataggcataagccaccacgcccggccacaaggctttctttaatactcatccagtgagtgactttacagcaaagaagaacatcccttccaccctttctctcaggcctggttacagggccacatccaccaccacacaggaccagcctgggcacctcctctccagggcctcagcccaagaggctgagtggacagcagtgcctctgggaccctcgggctgacctgcccggtttagtcacagtgaggggaatctcttttttcctttgctcacagaaacaaagacacacctttctcaaaaataacttttactataaggggaaagattaaaaaattaaaagtagagaaatagatagttttccagaacatggtttctgtaattccaccaagctcagcctcatcatgacttggttgatttcatttccagaaccttccaccctcaatttattttctttgcctcagtcagccctgagaagagggagacggcaaagccaccctgagtggctgtccttggggcctgaggttgtagggtggaggctggtgccaggcccagacatgctgccaagtctgctcctggagtgaccctccctctgccgctctgtcccagggacccacactgggctctgtgaggccctgtgcctggtccctggggtaaggatgggctctgtcaggcactgaccaagtcggtgcagtagagataaatggagtttgggaatctgacaaactgagttccttcctgtcttcctctgttctcagctgtatgatttttatttttttattttattattatttttttgagacagagtcttgctttgtcacccaggctggagtgcagtggcatgatctcagctcactgcaacctctggctcccaggttcaagcagtcctcctgcctcagccccccaagtagctgggattacaggcgcccaccaccacacccggctaatttttgtatttttagtagagacagggtttcaccatgttagccaggctggtctcgaacttctgacctcagatgatccacccgccttggcctcccaaagtgctgggattacaggcgtgaggcaccgtgcccagccagctgtatgatcttgaaaaacttacctcctctcctggaacctcagcttcctcatattcaggagggagtaaacgctgcccagcttgttgtcacggttaaaggtggtgatgtaacatgtctggcatcttctcagctcattcatcttttgctcagaccttcccgtgagggaatccctgtatatccatgttctaatgctggatattttgaaacatgtattttacacgtcctggataaaatagatgaggccctttaggaaagaaatgggcatcagtgcgcattatcagagcagcaaaaggacgaagcagctggagtccgccaagctgggggctgtgtctggcagcacacacagtgcagttgccagggggagaggtgcgtggagctcattagacacacttctaaattggaaaaggactgtcccacatgcagcatggggactgccagagtcatgaatcgttataattgtacctttccagttaatccaaaccaccagcaataaagcttgatggtgaaggacattttcattccctcatggaaagaagtgcagagagggcaaaaaggagcagggaatgggtgctgcaggaacaagtaaggttagaaggcaaatgaaatgagagaaaatgcccagcctggtacctgtacatagtagatgttcaatacttggtggtcactctgctccctcccaccacctcagctgcctccatgcctgccctccccagcctgactcatttctgtctgcccgaggcctggtcaccagcctgttttaagcagttgtcacttgcttggagccttgtcttgccctccggaggaagccagagaaacaagttcttgggagccccacccatccagccaccttctctgccattttgcctcttgggaccaccttctagtttgctcactaatgagtgcttcctcatgcgggagtggtggggatctgcaggtcctgagcccagacctgtagaccactcattattttacagacatctgtggagcacctactgtgtgccagggactgggacacagcagtgaataaagcagagctcctgcctgaggagctcacattctagtggagagggacaggcaacaaattgcacaaatatgtcagtggcaccggatgtgacagtgatgagtggtggggaaaagcagagcctagtagggagacagcaagggcctcactgcgagggcagtgtctgaggaaagccctgaaggaggtgagaggacagccacctaggcctttggggaaagagcatcccagacagaaggaagagcaaatgcagagactggcaggcgagaagcagccccagatgtctgcagacagtgaggaatgcagtatgttttgtggtggagttggaggagggcaggcaatagggaatgatctaagagatgaatatgggacctcagaggccagtgcaggacttggatttcaccctgagtgaggtagaagccactgcgggaaccagctctggctaatgtgttaacaggatccttctggctgcagacccaacagactaaaggggggtgagggcagaaggcgatgacctgagagaatgttgtgataatccaggaggagccagtggtgcttggaggtggcaaggaggggtcagactctgaaggtagtgacaacaggcggatacccacagggcggatgtggagtttaagagaggactcggggatgactctggcggtttagatctgagcagctggaagaatgaagttgtaatcctggtcaggcgtggaggatcatgcctgtaatcccagcacttggggaggccgaggcgggcggatcacctgaggtcgggagttcaagaccaacctgactaacgtggagaaaccccatctctactgaaaatacaaaattagccggacgtggtggcacatgcctgtaatcccagctactcaggaggctaaggcaggagaatcgcttgaacccaggaggcgtaggttgcggtgagccgagagggcgccatcgcacaccagcctgagcaacaacagcgaaactccgtctcaaaaaaaaaaagttgtaatcttactgaggtggggaggctgtggcgggagcaggtgtcaggaagctcagaggctcagttttggacttgttgagtttgacacacaagtaggcctccaaggaagacgttgcacgaacactagtctggggttcaggggaggtctggacagagggtgtaaatctggagtcattggcatatagatggaatttcagcgctctcccagggtgtcagtgatggttgatactcttctcccccaacaaatgcagcctcagacaccgagcagggacctagtgaaggactgttgaccagacagatgttcagatcaatgcgcttttacatcaaaaccatcatgcgggttccacaaatgcaacagacatcgctgggtgtggtggctcacacctgtaatcccagcactttgggggctgaggcaggtggatcacctgaggtcaggggtttgagaccagcctggccaacatggcaaatgccgtctccactaaaaatacacacacacacaaaattaggcaggcatggtggcgcacgcctgtagtcccagctacttgggaggctaaggcaggaggatcgcttgaacccgggaggcagaggctgcagtgagccgaggtcgcccactgctctgggtgacagcgagactccatctcaaaaataaaaaataaaaaataaataactagacatcattactataagaaaagggggattctttactaacagccccctaccatctctgtcccagccccacaacaagaagagacccctccagccactgagtccccgctggagccacgcctaggagagctgacagtgacagatgtgacccccaactctgtgggcctctcctggacagtccccgagggccagtttgactccttcatagtccagtacaaggacaaggacgggcagccccaggtggtgccggtggcggcagaccagcgagaggtcacagtctacaacctggagcctgagagaaaatataagatgaacatgtatggactacatgatgggcaacgcatgggccccctgtctgtggtcatcgtgacgggtgagtaatggggggactcagtcctcatctctggttacccagagctcccccaccccatggcccttcttccagccctgccttggtaccaccgcaccctcactgaggggctagatcccctcaggccctggctcggtgaccctgccagtctttctgttccctgacccctttactcctcccagggctagagccttctcagccctccagctccttccccatctccactctgccccccgcccaggggaatgtcttatttccatttggcctaaatccagccacagactttctctccccctctccgactgcccacagctgtttccaccccttctctttacaaccctgctgtgacttggacacagctgccacctcctgcttctgcccttttttgttgaggcgaagtgctttacatcctgagtcccttctcaggagtcctctgccacctgcctgcactgcattccatcccagccctggagagttttcatctctccaggaggctgcctcactcttgctctgggctccttcctgcccctcatggcttcctgggcacaggttctccatgattgttgtgctgtggcatctggtgaaacccctaccccacctgaaggcaatgtttttaaatctgtaaaataagctgtataggattacaaaggaaacattatatttatagacagttatcaaaatatttcttttttatttttgagatggagttttgctcttgtcatccaggctggagtgcaatggcgcgatctcggctcactgcaacctccgcttcccaagttcaagcaattctcctgcctcagcctcccgagtaactgggattacgggcacgtgccaccacacccagctaattttttgtatttttagtagaaacagggtttcgccatgttggccaggctggcctcaaactcctgacctcaggtgatccacccgcctcggcctggcatgagccactgcacccggcccaaaatatttcttaaaaatccaaagttacgatttagtaatacttggacttatttactagttcattaaataacaggacttggtggcgcgtttactaaactacaaaatttagaagcagtgatggatataaaaggtattttaaagtttctgcaataactctaaggtgacatgaaaacatctgtggtttctattggtaacaaagtcacaataattctactctggtgggttttctatattagttttggaaagaaatgctgcatttcagttagaggtctggaagtaaaggtgtaactattccccatctcagttcacagcccccctgaggccctcaaagcccaggggttctcccctcagagatctcaaccatgttctttgtcttcccaaatcccagctcccctcccaccagccccagccacagaggcctccaagcctcccctggagccacgcctaggggagctgacagtgacggatataacccctgactctgtgggcctctcatggacagtccctgagggtgaattcgactcctttgtggttcagtacaaggacagggacgggcagccccaggtggtgcccgtggctgcagatcagcgggaggtcactatccctgacctggaaccctcccgcaagtacaagttcctgctctttgggatccaggatgggaaacgacgcagcccagtctctgtggaggcaaagacgggtgagatgggcccctacacagctgagcctgaggccacagccttcccacccttctcttcactccctctgctgagtcttccctttgtccacctgctctgtctcatttgaaaagccacatggggctagcacagtgactcatgcctgtaatcccagcactttgggagtccaaggcaggtcaggagtttgagaccagtctggccaacatggcaaaaccctgtctctactaaaaagacaaaaattagctgggtgtggtgatgggtgctagtaattccagctactcgggagtctgaggcacaagaatcacttgaacccaggaggtggaggctgcagggagctgagattgcgccactgcactccagcctgggtgatagagccagactccgtctcaaaaaagaccaaaaaaaaaaaaaaaagaaagaaaagccgcaaagcagatgaggaccaggagagtggggccagttcctgggtctgctgtcccctgctgactctgcctctcttctcgtaatttccacttttgttggatgagggaagcccctacaggcctcttcctgcagggtggatgtgggagcctgggggtgctgggagaaggggcgaggggagccaggaacccttcctgccttgcgaatccatcacctcctgagagtctttgttgtctcccctgtgactctcacccaggttctcaccctcctagctcaggcctgtctgggcccatatgtgcctcctacagaggctgcccttccttctctgccctcctcctgaagtctcagaaattgggaaccagaggagcccagcccagctgtgcccctttccgagggttcagtccaagccctcccctgcccctgggggctccctattgccagaaaacttgcaataacaatgtcgtcagcgtcctcaccgtccaggaaggcagcaggccagctccttctcaagccctgggatggctcctcaggcagacaccagatcccttccctgcctgagctccccggcatcatccccctcaacattctcacaggcagcccacgctccttcaccaggcccagtgggagccttagttctcccgggccagccggtgcagaataagaaagggaacggagaagggtgagaactacctgtgtcgtaacatcctgcctccctgacctgccgagtgcccccatcagggatcctgcgctcctcggggccggccaaatcacccctttcctcaggggccggccaaatcacggccaaatcgtgtgctcctgggtaagaggagatagagacccagtctgtaagaagctgcaccctgctggggaagcagtctgtgagaggcggaaagaggctggacagaaaggggagtaagatgaggcagggagctagggaatctcttttcctggaggtgactcaggacaggtgaccctccccacttgggtcaaggggagagaggcatggaccagacggagatggtggtgaggatgggaggtgatggaaatattttggggaagcactgagcatttgggcagttctgggtttttccagccccagagggaggcagtcaaggagtcgttttggaaaaaataaacacaagaacctttcctctccagttgcccgaggtgacgccagcccaggggccccaccccgccttggggagctgtgggtgacagaccccaccccagactcactgcgcctctcctggacggttcctgagggccagttcgactcttttgtggtccagttcaaggacaaagacgggccccaggtggtgcccgtggagggccatgagcgctctgtcactgtcacccctctggatgccggccgcaagtacagattcctcctctatggcctcctgggcaagaagcgccatggccctctcactgccgacggcaccacgggtgaggggcattccctgcaggtccctgctctgctcccctcaggccaagcagcagacggtcacttgtggtggctgccattaccattatttggccccagccactcggctcagatccagctccccacgtccctgcacaagcccctagcacagcccggcaggactcagccacgcaaagccctgtctccagacctctcaatcctgcccgtcgaggtcacccagtcttccagaaacagctcagccgtttcctctccgtgtctccatctcagaagcccggagtgctatggatgatactggaacaaagcgtcccccaaaaccccgtctgggggaggagctgcaggtgaccaccgtgacccagaactccgtgggcctctcctggacagtccctgagggccagtttgactcctttgtggtccagtacaaagacagggacgggcagccccaggtggtgcccgtggagggcagcctcagggaggtcagcgtgccgggcctggaccctgcccacaggtacaagctgctgctctacgggctgcaccacggcaagcgtgtgggccccatctcggccgtcgccattactggtgagtgtgcggcagctggaacacctgtgcctccttcccgcctggctctcctggtctgactgagccataagatctctgagcttcccattttatatcatttccattgatccagaaagtttccttgtgcccctttagagtcagttgccccagtcccagcctccagcaaccactgtctgctttcgatcatcctggagacagcattttgactctccatgtaatggaatcacaatacgcagtctcttgtgtttcatttcttgcaattagcacaatgcttttgaaattcacccatgtgcagcaaaagctggtctttcgattgctgactgcttgccctcactccctctcctccctcactcctcctgagagtctgggtgcagcgacacaccagccatctgtctctacctgtctctgtgaaccagccggcagggaagaaacggaaactgagaccacggccccgacccctccagcgcctgagccccacctcggggagttgacagtggaggaggccacgtcacacaccctgcatctctcctggatggtgactgagggagaatttgactccttcgaaatccagtacacagatagagacgggcaactccaaatggtccgcataggaggtgaccggaatgacatcaccctctctggcctggaatccgaccacagatacctggtgaccctgtatggtttcagtgatgggaagcatgtaggtcctgtccatgtcgaggccctgacaggtgagaactctgcccactatgcctcctttcagatggctgggagagtccagaggacagcagagtcccgcggataccctgcccacctcagtcctctctttccatgtctctgtccagtcccggaggaggagaagccttcagaacctcccaccgcaacccccgagccccccatcaagcctcgcctgggggagctgaccgtgacagatgccacccctgactccctcagcctgtcctggacagttcccgagggacagtttgaccacttcctggtccagtacaggaatggagatgggcagcccaaggcagtgagggtgccagggcacgaggaaggggtcaccatctcgggcctggagccagaccataaatacaagatgaacctgtacggcttccacggtggccagcgcatgggccctgtgtctgtcgtcggggtgacaggtgagtggatgatgggagccccagggtgggagccatgggagggtcaccctcttgctctttggtgatgactggtggggaatgggacaagggtctggtcagcaccacagacctgcttgtggctggggctggggctccccttgggccttcctgtgaggttgaccactggctcctcctgaacagagaggggccatcgggaattttgctgtgctggtggctgtcccaggtcccccacagctgaccctggaacttgtcatgtgtgttagctgtcagctgagcaggaccacccagccccaagagtaggcctctctgaactgacctcgggtcccccagtcatagccttggcttctccctccttttccccagtacccaaggacatccccctcactctctcttcctccttctcagctgcagaggaagagacccccagccccacagaacccagcatggaggccccggagcccgctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagtgaagtcaccgtggggggcctggagcctgggcgcaagtacaagatgcacctgtacggcctccacgaggggcggcgcgtgggcccagtgtctgctgtgggcgtcacgggtgagtgtgcactgcagagccctctgggttgggtcttagcaaagtacagcctccagcatctcctccactagggacccagaaccccaagacctcaaacctgtaatacaccctgttcactaaaggctcaggacaggtgtgatctggggacagagagagcaaatccaggagaagtgtcggagccatatgggaaaggcccccagggactgaggcctcttgggaggtgattcactggctggtttgtggctctccgcttttccttggaactctatacataactctttttgtgagattggaacacatttttgaaatacaaattaattaaattaataagtatttgttaaataaaatttcaaatgtataaacagaaagaatagtacaaagaccctgccatcctccttcaatcaaatatcgacttctggccagtctggctcatctctgccccacccacttcctccactagaatcactagaatgttttctttctttctttctttctttctttctttctttctttctttctttctttctttctttctttcttccttcctttctttctttctctttctttctttctttcattcttttcttttctttctttctttttagacaaggtctcactctgtcgcctgggctagagtgtactggcacagtcacaattcactgcactgcagcctcaacctcctgggcttaagggatcctcccacttcagcctcccgaatagctgggactacaagtgcactccaccatgcccagctaattttttgtattttttgtagagacagggtttagccatgttgcccaggccagtctcgaactcctgggctcaagttatcctcccacctcagccaaagtgataggattccaggcgtgagccgccacacccggcctgaatgttttctttattaacacctttatggagatataattcatgtggcataaaatacacttgtttttagtgtacaacttactgattttagtatctttacctacttgtgcagccatcaccacgatctaattttagaacttttccatcacccccaaaagaaatcttgggtccagacccattcctacctcagccctagtttataactaatctacttttttctctgtagattgctgttccagaacatttcgtataaatggactcaaacaatatgtattcttttgtgtctagcttctttcactgagcataatgtttttgaggttcatcaatgtagcatgtagaagtactatacttactacattgctattgattgattgattgattgattgattgattttttttgagacaaattcccactctattgcccaggctatagtgcagtggcatgatcatagctcactgcagccccagactcctgggctcaagccatcctcccatctcagccccccaggtagctggggccacaggtgctcgccaccacactcagctaatttaaaaaaattttttgtagagatggggtctcacagtgttacccaggctgatatcaaactcctggcttcaaggaatcctcctgcctgggccttacaaagtgctgggatagcaggcatgagccacctgctctctctcagccactacactgctttttattgccaaacagtattgcattgtgtggttatactactgcagtattttaaaaacgaaccacagacatcctatgctttcatcactaaatatttaaaggtatatctctttttaaaaaaattatttttaaaaaatccacaatatggccaggtgaggtggttcacgcttgtaatcccagcactttgggaggccaaggcaggtggatcacttgaggtaaagagttcaagaccagcctgaccaacatggtgaaaccccgtctctactaaaaataataataataataataaattttaaaaagtacaaaaaagcggagcgtggtggcacgtgcctgtagtcccagctacttggcgggggttgaggcacaagaaattgcttgcacccaggaggtggaggttgcagtgagccaagatcgcgcc

SEQ ID NO: 15142 - DNA, 8668 bp, Human
  misc_feature (1)...(8668): n = A,T,C or G
ggattacaggtgcccgccaccacacctggctaatttttgtaattttagtagagacggggttttgccacgttggccaggctggtcttgaagtcctgacctcgtgatccccccaacctcggcctcccaaagtgctgggattacaggcgtgagccactgcgcccggcctgcaatccattttcaacatctcaaaaagagatgtcctttaaacacaatttgaatcatgtcatttccctgctcagaatccttcaataatgtcccattgtaggataaaataaaacaaacattaacattgcctaaaaggccctgtatgaaagatctggtgcctgtctatctctcaaatttgaactgatggactcaatactgtcaatcacactggctttctttctatttctctaattcccttaagtctttcttagttcaaagccttacttagaatgtgcaattttctctgtttggaaatgtcttttctgctactgttggctttgtctaactcctcctactcagacatcaggtctgagctaaaatattactttctcaaagagttttttcctgattttccaatctaaattagctccccttgtgatattctttcataataccgcatacttttccacaaatatatatgagaagttattcattgtagtatctaactccctcactaaactagaagcttcatgggagcaggcacattatctgtttagctctttgctttatcccctgcgccacagtaagcatctaataaatatctttggaatgaatgagtaagcaggtagtgagggggaataacctgtggtatagaagcacaattaaagtgatataatatcttaccttgcacaatattagtcattcattatggaagagcatctgtcttccatctctccccatttgatattctccgatagtttaagatctaagtgattggaagccaagtgactgatcaagacttatatactctggaaagatcctaagatatctttccctcatataagacaagctatgcaatatagaggctacaaaaaaaaatcttaaaggagaacaggatatcaaacctgaatgaacgctgggcccacttctcctgatccacacggggagccagtccagactttccagcccacaggacattgtcacaggcgaagtacaaggctcgattgaggtgactaacagtgatgcagaatctcaggacaacatctgataggtgaacagctcttttggctgactcaagggcatctgctgagttacccaggcgtagaacttgtggagattagaaagggaaagcaaggatttgtaagtggagaggcagataacaagaaacagaaacagagaaagcaagagggcaaaagttgagcaataataatgacaatttttttaaagagcagaaacaggctgggcatggtggctcaagcctgtaatcccaacattttgggaggccgaggtgggtggatcacctgaggtcacgagtttgagaccagcctggccaacatggtgtaaccccatctctactaaaaatacaaaaattagcccggcatggtggtgggcacctgtagtcccagctgctcaggaggctgagacaggagaattgcttgaacctgggaggcagaggttgcagtgagccaagattgcgccactgcactctgacctggacgagagactctgtctcaaaaaaataaaaaataaagagcagaaacagtccatttttcaatttcaaatttaatttttgtgccagtttagttttctcaaacttgacccattctctccagtccacctaattacttccatacccctgctctcttatctcaactggactcatgcagagggtaagtgcagagccaaatgagaaagaagaacagagagggtacaggaaggagggacaaaggaaggtgagctggggatggaggaaaggttgggggataaaaggaaagacagagttacttacgctttcttccaaggctcaggtggctctccagttgtcgaatctgtttctgtaactcaggactggctccatgcctctgcagcgcatggccaagaagagagcaagcatactgggcggccctagaggagagggcaggcaaggtaaggtggagacctccctaaccttccgctcaaaactatcttccaaaaggcacagacagacttccccctttcccagtttgagaacactccccttcctcctccatgcccatatctcaccatttctccaggccagaggaagggaaaggcataaggagaaaaaagagtctagaaaggggtggggagcactattgaatgttgagcaaattagagatttgacaatgatgaggcctgaaggggccagtgcaggccgcaggggtccatcacaagcacatcagcgtgagcatgtacgtgatcgatgagggggaggcagacagttggagggcattttattcctcagaataggtgaactgagagatttcaaggccctctagctgaatggagaccaaacgccagggcggaggcaggggagttcccgaatggcagcacggtgtggggacacggaaactgggagtgcctcctcagctctgggggcagagtctggggctatccaccgtggggcgaatgctcctcattccatcaccgcccagtgaggacactgtcggtcttatgtggacacagcaaccctgagcggcctccccgctggcccactcatgcctcagtttccccatctcttccgcgaacggaaaggaatcatctcaacagcggctcaaatctgcgcctcacggtccgttcgggcccccgtagccggagttgacccttcttgacccccctgtagcctaaactgacttcgcctcactagagtcttcctctgtccatccctcccccgccccacccccattcctattcgggccgcacctacacagccgctcccgggcttggctctgagcactgaagcggacccaggcgtccatgacagccgcagcccaggctccgcggccctgctcccgccccacttcccgcccctagtcacgcctactgcgcgacccaacggtgcctcgcgagggacaaacagtatcagaaaagaaagcttggccctggaagcggaatttcaggacgcgaaactcgtgtcttttgagcctccatctgtgtattactgtgcgtgtctgcgtcacagcttccccttatcagacgacccctactccctagcacgcctccagcggcaccttcttctttaaatattcatgaccaagggcggggcctgcaggggccggggcggggcgagaaagcgccgcagtgatctccacgtcttggaggccgccggcataggtgtgcgcctggcagaacctcacaaatacacatgcacgcaggccccgactgaatccagggctgtaggggctaaagaggtctaggtcagtagaggcctgaagcccaggctggtctgtccaaggaaaaaggagcgtgattggtaccagatcttcgttccctgcagaaccttgacagttgaacaagtgacctcctccagaacagatggagagtctccagaagcagaggctttagtgaacgaaattcgcaataatcagctccagatcctgaaaaggagggcgaagaatcagtggccaaagctaaccgcttcatacccacacttcatcctcctcagtttctctccaggccaccatgtctgcaggcaacggcaccccttggggtcagcagcgggggaggaggtctgggctggatcaggagtggaggtggagggctcagagctgcccaccttctcggcagcagccaaggtccgagtgggagtgaccattgtgctgtttgtttcttcggctggagggaacctggcagtcctgtggtcagtgacacggcgggaacccagccagctccgcccctctccggtcaggagactcttcatccatttagcagccgccgacttactagtcacttttgtggttatgcccctagatgccacctggaatatcactgttcaatggctggctgtggacatcgcatgtcggacactgatgttcctgaaactaatggccacgtattctgcagctttcctgcctgtggtcattggattggaccgccaggcagcagtactcaacccgcttggatcccgttcaggtgtaaggaaacttctgggggcagcctggggacttagtttcctgcttgccttcccccaggtgagtgacctaggactcaggaccgggcaggacagggatttgggtccatagcatgagttaaagggtgcgcttgggggccattagccattaattctcagggagtaagcctctgcttgcttttttttttttttgccggctcactgcaacctccgcctcccgggttcaagcaattctcctccctcagcctcccgagaagctacaggcgcccgctaccatgcccggctaatttttgtatttttagtagaggcgaggtttcaccatgttggccaggtggtctccatctcttgacctcatgatccacctgtctcagcctcccaaagtgctgagattacaggcgtgagccaccgcaccctgctacctctgctctctcttctgtaagattatttgtatgttaatttacatctgttaagagcctgccttttcgattcctcagggatctagaactagaaataccatttgacccagccatcccattactgggtatatacccaaaggactataaatcatgctgctataaagacacatgcacacatgtttattgcggcactattcacaacagcaaagacttggaaccaacccaaatgtctaataatgatagactggattaagaaaatgtggcacatatacaccatggaatactatgcagccgtaaaaaatgatgagttcatgtcctttgtagggacatggatgaaattggaaatcatcattctcagtaaactattgcaaggacaaaaaaccaaacaccgcatgttctcactcatagatgggaattgaacaatgagaacacatggacacaggaaggggaacatcacactctggggactgttggggggtggggggaggggggagggatagcattaggagatatacctaatgctaaatgacgagttaatgggtgcagcacaccagcacggcacaggtatacatatgtaactaacctgcacattgtgcacatgtaccctaaaacttaaagtataataataataataataaaagagcctgccttgtaaaaacagtatcctctatctgtgcctcttccattacatctgttttattacacgtggtttctacctctttgcatcctcccaatctcacctccttcagattggggcagggaagaaaaacatacatggggatctattaagagagtgaagtcagtggtttgggtaaaactttgtggtacatttcatttatccattcaaaaagtaatatgcatctccagcgccactcaaattttgctaaggacagggcagcaaaatcctgccttcaagaaatgtatagactactgcaagaaacaaagaaattaggcaattacaatatagtgtattcaaaagtgttatgctaaaggagctaaagaagacaatgggggtggggagtggataggggtgtctgacacagccgtgcagtcaggaaaagctttccagatgttaaaatttgattcttcagagataggtgttagaccaattaaaataggagaaatgctagggaggatggaggatagaggatctcaatgctactaaagctgaggactagaaaatggtgagtaatgaactgagaggggaagagcaagccagatcacaaataataaaattgtactttattctgagtgcagtggagagacactaaagtaaaaagagagtgacataaccaaatttgtgttttttactgactttattgtcgaatgagtgttaaaattgcaaagaggcgagcatctgaacctgagtactaggttaatcaaatctcaaatccaatccaatactgaaaaggaactagaaatctagagggggaaaagctaaatacaaagcaattccttcaaggcaaaaaccactatcactatcatggggttggggggcaggatacaacagcatctctgagactgtaggattagaattatgtcagaaggaggccaagaagggtctaggatttatctctggaatgacaatgcattatactgatttaagatttgatccttacttacatcctcaattattagaaatataactactagaagttagtctgactatactcctaagaacaaagaaaggcctggtggctcaagcctgtaatcccagcattttggaaggccaaggtgggtggatcacttgaggtcaggagtttaagaccaacctggccaacatgacgaaaccccatctctactaaaaatacaaaaattagccgggtatagtggtgagcacctgtaatcccaactactcaggaggctgaggcacgagaattgcttgaacctgggaagtggaggctgcagtgagccaagactgcaccactgcactccggcgtgggcggcagagccagactctgttgggggtggggtgggggggaaagagaaaaataatacttctaatatgttgcaaacaagacctttaccaatccaagtgttaaaaagaagcctgttgctacagtgccatttacaattaggtttgtttatatgaagcaaattttacatgtggactgggaattagaagactttttgtttcagtctgcctgttttactttgtttttttctgagtctcggctctactgctaactagctatatgattttggctaaggcacttgaaatccatgggccacaagatgatgcaatgggaaatgaatttcatcctttcttacagcctgacaatctgacaatatttgcaacctctatttgtttcaatggcaaactggttgtgacatgatacatgtgcgaaaggtgattttttttgttccaaattagtatccttttaggtaaattctgtattgcccatatgctgtaattgtagttaaaatattagtgttaataaaataaaaaatttaataatgtcacgttagagtggtaagggcttaggggtagttataggtagtattaggagtagttagaaattacttatttttgtaggcttgtttccaagttatcagcagttgaaagggatgtttctacagtacgtggtaaatggcaataaaacaggataaaggaaagatcaaaacaaggctgtggaccaaactataaatccaagagctttgattattattttttttttttttggagacagtcttactctgtcgcccaggctggagtgcaatggcgcaatctctgctcactgcaagctccgcctcctgggttcaggtcattctcctgcctcagcctcccgagttcccaagtagctgggactacaggcacctaccaccacgcccggctagttttttgtatctttagtacagacagggtttcactgtgttagccaggatggtctccatctcctaacctcgtgatccgcccgcctcagcctcccaaagtgctgggattacaggcgtgagccaccgcgcccagccagctttgactatttttatactcctcacaattctcaagcacttcttaggcagagcacaaaaacaaaaacaaaaaaaaaaacttagaaatatatgaatgcaagagatgggaagaggaaagaccatttcccaactagctcagagtagcctgatcgtaactccaaacagttcacaaaattctcttaggctgaaactattcatctttcctaaatgtccctcatgtctgctaaaatcactttcccaaatgccttgtatctaggaatctgatgcctactgagcttaccttttatcaaattaatagtgactcaatctccattactggaaagcaggcactttaaccttgtagctctaaacagaaatagtttttactgattcagttggaaaacccagcaatttaacaaaaagggggaggggcagcccaatagcatttggaaaatgttaaattttattatttaacattctttaccattatagttactgcacataagactattactactaaaggtcacttcagagtccctgcaaaatggcctggaattttggcagcacccattttacacaatatttctttttccacaaaataacagacataccaggaaaatcatttcagctaaaaatatgagtgaggtggtagaaatatcatcccttataaagcgcaatgttagaatagtacttgagaaagcaggattgttttaagttccaagatttaacaaacttactgttcagcatcatattcaagcctaaaaggaagataggattttcaagatatatttccaacttctttaacatggcaccatggatgaactgtttctcagcactgtgctgcttcacttggaattaaggatgaattgggaggagacagtatgacataggtgggtaggttgggtggtgaggggaaccagttctaatagtcctcaactccacttccagctgttcctgttccacacggtccactgagctggcccagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15143 - DNA, 15192 bp, Human
gtacatccagacaatgcaatattattcagggctaaaataaaatgagatcccaacccatgaaaaaaacatggaagaaccttaaatgcatatttgagtaaaagaaaccattctgaccgccaggtgcagtggctcacgccttcaataccagcactttgggaggttgaggcgggtggacattatacgtcattatatatttgtcaaaacccgtagaagacacaacacctagagtgaaccttaatgtaaactatggactttgggtaatactgtggtgtcaatgtaggttaacagattataattaaagtacaactttaatgtggggtgtcaatagtggggaaggcaggtgaaatgctctatactttctgctaagttttgctgcgaacctaaaactgctctaaaaaataaagcatataaaaggaaaaatttggccgggcgtggtggctcacgcctgtaatcgcagcactttgggaggccgaggcgggcggatcaccaagtcaggagatcgagaccatcctggctaacatggtgaaaccccgtctctaccaaaaatacaaaaaattagccggccgttgtggcgggcgcctgccgtcccagctactcgggaggctgaggcaggagaatggagtgaaccctggaggtggaggttgcagtgagtcgagatcgcaccactgcactccagcctgggcgacagatcgagactccgtctcaaaaaaaagtaaaaaaaaaaatttttaaactggaacacagaggataagtaatcctgcttcgccccttgcctctcgcccctgcatggggcgaggaaggattgatcaaacccagaaagactgagtgagaatggatgttgaacacagaactgaaggatgaatgggagttacctgaatagaacccaggggcttgaatgcaagaagaggcgggcattccaggcagaggagagcaagggtaagggccccacgggaggcattcgagtaggagggtagaactatgatgacagaagactcaataacgatccaaagaaaccaaatgattgggcgccttctttcggatccgtgacttccagcgccaggagtctctatcggctcttataccgttgctctatgggatagcaatgtttttgtccttcagcctcccctccaattgctgagctgctggtgtgttttgaggagtagaaggcaaaaagaaccctcttgtttttctttggatctagagagaatctgagcaaatgacaaagcaaatggggtaaaatgtctttttgtttagtttttcctgattttcccatgagaggcaaatacatgttaaggatagttgaatctgagtaaagggtatagaaatattccttacaagatttttgttggcaactggtctaagtatgaaattatttccaaatagaaagctaaaacaaacaaaacaattggccttgggaaactggacaatcttgaagtaatcaagtaatattgttaagggacaatcagtgttgtgaaaacaacacggatacaccccctccctccccctcaaaaaaaaaaaaccctaaattcagttcccccgttgctaatgtgtgatcctggcaaagtcatctaagtcgctgagcttcagttcctccaacccagagagttgttgcaacgatcaaatgaaagaatgtctattaaagcctttcatgaactatattattgctgctaccgtagaaatggaaagtgtgcaacactagatccaaaactacttttgacacttctgagactgtggccgcgcctctgtcaccttccaaaggccactaggcctttcctgagctggcattggcaacgcacactcttgcccggctaacctttccaggtgggcggcgcactggcttcactgctctccaggtggccgctgcagctgcccgagagcgcaggcgcagaggcagaccacgtgagagcctggccaggccttccggcctagcctcactgtggccccgcccctctcgaacgccttcgcgcgatcgccctggaaacgcattctctgcgaccggcagccgccaatgggaagggagtgagtgccacgaacaggccaataaggagggagcagtgcggggtttaaatctgaggctaggctggctcttctcggcgtgctgcggcggaacggctgttggtttctgctggttgtaggtccttggctggtcgggcctccggtgttctgcttctccccgctgagctgctgcctggtgaagaggaagccatggcgctccgagtcaccagggtgagccgcttcggactgcgaactaacgcggccttcttagctgctgcctgctctccctgcctcgcctgcgggagcctcccgagcgggagagggccgcaggagcgatttggggaggaaggtgggaggggactcaccaagagagcgccgaggtgggcccaggcctggtgagagagtgtgggggacgatggatggagggaggaaggtgagaaagagaactggacggatattggataaatgttttggggaggtggagagtcgactgggaaccttttgaaaaagtgatagagggtccctgagtgggcccgccagcaactctgtaacccccttcccagagagaaggtgtctgcaattggaggctttttcggtttcctttcaaatgtaaattctcggtattttagggctggccaggactaatcagggaatccctcaattggtaaatgtagaggtcggcggaaactgacttgtcacggccgcagagtagactctgggacccatattttccctcggaacccatttttagtcggctttctttctgggaacttctccttgtgccccaccttaattaacccttgacttactcgagccttcgtggatcagctcttaaagtggtcttgcttctttcagaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggtaactctcttcctgacctaacttctgtaagagcccgccttccaactgtggcctttgatgcagaaacatttcattctctctgtttcatctacaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggtaaacttattcttaccattgtagagtctgttgattatttcttgtcccttatttcactgatacatgcaagagcattcaaatgaatagtaatattaataccatttattgagtgcttagcatgaggcaagctctgcctaacattttacatgcattaactcacataatctttacacgtactctctgaggtttgtcacctctactatttaaatcatggctttagagaggttatgtcagggtcacacaggtaagtggcccatatgggattcaagctcaggctgtctggcttcagaatctatgcttttaattgtcaactgtcttatattccttcgttaatgatattaagtagtagctgtctgagccaaaggctttgttgtccaactacaagccatctctgcagaatttattggcgtaaacatagaatgttctcttgaatttttttactgctgcatatggctactaaataataagcctgtaacattggaatatgcaaaggagtaaaacaggaagaaggcaacttttcagggagtggttaagaagatgaattaacacttagcctcaaaaataataactttttattaaatataaggtatgtaaatgtattctatgatagacctacctgtgaaggaaaggtaggtcatgtagaggaggctgctttgatgaaattgcaatgaactgtattctgaagctctgtttttttaaacttagttaaaaccagttgggaaaattatctgaaaaaaattttttgagacagagtctggctctgttgcccaggctggagtgcagtggcgtgatcttggctcactgcaacctctgcctcccaggttcaagcaattttcctgcctcagcctccctagtagctgggattacagacgcacgccaccacgcccagctaattttcatatttttagtatagatggggtttcaccatgttagtgtactcctgacctcatgatccgcccgcctcggcctccgaaagtgctgggattacaggcgttagccacggcgcccagccagttcagcttcttatatctaaggataagagattgaaagctattgctttagtgttgaatttctgggcatagcacatgaaatatgtagccagcacagtctttgggcatatcaaactacgtgaggctttcttggaaggcccatactgattcttacctttgctttcccacttagtaagaatgccttccccaccctgtctttcatttagctaataaccttttcatccttgaaaacagctcaagcatcaactcctgaagctttcccaaacttcccccatctccaccccctgttcctagaatcagtcttttttttccctttgagacagagtctcactctgttgcccagactggagtgcagtggtgccatcttggctcaccacaacctctgcctcccgagttcagtgattctcctgcttcagcctcccaactagctggggctacaggcacatgccaccatgcttggctaatttttgtatttttagtagagacggggtttcactatgttggccaggctggtctcgaactcttgatctcgtgatccacccgcctcagcctcccaaagtgctgggattacaggtgtgagccaccatgcccagccttagtcttatttttgtttattttttttttcccaagacagagtcttgctctgtcacccaggctggagcacaatggcacgatcttggctcactgcaacctctacctcctgggttcaagcaattctcttgcctcagcctcctgagtagctgggattacaggtgccagccaccacacccagctaatttttttattatttttttatttttttatttttagtagagatggagtttcacgatgttggccaggctggtctcgaactcctgacctcgtgatctgcctgcctcggccttccaaagtgctgggattacaagcgtgagccaccatgcccgaccttatttctttactttgtctactaaattcagagtcctttgaggatgccatgaagtcaatgccttgtagagtttgacttcaagaaggtgctcaataaatgtttgaacaatgggataaagggagcttgaaggaaatggttaatggcgatgaagttagttaatccttagtagtcaggatagaatttgtgttgagtagtgagaagcagtttatattatgaaataaagactaaagactgaattgtcatttatttggactaacttcacatgttgctgataaaaattaattacttctcagtttcctttgcagcaaagtctagaatgtgaatttatttgcttccaactttaaactgactcactctaagttggcatttcactgtttttttttttgcccaggctggagtagaatggcgcaatcatagctcactgtatcctcaaactcctgggctcaagtgatcctcctgcctgggcctcctgagtagttaggactgtaggcagctgccttcatgcccagctaattttttgtagagatgagttattgctatattgcccaggctagtctggaactcatggtctcaaaggatcctcccacctcagccacccaaagtactgggattactggcttgagctgttatgcccaacctcattctttttaattgaggaattaaatgatcacttttttcttttttaacagagacagggttttgctatgttgcccaggctggtcttgaactcctagcctcaacctcagcctctcaaagtgctgagattaaaggtgtgagccaccgcgcccaacccaaatgatcacttttgatgttaatcacttcctaaaaagaaatggaataaatctgaaaagatacttttcctttaaggaaatgaattgtatgccgattcagcagaatactagcttgagttggtaccaataacctgaacttcatgcccaaactatagtgcttacttctatttgctatttcaagatatctctttgtttcaaggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggtaagtattatcattcgttttttttctaaactgcatctaactttatgaaagtattttccatcaatagtttataataatacaagcaggacgtgggcagcatttcttaagagatcgcactttcaaattctccttcatggaatacctataataaaaagtcactaaataaaccaatggagtctatttgtcactttgtgcaggaaagttcgaagttagggtggatactactatcgctttctaaaggaaaatccacagattgaatttgatatgtatatatgcgatctccaccacgtttggaatggttaagtcccaaactctgcattttaggtgataacgggtcaggaagtggatgaggatgtagaatatactcaaagactacagccacccctaacacaaggcattttgtgttagtgtggctgatgtgcatccagttgttggtgaaattatttgtgcccaaaaggagtacactcaaaagctacttttttggttcacttcaatttgatcccacttttgaaactttctattaatggcatttgccctttccctacaaatacaagcactctttatggcagcataaacatagtaacataaattatactgttaccacatttacgtagtttttttgttgttgttgttttgtttttttgagatggagtctcacactgtcgcccaggctagagggcagtggtgcggtctcagctcactgcagtctctgtctcctgggttcaagcaattctcctgcctcggcctcccaagtagttggggttgcaggcacacaccaccatgcctggctaattttttgtatttttatttggttttggtttttttgagacagggtcttgctctgttgcccaggctggagtgcagtggtgcaatctcggctcaatccagcctccgcctcgggtcaagtgattctcatgcctcagcatcccgagcagctgggattacaggtgcccaccacaacacccagctaatttttgtacttttagtagagatgaggtatcaccatattggccaggctggtctcgaactcctgaccttagatgatctacccatcccggcctcccaaagtgctgggattacaggcctgagcaaccgcacccagcccccagttgtttctaatgtgttgtcttatgtcatcactgacatgttcatctcttgcctgctcctttttggcctctcctttttctataggattcttctgcaagacttctttgccaggagcagccttctgcttttagtttcttcttccatctttctagtgctttttaaagttgtgttctaactttggaggattcaatttagtaaatgtgctgtttcttttttttttttttttttttttgggacagagtctcgctgtgtcacctaggctggtgtgcagtggcacaatctcggctcactgcaagctctgtctcccgggttcacgccattctcctgcctcagcctcctgagtagctgggactacaggcatccgccaccacgcctggctaattttttatatttttagtagagacggggtttcaccgtgttagccaggatggtctcaatctcctgacctcatgatccacccgccttggcctcccaaagtgctgggattataggtgtgagccaccgcgcccagcctgtaaatgtgctgtttcttgatgcttcgttcttgttctgtgcaaggccatttatgcaaagcaacccctcaagtggcagaggagctgagaaaccaaggaattaggcagataaatggagtttgctggtattgggtgactgatgagggggaatttacagacataagtatggtctttgatggctgtaagatgtagatctctgcactgtaacccctcgtacccacggcttgggtatgtatacattttcttgggcaaagtatacatgctctagaatcaatgtgtgggtggctgacagaatgctgcagacatcacagcctataatgtatacaataatatcaagggctgttttggaggaaaggccaaacttaaagtgaataggcagaagtcacattgaattagtatttaaaataaagtcactgttgtccccacagttcttagctatgttgctgttgggatttaacccaggagcaggcaggagtgttgtagtacatgggttccagctgccctgggagttactgatattttctctacataaagctcaggttctaagtttagaggcttaagtgaaaagatctgagatgataatgtagtatctttatttggaagggagtggaccagcagcagttgtggtgaagaatatcgtaagacctgacaatataaaaaagctgtcatactgtcctatctaatgtttgccttttttttcttttttttttggggtggggagacagtctcactctgtcacccaggctggagtgcagtggtgcaatctcggctccctgcaacctccaccttccaggttcaagcaattctcctgcctcagcctcccaagtagctggaactacaggtgtgcgcaaccatgcccagctaatttttgtatttttagtaaagacaggtttttccatgttggccaggctggtctggaactcctggctgcaagcaatctgccaacttcagcctcccaaagtgctgggattacaggcgtgagccaccacgccagccttcatgtttgctttatttcttggtgatgttgttgtttgtggttgaccatatgaataattgaattaagaactgatatagattataaatgccccagtgctactgtaggaactaactgatctttctggacataaatgtgtcacatggagtcatgtttctaagaataatcagcattttcttttgcaggaagagcaagcagtcagaccaaaatacctactgggtcgggaagtcactggaaacatgagagccatcctaattgactggctagtacaggttcaaatgaaattcaggttgttgcaggagaccatgtacatgactgtctccattattgatcggttcatgcaggtgagcatttcagtaagagttttcccttccaggattctagccgagtcataagaaactgatgttttcaggccagtctgggcgcagtggctcatgcctgtaatcccagcgggcgggtggatcacaaggttaggagatcgagaccatcctggccaacgcagtaaaaccctgtctctactaaaaatacaaaaaattagccgggcatggtggcgggcgcctgtagtcccagctactggaggcggaggttgcagtgagctgagatcacgccattgcactccagcctgggtgacagagcgagactcaaaaaaaaaagaaagaaataaaccgactttttcaactaaaatctttcttgggggatatggtgtcattaattaagattttgctatgggagaatgtctttctacctctccttcatcatagctctgtgtctccttttcaaacattttattcaccctattgaaattcccattgcagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattctaagagctttaaactttggtctgggtcggcctctacctttgcacttccttcggagagcatctaagattggagaggtacaggtttcttgagaaacctctccgtatgggtacattagggggaacactgctgctgaccaagcacgttgaattcaactgacctgtattatacctaactacatggggaagggataaagttgttctttatttctagtcaggctgcatgttaatattaggactttccatgggcatttgagagtttgtagacaaacatttgtagttaaagatacatatgggcatgcaggttagtgccaaaggaaaattttctgaaagaaactcagtaacatgggttttgtttcaggttgatgtcgagcaacatactttggccaaatacctgatggaactaactatgttggactatgacatggtgcactttcctccttctcaaattgcagcaggagctttttgcttagcactgaaaattctggataatggtgaatgggtaagctgtgtcccacagaactcctaagcttttaaattttaaagagtgactaaatacagaacttttgttattaaaaggcaattcaagtggttcataaatatgggatctactgaaggaatagttaaaaaagatgtcttagaatgtttccacatctttttgtttttgagacaaggtctcgctctgtcactcaggctggagtgcagtggtgcagtcttggcccactgcaacatcagcctccagagtagctgggattacaggtgtctgtctagtttttaaatttttttcatgtcagatgggtaatatgcccacattgtaacaaggtttgagggtggcacgtttcacatgttcacatgaacaccaaatcatcacacttatgaactacaaaagagtcgcccaccagcctgggcaacatagcaaatcctcatctttacaaaaaatatataaaatatatatatatatatatatatatatatatatacaggcacacgcctgtagtcccagctactctggaggctgagctttgtattttttgtagacatggggtctctctatattacccaggctggtcttgaaactctgggctcaagcgatccacccacctccacttaccaaagtgttggaattacaggcgtgagccattgcaaccagtcgagtgtttccatttctttccctgatttcaactttattccctttgagaaaggtagagcaacttttactccttacagatggagaaacttgaaggtcaaatgacatactagtagttcattcatattcattgattcaacaaatgcttctcctatgtgacaggcactaccctaggtctttttttgttttttcgagacggagtctctctctgtcgcccaggctggagagcagtggcgtgatctcggctcactgcaacctccgcctcctgggttcatgccattctcctgcctcagcctcccgagtagctgggactacaggtgcctgccaccacgcccggctaattttatatatatatatatatttttttttagtagagatggggtttcaccgtgttagccaggatggtcttgatctcctgacctcgtgatccgcccaccttggcctcccaaagtgctgggattacaggcgtgagccattgtgcccggcctaccctaggtcttaagaatagaactatgtagctgggtgcagtggcttacatctgtaatcccagcactttgggaggcagagttgggcagatcacgagctcaaaagttcaagaccagcctgaccaacatggtgaaaccctatctctactaaaaatacaaaaattagccaggtgtggcagtgcgcgcctgtaatcccagctactcaggaggctgaggcaggagaatcacttgaacctgggggcggaggttgcagtgagccgagatcataccatgcactccagcctggagcgagactccatctcaaaaaaaaaaaaaattacaaagttggcctcaaggaagtggagtctagttttagggtgggcaagtcagcaattacaaaagtgcaattaggtttgagcagaggaagcatgagagcacctaggaaaggagtctttagctttgtcttaaatttcagttatattaattatacagtacccatctcttttccactcctgaataacatctaacatctagaaactttatgaaaatcattattgatttgagcatttttaacattaacttgttgccttagacaccaactctacaacattacctgtcatatactgaagaatctcttcttccagttatgcagcacctggctaagaatgtagtcatggtaaatcaaggacttacaaagcacatggtgagtcaatatagtggcattgtaagatgctgaaaagtgtaataattcaaacttaatgcctgcaaatgcctggtttatttttaatgagttaatgttttaaatgaatacctgtatcattgcatcttgtgattttttttcttttgcctctttaattgctatctttttgtcttccagactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacatattactgttgcatttacttttaataaagcttgtggccccttttacttttttatagcttaactaatttgaatgtggttacttcctactgtagggtagcggaaaagttgtcttaaaaggtatggtggggatatttttaaaaactccttttggtttacctggggatccaattgatgtatatgtttatatactgggttcttgttttatatacctggcttttactttattaatatgagttactgaaggtgatggaggtatttgaaaattttacttccataggacatactgcatgtaagccaagtcatggagaatctgctgcatagctctattttaaagtaaaagtctaccaccgaatccctagtccccctgttttctgtttcttcttgtgattgctgccataattctaagttatttacttttaccactatttaagttatcaactttagctagtatcttcaaactttcactttgaaaaatgagaattttatattctaagccagttttcattttggttttgtgttttggttaataaaacaatactcaaatacaaaaggtatcttttttaaaaagttagtttactgcttccttaggctctttctaaatcccacccacctgaaggacatcaattatggatttatccttcatgccttgtataaatacagatgtgcatatgaatttttatgggttttttaaaaatgtggttcattctatatacataacaattactttcaacatacataagcctacctgtatttgtgcattatattacatggtacagataaatagtcatgtgccccatgaacattttggtcaaagatagattacagatacaatggtggtcccataagattatgatgccatatttttactgtacctcttcttgtgcctagatacacaaatactgacttgtgttataattgcctgcagtattcaataatatggtgtatagatttgtagcctaggagctataacctatactatatagcctaggagtgcaggagggtatgccatctagatttgtgtgagtacactgatgtttgaacaataaaatcacctaatgataggtttctcaaaccatatcccagtccttaagcaacacatgactaatggattcaaccatttcccctgttcgttcagattgctttttctttttgcccctacaattttgttgataatactgttttttggggcttttgtttttgtttttgtttttttttttgagacaagagtctcactctgtcgtcaggctggagtgcaatggcgcgatctcagctcactgcaacctctgcctcccaggttcaagcgattctcctgcctcagcctcctgagtagctgagattacaggcatgcgccaccgcgcccggctaattttgtatttttagtagagacgcggtttcaccatgttggtcaggctggtcttgaactcccgacctcaggtgatccacccgcctcagcttcccaaagtgctgggattaaaggcgtgagccaccacacctggccaatttactgttttataccatgcttttttgtgtgtattctaggttccctaaagcaaacatgcattttaaattttgatagaaccagatgacatacaaaagtgcctgttttctctgcattattaaaactgaaggtaatcagtcttttatttctatgactccaactggcaaaaaatatttgccattttaactttttttttttgagacggagtcaaaaggtgccagttttctctgcattattaaaactgaaggtaatcagtcttttatttctatgactccaactggcaaaagatatttgccacgttaacttttttttttttttttttgagacggaggctcacactgtcacccaggctgaagtgcagtggcatgatctcagctcacttgcaacctccgcctcccaggttcaagtgattctcctgcctcagcctcccaaggagttgggattacaggcgcatacccggcttattttttgtatttttagtagaaacgggatttcaccgtgttagccaggatggtctcaatctccagacttcgtgatcgcccacctcggcctcccaaagtgctgggattacaggcgtgagccaccgcgcccggccctcagtaggcgatttttatatgtggtataaagtagaattcttacagatggatacccgtttatgccagtgccatgactgaaaccctgcttgtccaacttgaaatatcttcaatgcccatctattcttccttgatcttgttttttcctgtgataatacaatagtttttaccagttaatcagttaagatgaggcttaccaaatatatgggagtactactgaacacttttctataaaaactttaaaattgtgtacagttaccaaaaagttcctttgagttttgttgttgttgttttgttttttgagagggagtctcgttctgttgcccaggctggagtgcagtggtgcgatctcagctcactgcaacctctgcctccctggttcaagtgattctcctgcctcagcctccggagtagctgggactacaggcacgggccaccatgcctggctaatttttttgta

SEQ ID NO: 15144 - DNA, 12113 bp, Human
gaaggtgagaacgtaggtagaaagagctgttgggcaactgtagcaataaaacagaaaagagatgaatgtttgcacataggcaggggcagcaggaatgcagaagggcaggtgtcagagagcgtccacgtggtaggacccacaggaccaggtggctgaatgcagaggctgaggctgagcagggcggccagtatggctcctgtgttctgatggcgtgtagtggcgtgaccagccagggtctggaagaaagaggaatgagtattggaatcagaggcatcagataacgatgtgggattctttaagatatcagttgagtcaaatgagtgtctagagaaaatggagccaaaggagctcaggagggtccaagaagcagttaagagtaccatgatagaagtgccagggatcaagtcagggaggtaaggtaatatggtttcgttgtgtccccatccaaatctcatcttgaactgtagctcctgcaattcctacatgtcactggagggacccagtgggaggcaattgaatcatgggggtgagtcttttccatgctgttctcataatagtgaataagtttcaccagatctgatggttttataaagaagagttcccaagcacaagttctctcttgtcttccgccatgtaagacgtgccttctgccttctgccttctgccatgattgtgaggcctccccaggcacttaaactgtgagtccattaatcctctttttctttataaattacccagtcttgggtgtgtctttatcagcagtgtgaaaacggactaatacataagggctcagaagggccaactggatgggcaaagaagccattggtgactttagtgagagcgactttagtggaatggtgggggggcaaaagccagattgcagatgattaaggaaacagttggaagacaaggaaggcaacagacatagattagccatttgctgaaggttaactgggaaaagaaggatggaggaaggctataccgggggctgcagagtgcagatgtgcatgtgtaatatgggagggagctgagggtttatatgctgaggggtaaaaggtgggatggagtcaggattgaaaatgaggaagagaggccaggtgcagtagctcacgcctgtaatctcagcactttgggaggccgaggcgggcagatgacaaggtcaggagtttgagaccagcctgaccaacatggtgaaaccccatctctactaaaaatacaaaaattagccaggtgtggtggcacacgcctataatcctagctactcaggaggctgaggtgggagaatcacttgaacctgggaggcggaggttgcagtgagccaagatcatgccattgcactccagtctgggtgacagagcgagactccgtctcaaaaaaaaagaaaaaaaaaaagaaaatgaggaagaggccagacacgggggctgacacctgtaatctcagcactttgggaggccgaggcaggcagatcacttgaagtcaggagtttgagaccagcctggctaacatggtgaaaccttgtctctactaaaaatacaaaaattagctgggcatggtggcaggcacctataatcccagctactcgagaggctgaggcaggagaatcgcttgaacctaggaggcaaaggttttagtgagccgagatcacgccactgcactccagcctgggtgacagagcaagactcggtctaaaaaaaaaaaaaaaatgaaaacaaagaaaatgaagaagataggggctctacatgaaccaaggatcctagctggttattttgattaaaagatgactcaaatgatgttaacactgatcagactttagcacgagagctgcagagaaggaagacactatgatgagaatatatttggggttttgagctgggaaaagacttcttaaatatgatccagaaagtactggccataaggaaaaaatgttaacagatttgtctgcaccaaaatctaccaagagagtcctttcaactagaactgccgtcaccacaatgatgaacatggggaaagaggagaggtacctgctgtatattctcaggccttttagaacacatggagttgttcctctggccacatccacacgaacctacaagaaaggagatgttatagacgtcaagagatgccccacggatgttaccaaggcaaaaggaatgccccacagatgttaccaaggcaaaagaggaagagactacatgtatctagtatgctgttggcatggttggaaacaaacaacagcatgattcttgccaagagaattcatgtgtgtgtatggagcataccaagcactccaagagctgggaaggccttcagaaacacgtgagggaaaatgatcaaaagagaaggaaacggccaggcacggtggctcacgcctgtaatcccagcactttgggaggctgaggcgggcagatcacctgaggtcaggagtttgagaccagcctggcccacatggtgaaaccccgtctctactaaaaatataaaacttagccgggcatggtggcgcgtgcctgtagtcccagctacttgggaggctaaggcaggagaatctctagaacctgggaggcgaaggttgcagtgagccaagactgcaccactgcactccagcttgggcgacggagggagactccatctcagaaaaaaaaaaaaagagaaggaagccagagagtacctgggttcaactgaagtgccagcctgctccagccagagaagcacaatttgtgagaacagggaaaacgaacccaagctgctggaacccaatcctcttgaattaatggcttcataggtattaaaaaaaaaaaaaaaggccgagcgtggtggctcacacctgtaatcccagcattttgggaggccaaagcaggaggatcgcttgagcccaggagttcaagaccagcctgggcaacatagggagactcatctctacgaaaaataaataaataaatgattttaaaatggcacaaaaaacaaaccagacccctggactgttaaaaaaaaaattgattgttctacatcaaaataaatgttctctaactttcatgtgggcaggaaccatatggagaccatcttaaaaacacagatccccagagattgtaacacagtaggtctggggttgggcccagaaacctgaatttttattatttttttgagacagggtctctgtcgcccaggctggagtgcagtggtacaatctcagctcactgcaacctctgcctcccgggttcagtagattctcctggcctcagcctcccgagtagctgggactacaggtgtgcaccaccacacccggcaaaagtttgtactttttggtagatactggctttcactgtgttggccaggctggttttgaactcctggcctcaagtgatctgcccgccttggcctcccagagagctgggattacaggcgtgaaccaccacacctggccagaaacatgaatttttaacaagcatcatagtgaattcttctgtcattggttctatgttttgaataactgctagagaacggccagctgaggtcctagtaagtgagaacaaatcagtcaaccaaccaatcagcaccacccccttccggaaaagtcccaagcatttgacaaagatttgtcacctacaactatctgccactgtgtgaagagggctactttaaatgaacccaagtcttggtaagttttcttgagaaaaacagaaacaggtacaaaatgaaaacaactggggattaagtaacagtcatgaaggcagtgatcatttaaataggactggaatgggtgggcttggagccaggttgcacaggtttgcaaaagccaattgttaaattttcagaaattttgtgagctggaggctaaacaaaaccattgttaaaaattaaattgggccgggcgcggtggctcacgcctgtaatcccagcactttggggggccgaggctggcggatcacgaggtcaggagatcgagaccatcctggctaacacggtgaaaccccatctctactaaaaatacaaaaaattagccgggcgaggtggcaggcacctgtagtcccagctactcgggaggctgaggcaggagaatggcgtgaaccccagggggtggagcctgcagtgagctgagatcgcgccactgcactccagcctgggcaacacagtgagactccatctcaaaaaaaaaaaaaaaaattaaattggataaacttacaattaaatagattacattaagaaaagatttttaaaactctcaacacattgcattctaatttcttttctttttctttttcttttttttttgacatggagtcctgctctgttgcccaggctggagtgcagtggcatgatctcggctcactgcaccctctgcctcctgggttcaagcaattctcctgcctcagcctccgaagtagctgggattacaggcgcccaccacctcgcccggctaattttttgtatttttagtagagatagagtttccccatgttggccaggctggtctcaaactcctgaccttaggtgatctgcccgccttggcctcccaaggccaggtgtgagccatcgcacccggccctaatttctttactacattttactatcaggtgtgctcctcaggttatttttgtctatcttatctgtaaggtggaaatactatgtagcactgtgctcctgcgcctctccttccaactcaggttgttggcttgaaaccaggcaccgtggaagtatttataccagtgaaattgggaaaggcttacaaatcaatgctcctcatcccttttttggagaactgattgttacatgtttaccagaacaccactgaccatggtccttaaagtaattaggctgcacacggtggctcatgcctgtaatcccagcactttggaaggccgaggcaggaggattgcttgagcccaggagttcaagaccagcctgggcaacaaggtgagacctgtctctataaaaaagttaaaaattacctgggcgtggtggctcgtgcctgccctctcagctactcaggaggctgaggcaggaggatcgcttgagcccaggacgttgaggctgcagtgagctgtgatcgcatcgctgcactccagtgtgagagacagagcaagacccagtctcgaggaaaaaaaaaaaattagaagagtaataccagcagtaagggaaatcgaagcacatactatctgcttgtattaatgtattcatcccccagcagcagtgtgcaagaggacagtaagggtggaggtgtggatgcttaacccagtctttttgcacccatagcctcttcaagttccttcaaaattttgcctgggtggcttcagctgaaagcagaaatggcaggaagtaattgggggagattcccaaatctatgcccaactgggaatcaaatttttctcttgccaagagatgagctgaggtgagtgaatgacgccatctagtgtcgaagaacaggttggctccaaagagcaatgattagcaaaagatttctcttgatttgggccctagaaacacgacttccataatttcttcttcctttcttttcacatattttctttcctcacttccatgtctatactgagtcaattcttaattattcccccaataaaaacagcctttacttttttttttttgagatggagtcttgctctgttacccaggctggagtgcagtggcacgatctccagctcagtgcaacctccgcctcccgggttcaagcaattctcctgcctcagcctcccgagtagctgggattacaggctcccatcaccatgcccagctaattgttgtatttttagtagagatggtgtttctccatattggccaggctggtctcgaactcctaaccgtgtgatccgcccgcctcggcctcccaattacaggtgtgagccactgtgcctggccaaaaaacaggctttagtttttaaaaaaagatctcaattttgcactgctaccaggcaaaaatcggtaatgccaagagttgaatggcataggaatgtacacaggtattatgtgtaataatttgcagtacatttgcttagggaagttgtaaacattttctcttgtgggccatataaatcaaatgtttctctgccttcccacatgtcctgtatccaccgcattttcccagacagggcagatgaaagtggttttgttagcatgttatagtctaacaaacaatcctaactcattctcaagttttattctgcttaatggaaaatggtagaagaaaaagcctttgcataactacccagtgaatgggagatttcattcttttccataagttgagggctatttcctgttttctttttcatttttttttgagaaaactaacccttcattgagatatttttaagtcgaatatctagtataaaaagtttgcattgtttcagcttgttttcatttaaacctgtggttgtctttcatctgcttctggcaattttttttttttttttttttgagacagagtctcgctctgttgcccaggctggagtgcagtggcacaatctcggctcactgcaacttccacatccccagttcaagcgattctcctgcctcaacctcccaggtagctgggattacaggtgcacaccaccacgcccagctaatttttgtatttttagtagagatggggttttaccatgttggccaggctggtcttgaactcctgacctcaagtaatccaccagcctcgacctcccaaagtgctaggattacaggcatgagccaccacactccgcctacttctccattgaagtgctctagttttggtaaaatcttctccttgacttcaggaccctctccacatttatccccagtctataactcgcatatttcgtgttttcaaacagaaaaccgtaattcaggagtgaacagcatcctctgtaaggtgtcacaggagcagcctgaaatccattaggcagtcattctgaagctgtggtgaaatcgaagggaagctaatgttgcagctaggaagatgagatccaggctgaggatcacactttttccagaatacttttttagtgtttccaaagccagcaaaagccgtttagaagtctcatctccagaatgccagaatacacaaatgtaaggctttattttaggggtgggccctgggttttgcagtcaagtcagccgctatttgtatgagcaagacttcatcggtagcactactgggctccccctcttctacatgatggcagcaatttggccttagaaaatatgcctaagtgactccacaggctataagctattttcttcataagtagaaatggaagatttctgttaggaaggtagaagtcagttttgtccgtatgtgggccaaactattaaaaataataaggcctggggattcctatgttcttagatgctcaataaacatttcagttcatcaaactatgaccaacttacaagtctgtggcattgtgctagttcactggaccctgggaaagtcttttaaatccaaatgatactttttgttttttaaagagacaggattttgctctgttgcctaggctggagtgcagtggcatgtgatcacagctcactgtaaccttgagctcctgggctccagtgtcctacctcagcctcttcagtagctaggactaaggcacatcccaccacacccaggcaattttagaattttttgtagatggctcttactatgttgttcaggctggtctcttactcctggcctcaagtgatcctcctgcctcagcctcccagtgttgggactacaagcaccagccactgcccccaaccctgcattatgttcttaaaggcagacctgaatcctgtgcggtgtcaattcaggtgtgcactggcccctgagccttacatacaggacccgttccttaggatgacgttgcgttcccttgcttagagcctcagcaccatggcacctggctctcccccgatgcctgggtcttgctcttgcccatttcctagccagggtttgtggtccaggcaacctgtcacatcagtgtgttccaaacatggcacccagatctcaaaagcttcttcaacgctcccatggtttgggatacacctcaagttttaacttacgtacttcaagtttcttttattcaattagatacaaaccgtctgacttttggcttctgaaacaggaaagtcaattttgttgttttcactgtaccatgcttttttatctcagaatcttgatgaactctgaaatgacccctgatgggggcatgcctctatttatgctgaataagagccattttacattttactacaggttgagtgcccctaatccaaaaatttgaaatgctccaaaatctgaaactttttgagcacttacatggtattgaaaggaaatgctcattggaacatttcctattaggcatgctcagccgttaagcataatgcaaatattaaaaaaaaaaatttcctaaatcttttaatacttctggttccaagcatttcagataagggatactcaagctctacctattcccaaattcccactaactagctctttggcaggtctatggaataaaaatcgatgcttctgattactttaaggcattataacctcatgaagtggtttctgagatgcaactgagtttttgtgctattttattgtattcttatatctttgaagatgaataatccacgtagtgcatttgagaggttctatctgttcaagagaggaaatttaatatccgtgactactgtatgtcaaatgatttagtgccttatttaatttgttcctctaggagtcctgtgcacttatcttgggggaaacattgttccattcttagtaacatgcctgtttggcctgtggtctgaggtacttacaacttgctgcagtgtggtaaatgtgtcccttttgaaacactgttctggggacttcagagatgactgactgcaacctaccacctcataaatgagggatctgaggtacaaactggaacccgggtcttctgggctcagagaactctcctcactacagcagactgcctgtttccatttaggggaatgagatgctctttcataaatgataccaagtgcaagagaacttaaggcagctccaatcgaagactgtcttggctgcttctggaaactacagatcactactcccgaagtcaaaaacgactagaacacagcttaaaaatcaagccatttaattgtatctttgaaggtaaacaatatatggagctggatcacaacccctgaggatgccagagctatgggtccagaacatggtgtggtattatcaacagagttcagaagggtctgaactctacgtgttaccagagaacataatgcaattcatgcattccacttagcaattttgtaaaataccagaaacagaccccaagagtctttcaagatgaggaaaattcaactcctggttttagagataaatgaatgaagagtaccaaaatatttgttgacttctcttcatttttctcatacaatctgaagcctgagctgactatcatatccccaactcacagcagcgaaagctgcagttcagatttgagatcagtctccattcacttccacgtagcaccacagcaagagtgaccggaggcagagagctcttgttgggtcagctttctaataagcatgtcaagtgaaaaagaaccctctagcagcacactgatttagtttgtaagattttaatttacaaattaaaaaagctatttaatacatgttttactttttctcctttttctcctctttctttacatcactcttttccttatctttatctttctccttgtcctctttcctatcctttttgctctcttctttctcctgcccttctttcttctctgcatcccggttggcaatcttgttgttgatgaggttgtgcagggcgaccacggaacggatcagcgaggccaagtacactaccaccatctggtcattggtcttcaggtaaaaggccttgacgaactcctgcaggctgacatctggcagcaggttgaagacgtcctgcagctggtagatgatctggtggttgatgggcagcttgcctgtggcgactttttccaggtagctcctgatatccagaagcttggagttcagtcccttcaaaccatggacctggtttgtgatccgctgggacagagtgcccaccgtcgtgtctttgatatctctgtaataacccacagttaaaaagggcaggaaaaggcatcagggtaccatgttatcaggcaagttcttacattctaagaaaattcctagctttgttgggtgaggcaagtttttaaaagaaaaatgtcacttccccatttgataaagatttcgttatcaattaccttaatttcgttatcatttggaacacattttatctttctcatcacaggacatttttcaaaaaacaattataaaagggagctaaaataaaaccatttccacttaaggaaaaaaaaattgcttaggtcaacagttcagatctaccaataactttctgggtaaccttgtactgaagctgtctctctcagctttcctgttcctaaaaggatggcattttctctacatgcatctccagaatattgagaagcttaactaagatggtaatttttagaactagaaggaacctcattgactgataaaactataacctttttcaaataaggattataatagatataggattttaaaacaaaagctactccaagatgaagattctctccagaaaatgggctacatttgttgagaaggacacctagtggagagtgcaggcctgcatttatttcatacctctcttcccgtcagtcaacattatagtttccagacaaggtatgctatccacaaagtcataaattgtaactcaagacattttacagttgatgtagttcaaacacttcaatttacagacaataaaacaaaggtctggaaagggactgtgatttgctcagaatggcagacttgttagtggacggccaggacgagaccccaggtctccatattcccgacacagacctcttccttacactgtgtgacctctcgggcagtgaatgattttgatgctgtactagggtctcaccgtaacaagtgttcaactccaacttcctcagcttcctctgctccaatttcactggtcacgtgttcaaatgttttcgaggttggagttccatcctgggagaggaagcctaactataattatttattttccacaaacgaactgacatgtgttccttttcgcaccctgagtcttttgctttaagtcagctcatttaatgagtgcatgactgagaattttctatggcaagggtgggtaaggcttactttgaaagcttagccttcaaagctaacatcactgtggtgctgctcagtgatgcagtctgctggggcactgtgcgttgagaaaaatctggaaattccctcaagcccacacttggcatgaacgcacagggaggtctcaggttgattcttaaaagtataccgctttggccaggcacggacctgtaatctcagcactttggtacgccaagaattcgagaccagcctgggcaacatggcgaaaacccctctctactaaaaatacaaaaactagccaggtgtggtggcgggcgcctgtaatcccagctactctggaggctgaggaacgagaatcacttgaacctgggaggtggagggtgcagtgagtcgagatcacgccactgcactccaacctgagcaacagagtgagattgtcttaaaaaaaaaaaaagtatatagttctttctagaatggacaatatacagaatatctgtactgaagcaagttcatgccagaaaataaaacttttagcccttttttgtctcttggatcaaacgattccacagtgcccaaaccaatgcaatcagaatagttggctttctggtggtctgaattaatcaaaggatccattggggacatggttcatggtggtcacccagtgacatcctgaagggacttcgaagatacttttctcagaccttgtgccagaagaggctgtacgtctcctgtcaaaaggctgtaaactgtctgtaagggaggaaggacagcatagtggtaagagtacaggctccacagccaggctacctgggttcaaatttggctctgccatgtatgtaataggcgagctccaagaccttgggaaagtcactcaactcacactaagtactataaaagttagccgtgattatttt

SEQ ID NO: 15145 - DNA, 8920 bp, Human
  misc_feature (1)...(8920): n = A,T,C or G
agagctggggtcgtgcctccagctgggcaactgcctgtctctctgggtgcctgggtttgctttcttgggcctcggtttccacttctgtagagtggggtgatagtccagcacttcccctgggcgtgtgaaatgtccagcactgccaatattcgttgctgttatcttcggagaacagtgaggggaaaggaatccttgcctgggctgggccaggcaggaggctgggggtcaggacctggaagaggcttccaggtgaggcttggggtggagcctggtgacgaaagcgttaagcccaaactcggtccctggaggattagaggatgatctttaagtccccagctgtcagccctgctcagagcgacagtcctggcagccaatcagatgcgaggacggctgcgggttgcgctcccattggtttactccacccctggggtagcggagcctctttatcgagtgactactgtttgcctcgctctaatcagagcttccaggaaccctgcgctgtgggataaaggaatgaggttcagaaaggggcagggagttgcccgcagccgcaccgcacgtcttcagcccgaccgttgtcctgacctctctgtcccgtcccctgcccagtctcaccatggccttctggacacagctgatgctgctgctctggaagaatttcatgtatcgccggagacagccggtaacgccccagtgtgagaccagggccgggtgggcaggcagcccccactgtcccccaccgtctcccacctattctcccccaggtccagctcctggtcgaattgctgtggcctctcttcctcttcttcatcctggtggctgttcgccactcccacccgcccctggagcaccatgaatgtgagcccccccagggaccaggcactttgtgtgtgtaggggaaggcagatggctcacccgtgcacaggaatcccccgtgcatgtcagggagccttcaccaggccgccaatacatggcatgggagtgagctctccatcgctggaggcatgcaagcggtgccgggcgacccgatgggggtggagtcaggcagagtccacagggcctcagcaccaggcgtctccccgcaggccacttcccaaacaagccactgccatcggcgggcaccgtgccctggctccagggtctcatctgtaatgtgaacaacacctgctttccgcagctgacaccgggcgaggagcccgggcgcctgagcaacttcaacgactccctgtgagccagaggcagtgggtgcggccggcctgcaaactcggggctgcagtgccggccggaaccccgcctcctgccctctctctgtccccagggtctcccggctgctagccgatgcccgcactgtgctgggaggggccagtgcccacaggacgctggctggcctagggaagctgatcgccacgctgagggctgcacgcagcacgggtgaggaggccggggggcctctggcagggctgagctctgagcctcaacttgccgggccgtgaaatgggcacagggtgggggtgggtgcctcagaccaacgtccccccagccccatgctcccgtgcgctcctcccccagcccagcctcaaccaaccaagcagtctccactggaaccacccatgctggatgtcgcggagctgctgacgtcactgctgcgcacggtagggtgtcggggcgggaccgcgctgacttcctgggacactgcactggggatgtcctggcactgccccaccccgggccaaggacctcccgttccaggcatccaggctgtccctggtctctgcggtgatgctgcttgtccgtctgggcccccagacagagtgtgtctgacccagtgaggaagactcgtctgtgagatctccaatgagtccctttgcctctcagagcctcagtttccctatttgtaaagtgggggctatgatagtatggtctgcctgggaactggccagagcgctggacccctagtgagtgttcaaaatcattgtcccccttgtggtctttctccccaggaatccctggggttggcactgggccaagcccaggagcccttgcacagcttgttggaggccgctgaggacctggcccaggaggtacgaggccccactcatcctcaacccccatggaggcaacgttggcaggcagcctgcgccgggagggtctggggcagcccgggcacttcccttgggtgggttttcaggaggattagacagcgagagggagaggctgcccctggcccagtgccctgccctggttagggcttggaggtgggatcattgccagctccgtctggtaacctctctctagctcctggcgctgcgcagcctggtggagcttcgggcactgctgcagagaccccgagggaccagcggccccctggagttgctgtcagaggccctctgcagtgtcaggggacctagcagcacagtgggcccctccctcaactggtacgaggctagtgacctgatggagctggtggggcaggagccagaatccgccctgccagacagcagcctgagtgagtgactgacctcggtttcccctcttgggaagtggaactctgggcaggggggcagggcctcatggcacccccatcccaggccccgcctgctcggagctgattggagccctggacagccacccgctgtcccgcctgctctggagacgcctgaagcctctgatcctcgggaagctactctttgcaccagatacaccttttacccggaagctcatggcccaggtgggggcagcctggatgctggggtgggagggtggtggccagagcccatccagtaccctcagtccaggtgggccagggccaggccggagggtcacggaaactatttgaagaagtaggagttagccgatggagggggatcagcttgtgcggaggatcagaggcacacgcaggagcaaggcagagggggcagggggtgggcaggggtcctcagaggaggagagggtcatcagtggagggggtgctgtccacaggtgaaccggaccttcgaggagctcaccctgctgagggatgtccgggaggtgtgggagatgctgggaccccggatcttcaccttcatgaacgacagttccaatgtggccatgctgcaggtgtgcgggggtgctggggaggtgggatgtggctccccggtgaggagggtagacaggcccggtggatgggaaggtgggctccgtgcagacccccacttttttttttttttttttgagatggagtctcgctctgtcgcccaagctggaatgcagtggcgtgatctcgactcactgcaacctccacctcccgggttcaagcgattctcctgtctcaccctctgagtagctgggactacaggcgcccaccaccacgcccggatgattttttttttttatttttagtagagacggggtttaaccatgttagccaggatggtctcgatctcctgacctcgtgatccacccgcctcggcctcccaaagtgctgggattacaggcgtgaactaccacgtcctgctttttttttttttttttttttttttaagagatggagtctcactctgttgcccaggctggactgcagtggcgagatcttggctcactgcaacctccgcctcctggattcaagcaattctcctgcttcagcctcacaagtaactgggattacaggcatgcgccaccactcccggctactttttgtatttttagtagagatgggctttcaccatgttggccaggctggtctcgaactcctgacctcaggtgatccacccgcctcgcctcccaaagtgctgggattacaggcatgagccactgtgcccgacccagactctcactttcacctgcgccccccagcggctcctgcagatgcaggatgaaggaagaaggcagcccagacctggaggccgggaccacatggaggccctgcgatcctttctggaccctgggagcggtggctacagctggcaggacgcacacgctgatgtggggcacctggtgggcacgctgggccgagtgacggaggtgagggcctgtccacctgcggggtctgtttcagtggggagggcaggtcccatcctagtgttcccaccctggtgttcccagggggaggcgggcccggccctagtaagagcctgggatttgtagagatctcaggagggagccggccgtgggcctacgaggggaaaacatggcccagccccgaggtccagggggaggagcggagtggtctaggaggcaggcggaccccagcgcctaggactcacccccgcatcccacagtgcctgtccttggacaagctggaggcggcaccctcagaggcagccctggtgtcgcgggccctgcaactgctcgcggaacatcgattctgggccggcgtcgtcttcttgggacctgaggactcttcagaccccacagagcacccaaccccagacctgggccccggccacgtgcgcatcaaaatccgcatggacattgacgtggtcacgaggaccaataagatcagggacaggtcaggcgagggagggggcggggggatgagggactgggcggggccaagagcgtggtgggtggggccaggcagcattcagcctattggagaccatgatagacaggatctgggctgtatcaacagtggtatggtagccagagcccggggctccttagaccaataggggcccgtgatgggcggggcctaggtgcatgaggggcgtggccatgggcctgagataagatgagagcaggtataggttgagggcaatggtgggcggagccaggtgtattattaggtccctggaataagggtggagctaaaattgcaccgggtgctgagcgcagtagatcttgcctgttatctcagaactttgggaggccaaagtgggagaatctcttgaggacaggtattcgagactagcctgggcaacatagtgagaccgcctcccccccgcccccctcccccaccaacctcacgaaaatatctttaaaaattagccaggtgaggccgggcacagtggctcacgcctgtaatcccagcactttgggaggctgaggcgggcggatcacgaggtcaggagatcaagaccatcctgactaactcggtgaaaccctgcctctactaaaaaaaaaaagtacaaaaaattagccgggcgtggtagcacgcgcctgtaggcccagctacccaggaggctgaggcaggagaatcgcttgaacccaggaggcggaggttgcagtgagccgagatggcgccactgcactccagcctgggcgatagagcgagactccgtctcaaacaaatgaataaatgaataaaattagccaggcgacttgggaggccgagctggggggatcgtttgatcccgggaggtcaaggctgcagtgagctatgattgcagctcttcactccagcctgggcgacagagcaagaccctgtctaagaaaaaggttattcagggtggggccccgggagtttctagcccttccctacaaccggccaccatgcccctctcgcaggttttgggaccctggcccagccgcggaccccctgaccgacctgcgctacgtgtggggcggcttcgtgtacctgcaagacctggtggagcgtgcagccgtccgcgtgctcagcggcgccaacccccgggccggcctctacctgcagcagatgccctatccgtgctatgtggacgacgtgtgagctctggcacccctccccgctcttccccgcggcgggaaggtcccgggtgtgggggtgggcccaggctctgttgggaaccttcctgcggtccaggctgcgaactttgcacctttacaccactccacgtgacctgctgcagcgggaggagcaggggactctgagggtctggtggggggggggactctgagggtctgggggcccccggcgcagggacagcctgggctgcactgatgcctgagagccaaaggctggctggatcaggttccaaggaacagggaggcaaatcttcccgccttgagatcccgggacacgaaccagtcgtgccagatggtgggcggagggggggtctgcggagggtctccagcctccaccccagccgtccccaccccaggttcctgcgtgtgctgagccggtcgctgccgctcttcctgacgctggcctggatctactccgtgacactgacagtgaaggccgtggtgcgggagaaggagacgcggctgcgggacaccatgcgcgccatggggctcagccgcgcggtgctctggctaggctggttcctcagctgcctcgggcccttcctgctcagcgccgcactgctggttctggtgctcaaggtgggcgcgcctcggcctgcccggctgcagaatgggtgcgctggagggtgacagacaggggcggccccacgtgggtgcgcgcccccaggccaatccaggagctgcaccctaagctcccgttgcctctcacagctgggagacatcctcccctacagccacccgggcgtggtcttcctgttcttggcagccttcgcggtggccacggtgacccagagcttcctgctcagcgccttcttctcccgcgccaacctggctgcggcctgcggcggcctggcctacttctccctctacctgccctacgtgctgtgtgtggcttggcgggaccggctgcccgcgggtggccgcgtggccgcggtgagagccgggtcgggcgtggatgggggacgccccccgcttcggccgctcactgaccgcccgcttttccgcagagcctgctgtcgcccgtggccttcggcttcggctgcgagagcctggctctgctggaggagcagggcgagggcgcgcagtggcacaacgtgggcacccggcctacggcagacgtcttcagcctggcccaggtctctggccttctgctgctggacgcggcgctctacggcctcgccacctggtacctggaagctgtgtgcccaggtgggccgtagggggcggggctccgggccgggtcgcacctgctttgcgggaggctgagctaggggtgtggcctccaggccgtttgggggtggggggtggcttattcccttggagagaaggcggggcttcttggcacacgcatgcaggtggctgcattggaggggcggggcctgaggcaggtgggcggggtttctgggccgcctcatacctggacgccctgattccaggtgtatggccagaagctggcacagtcgccgggcgctgtggctcacgcttgtaatcccagcactttgggaggccaaggcaggagaatcgcttgagcccaggagtttgagaccaggctgggcaatatagtgagacctcatcaatacaaaaagttagctgggcgtggtggcacgctgggcgtggtggcacgctcctgtagtcccagctactcgggaggatggggtgggaggatcactcgagcccaggaggttgaggctgctgtgagccgtgatcccaccagcctgggcaacagagtgagacctccatctctttaaaaaaaaaaaaaaaaaaaaagctggctgggtgcggtggctcacgcctgtaatcccagcactttgggaggccgaggcgggcgggtcatctgaggtcgggatttcgagaccagcctgaccaacatggagaaaccccgtctctactaaaaatacaaaattagctgggtgtggtggcgggtgcctgtttcctagctacttggaaggcagaggcaggagaaatgcttgaatcccggaggcggaggttgcggtgagtcgagatcgcgccactgcactccagcctgggcaacaagagtgaaactcagtctcaaaaaaaaaaaaacaaaaaaaaaaaaaacaaggccgggcacggtggctcacgcctgctttcccagcactttgggaggccgaggtgggcagatcacgaggtcaggagatggagaccatcctggctaacacggtgaaaccccgtctctcccaaaaatacaaaaaattagccaggcatggtggcgggcgcctgtagtcccagctactcaggaggctgaggcaggagaatgacgtgaactggggaggcggagcttgcagcgagtcaaaatcgtgccactgcactccagcctgggcaacagagcaagactccgtctcaaaaaaaaaaaaaaacaaaaccccaaaaaaagcctggtacactcctggggggtgggctaagcaataacccgcgcccctccccgcaggccagtacgggatccctgaaccatggaattttccttttcggaggagctactggtgcggacctcggccccccaagagtccagccccttgccccaccccgctggacccaaagggtgaggccctacgaggcttaatagctggttgtccacatatgcccagttcccccccaaaacgagattccacagatgccaatgacaatgacctggacaccccaaccctcacacctgccctgaagacactgcggtccccaagctcccgcagcttttataggccccggcccagcaggtcccggattccacagcccagctctgagggacttgcaggccccaggacccccatgacctccatggctgagtccaccccatctctgcagtgctggtagaagaggcaccgcccggcctgagtcctggcgtctccgttcgcagcctggagaagcgctttcctggaagcccgcagccagccctgcgggggctcagcctggacttctaccagggccacatcaccgccttcctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15146 - DNA, 91279 bp, Human
aaatacaaaaattagctgggtgtggtggcaggctgctgtaatctcagctacttgagaggctgaggtgagagaatgcttgaacccaggaggcggaagttgcagtgagccaaaatcatgccactgcactccactccagcctgggcaacagtgcaagtctcaaaaaaaaaaaaaaaaccaaaaaaacaggcatggtggctcacgcctgtaatcccagcactttgggaggccaaggtgggcggatcacctgaggtcaggagtttgagaccagcctgaccaacatggagaaaccccatctctactagaaatacaaaattagctgggtgtggtggcacatgcctgtaatcccagctactcgggaggctgaggcaggagaatcccttgaacccgggaggcggagcttgcggtgagccaagatcgcgcaccattgcactccagcctgggcaacaagagcaaaactccgtctcaaaaaaaaaaaaaaaaaaaaaaaaaaaggctgattccattactctttcctctttcctccctgctttcactttgccgttcaaaccaaatccttcttgattagctcagcaccaagtactggctccctcctcagccatccctatgtgtagttcagtggcacttggggccaactgcttgtcttacagattaggcaactctagattacaaagcactgaaagcaggggcttcatctggttggtctttgaccctgcagagccccttgcacacaggtgatgctcaataaatacttggtgaaagcacaattcattttctgtgtttcaatgggcttcttttctctatagaatcagatgcttggttattctcacctcagcgctattttgttggcttccagaaggcacagtaacgctaggtgtgttgtgttctatcctttaattggaagagctttgggaactgaaaaataagaattatttctccaagcctcatcttctgccactcccccgtactcaccggcctcatacaggaattgaactacttagcactgcacagaacacgactttctctctcacgcctccgttcctctgtacttagcctctgtacttacgtgccattccctttccctgaaatgcccttactctggcttctctgcctggcaaattcctactcatcctccaagactcagatcagacatcgccgcatcacatctgtgaaggctcttctgcaatgggcagtgtagcagtaccccctccatttttttagcttcctcagcaaactccaaataattataacagtacttatggcattatttgtttatttttcttctacttcctagaccgtgaattccttaagggccaagatttctgttctatccccagcacagtgttcggcctatattggagaatccggtccgtacaaactctgcagtgattcaatcaatgagcaaacaaactcaccaatcattcaacacagcagagtttgtacggaccggattctcaaatattttaagacctggtcctctatttggagtgcttcattctggaagatctcttcctcccccaagcccctacccatccaactgcctaggtttggtagaagaggaaaataaagtgattagacgggggaagagtccttcagggctaagctgtcatttacccgctctggcaccgagagggttacggcgacccgggggcggagccgtgcggaggccacctgctgcggggaggtctggcgcatgcgccctgacacctagctggttccctacccgcaggggcccggctgaggaggagcgcttgcgctctgggccttttccgccgggggaagtctcgcgggggcggggcggggcctcgtggagaagttctcgcgggacaccgacggggagcggaagccaggaggtattgctgcttcggcgaccgggcggcggcagcggcggcggcggctgtggcagagtctgtgcctgtggcggtgacggcggcgggagcaagcgctgccctcgcagagcagccttggggtcgccggccgctcgcagcgttgtggaggggcgggccggacgctgagcggagcagctgcgccacggtgagtacgggaggctgcgctcggcgcctctctcgtgccttttcctcttggctctacagcgggagtgggccccgggggaaccgggaccggccccggggttcgcgtcggggcggcgaggcttgggacgtggagcgcaatccccggggctccggactctacgtttccccttttggggcgcttccttcctggggaccgtcctcctccggctcttggctctgggcagtccgggggaagaggtcggggttctctggcgaggtcccctgccttcatcgggagggtttgcacggaaggggcccgggaagcccaggcgggccgaacgccgaccgagtcagtctacccgagcctggcggcgggggactggtgtgggctgcagctgtggtgattgatgtgccttcgacctgcacggcaaccacgtcaccatctcctggcgtctttgggcttaattttgtgcgggaatccactttggggtggaacgtttgctgctggagccgggggagatacctttattctgacacttaaaaaaaaaaaactatttgaaaaatatttgtcaagaaaaattcagcagtagcaggttggactgcaccgaggaaggattgcggcgagagcgggcgctggtaattttcatttgcagcgcgccctctctatgattgtaagccacacatgagttatggcttgtttagaaagtttttcaaggctggcttcaaacgctgtgaaagtgcagtttgcaggggactgaagtgcacttgaggtctgtctctttttgatgctgttgactttccgaaatgtcagacacatgagagaaattagcattagtctattttggctttcttactcctctttctccagttatttccttccttctctatctgcttctgtcctttccactagggacacgaaatgcttgtgtaatgcaagtcatttgccccttcctccccccacccccccctttttttctaatgtacttccccttcctccttgtagtccccactctggcgtaatttttcgaggtttcttccctttcgtgctgttcgttttctctcatttcaagattccgtctttttcctcgggaagagactctctttccttgctttcgttcctttacttttgcgcgtcccctgcgttccctgcagtcagccagaagggttgctagagagccgtgggaggctgaagtcccctctctgagaacggggaggctcaaaagattgaattcatccctaagaaatcagtcctgccactaggtcgcaagtgtggtttgcttgtattatttttgtcttttactctttttcttttaagattatgcttctgtgcctgcttatgttttcttctagtatgtctttataataggaagattgggtcagctcagtgactttttttttttaggcagagttttgctctttttgcccaggctggagtgcaatggtgctatatgggctcactgcaactctgcctcctgggttcaagcgattctcctgcctcagcctcccgagtagctgggatcacaggcgcccaccaccatgtccagcgaattttgtatttttagtagagatggggtttcactgtgttgcccaggctggtcttgaactcttgacctcaggtaatccacccgccttggcctcccaaagtgttgggattacaggcgtgagccaccgcgcccagccagagttaattcttataatcagctttcttctactaaacacaagcatttatttatttattttatttttttgagacggagtctcgctctgtcgcccaggctggagtgcagtggtgcgatctcggctcactgcagcttccacctcctgggtttaagcgattctcctgcctcgcactcccaagtagctgggattacaggtgctcaccaccacacctggctaatttttgtatttttgtaaagacagagtttcaccatgttggccaggctggtctcgaattcctgacctcaagtgatctgcccatctcagccttgggattatagacatgagccactgcgcccggcctgaactcaaacgtttaaatgtttgaggcactttacttcgtcagcaagttattcagatttgagaggcttgctgggttttaaatactactggttgatggtacttagagattcttctcagtaattgctgttatcatgttgcatgttgtccatcagagttctaattgttacacatacaacagaagaggaatggattttggagaaatgaagtaatacagaatagagagtcaccatgccctccggagagaaattaatacttgcttaattcagaggaactctccaccattactgaatggcttttgagagtctgtatatatatatatatttatatatatatatatttttttttggtcaaagttgcctttttcctagttgtgccaagtgaatacgcattattttctttttccttttttttttttttttttttttttttgagacagattctcgctcttgttgcccaggctagagtgcagtggcacgatctcgggtcaccacaacttccacctcctgggttcgggcaattcttctgcctcagcctccctagtagctgggatcacaggcatgcaccaccacgcctggctaattgtgtatttttagtagagacagggtttctccatgttggtcaggctggtctggaactcccgacttcaggtgatccactcacctcagcctcccaaagtgctgggattacaggcgtgagccaccgcgcccggccaatatgcattattttcatttcatgcaaggacattgtagtgcattatctggaatgcaaattttaaaatctggttaaggcatccttatggtatagcagttatttaaaatttagtatccataaaaatcactgggagatctttttaaaattaggttctggtagaactccaggatgtaccccacagtgaatcagtctctgaatgggtggattttgatacagatggtctaaggatcaaaactgttgttaccaaatgcagccataaataataagactgctgtgtggctttaagtaattcaacttaaaattacatttttctgtgtatacacaaagtcagtatttagaatagcctaatggaatgagtgactataagcatgattcatttttacatgtgtaaattttttagcattcttaatactgtgatgtggagtgatttaacttgaaatttatacttaatagggtcattaatttgcctaccagagaattcttctgagtctgtagactcagacgaaagatttttcagctttacagtggtgtgaaagcaatagcgctcagtaaaaactatacttccagtacccatataactgttttgtttttcactctcagtaccatagtcagtaaattacaggagatattcatcactttgttataaaatgggctttgtgttagatgattttgcttaactgtaggctaatgtgtttggagcacatttaaggtaaggtaggctaggctaagctgtggtgtttggtaggttaggtgtattaaaatgcatttccatgtaacaatattttcaactgatgatggtttcatcaggatatctgcctatgcagatggaagctccacatttactcttagaacatgtaggctagtatttgaaaagagactgaaaatactacttaaggtctctggcttatactacattataataataaaatcatcacagcccacactatagtggataattagttagctcagtcttttggagagagccagagacttctgccaagcagtttacaaccattatctcttttaattatcaaaatgactttataaggtagttggctgttattattcccattttccagttaagggatactagggattacagagtataagttacttctccagtgtcccctcattagtaagtggaaagtgacatttgaatccaagtctaactccagagcgtcagtaagctttttggtttgtgttgtaactacaaaagtaacacatgcctattgtaaaaataatgaaaatacaattgaggtgtatcatgcagaaagtaaaagtgttctgtgatctcgctagcagagataaccattgttagcctttttttttttttttttttttgagacggagtctcgctctgtcgcccaggccggactgcggactgcagtggtgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcgtgatccacccgcctcggcctcccaaagtgctgggattacaggcgtgagccactgcgcccggcctagcctttttttttaagcacatactgatgtattattttgccttacagaaataggataaactataatttttctgcagctttaaaaatttgaggagaatggcttgaacccgggaggtggaggttgctttgagcagagatcataccactgcactctagcctgggcgacagagcaagactccgtctcaaaaaaaaaaaaaaattgatatatcctggtatttatgtagatactccatacacaagctcatggatattgatcaagggtgtgggtgtatatgtgtatgttgcacattgtattttgtctcattgtttcagtgagataaatctgggaagtggaattgcttggtcaagagtatgtattggtcaggcacagtagctcacgcctgtcaccctggaactttgggaggccgaggtgggcggatcacttgaggttggagaccagcctggccaacatggtgaaacctcgtctttatttgaaaatacaaacattaaaaacacacacaaacacacaaaaaaagaaaattcaaaaattaggtggtggtgacacgcctggaatcccagctacttgggaggctgaggcaaggagaatcgcttgaacgcaggaggtggaggttacagtgagatgagatcacaccactgcattccagcctgggcaacagagcgagactctgtctcaaaaagaaaaaaggagcatgaggctgggtatggtggtatgcatgtaatcccagcactttgggaggccaaggctggtggattgcctgaagtcaggagttcgagaccagcctggccaacctagtgaaagcccatctctactaacagtacaaaaattagccaggcatggtggtgcacgcctatagtcccagttacttgggaggctgaggcaggggaattgctggaactcaggaggcggagattgcagtgagctgagatcgtgccattgcacttcagcctgggtgacagagcaagactccatctcaaaaaaaggagtatgtatttacaaaaattagccaggtgtggtggcacacacctgtagtcccagctacttgggaagctgaggcgggaggatggcctgagcctgggaggtcaaggctgcagtgagccaagatggcacccactgcactccagactgggtgacagagcaagaccctgtctcaaaaaaaaaaagagtatgtattaatatttcaaaattgtcggtcagggccgggcacggtggctcatgcctgtaatcccagcactttgggaggctgaggcaggcggatcacgaggtcaggagatcgagaccatcctggctaacatggtgaaaccatgtctctactaaaaatacaaaaaaataagccgggtgtggtggtgggcacctatagtcccagccactcgggaggctgaggcaggagaatggcatgaacctgggaggcggagcttgcagcgagccaagattgcgtcactacaccagcctgggcgacagagcgagactctgtctcaaaaaaataaataaataattgttggtcgggcgcggtggctcacggcctgtaatcccagcactttgggaggccaaggcgggtggatcacgaggtcaggagttcaagaccagcctgaccaacatggtgaaaccctgcctctactaaaaatacaaaagttagtcagtcgtggtggtgggggcatgtaatcccagctacttgggaggctgaggcaggagaatggcttgaatccaggagacagaggttgtggtgagccaagatcgtgccactgcattccagcctgggtgacaaagcgagactccatctcaaaaaaaaaaaaaaaaaagaaaagattgtcaaggccaggtgtggtggctcacccctgtaatcccagcacttggaaaggctgagatggggaggatcacgtgagtccaggagtttgagatcagcttgggcaacatggtgagtcctggtcaccacacacacacacacacaaaaattagccaggcatggtggtgtgcacctgtagtcccagctacttgggaggctaaggcaggaggatggcttgagccaaggagtttgaggctgaagtgaaccatgattgctccactgcacttcagcctgggcaatagagcgagactctgtctcaaataataaaagtaaataggctgggcgcagtggctcacgcctgtaatcccagcactttgggagggcaaagtgggcggatcacctgaggtcgggagttcaagaccatcctgggcaacatggcgaaatcctgtctctattaaaaatagaaaaatcagctggtcatggttacaggcacctgtaatcccagctacttgggaggctgaggcaggagaatcgcttgaacccaggaggtggaggttgcagtgagcggagatcacgccactgcactccagcctgagggatagagcaagactctgtctccaaaaaataaataaaaataaataaaagttgtcaatagattaccaaagaactcaccaaaaagactgagctgagctcattaattccttgctgtagtgtgggttctgtggtgattttattattataatgtaacaccaagccacattgtcagttagtaacttctcaaaatgttgagtcagtggacaccgggtagggtaaaaagtctttgtgcctggtgcggtggctcatacctgtaatcccagcactttgggaggccaaggcaggcagatctgttgagcttaggagtttgagaccagcctgggcagcatagggagaccccatctctacaaaaaaaaatgagtaggctatggtggctggtgcctgtagtccccactaaggaggctgaggtgagaggatccctggagcccaggaggcggaggttgcagtaaaccaagatcacgccactgccctccagcctttgctacagagtgagaccctttctgaaaaataaataaataaataaaagtgtgtttactcaaagtattgcagattggattttataaatatttttaaaatttgccaattagtatatgaaaactctgattgttttaatttgcatttcttttcatatgttttaaatagagtaacatttaaaatttcttttgaaggctgggtgcagtggctcatgcctgtaatcccagcactttgggaggctgaggtgggagtttgagaccagcctggccaacatggcgaaaccccatctctactaaaaatgcaaaagttagccaggcttggtggcgcgcacctgtagtcccagctacttgggaggtcgaggcaggagaattgcttgatcctaggaggcggaggttgcagtgacctgagatcgtgacactgcagtccagcctgggcgacagagctagaagctgtctcaaaaaataaataaataaataaataaataaataaattttgagtgattattacatgtcgggctctatccagagcacttaatgtatgttatatatgttgtctaatttaatcctcagtggatcttataaggtagatattctcattttacagatgagaaaactggagcttgtttcacaactttgcccacaactgtagctgtaagtgtgaggggcctgcctctagagaccatgaagattcaacactaagctatactggactgttgtcatgtattttattttctgtgaattttgggaagaagagagttaaatggaagaaagaaaaaaaatcttgcaaatacctttaggatagtagtttttttggatacagtagacattgtttgaaatgaatgattaaagctgtacttacctttcttaaaattcactgcttgggatgggctggtaacagtttcgaggttactctcattaggcttcagtgtttagtacactataccccattttcttgggaagtgaacagcaacatctactctgttaaaatcattatacattgtgtctgctttcagatttcttccttttagtaattagtgttgtgtatgtgttagatttttttttgtctttactgaaacacaccctttggaattcctttagcgaatatgctcttttgggtggataacctaataagctttcctctttgagttttctgtttttttactcagcacagccatggaagtagggatttaattttctgtcaaactctgcatctcacaaagcaatagttactcaaaacacgactttcaagaaggttattctttttaagctttcagcagatgagctgagtagcagcaggaaagcaggtattgagaactgtcttggtttttgtactgctgttgagtagtaacattgcagctgtcttaaatcctgaatgacacagaagcttatggctggtcgtactacatagcaccttgaaagtgacagggcttttcatttctatctgatttctgtttttcaaaaataaaactccttattcttttcctatcattgtaaatattcttcagcttcctatcactaatacatagtctcggcattagagaccagttaaaataaataggctgaggaaaatcttgatagtaggagagattttggagcattcattaaaagtaaaaatagggctgggcgtggtggctcactctcccctgtattcctagcactttgggaggccgaggcaggcagattgcttgaggccaggagtttgagaccagcctgggtcttaaaaggtagatattattctcattttacagatgacgaaactggagcttgtttgaaaagtttgcccaaaattgtagcagttagcgtgaggggcctgcctctagagaccatgcaaattcaacactaagctatactggactggtctcacatagtgagaccctgtctctacaaaaaatagaaaaagtagccgggcatagtggcccacacctgtagttccagctacttgggaagctgaggcatgaggattacttgagccaaggagatcaaggatgcagtaagccatgaccatgccactgcactcgtgcctggacaacagtgcaagaccctgtctcaaaaaaaaagagaaaagaaaaagtaaaagtagatacacagggaactaggcaagtaaaaaatagaacattaagcagttgctaatgctgggaaaaatctaaggattgtacaaaaaagtatgattgggtcaggcacagcggccgatgcctgtaatcccagcacttggggaggccaaagtgggcggatcacttgaggccaggagttcaagaccagcctggccaacatggtgaaatcccgtctctactaaaaatataaaaagtagccaggcttgttggcacatgcctgtagtcccagctacaggccgaggtaggaggatcgcttgaacctgggaggtggaggttgcaatgagccgagatcatgccactgcactctagcctgggcaatcttagagaactctatctcaaaaaagaaaaaaaaaaaaacacaaaaagtatgattggttttagtgcattatttaaattatcagtgagtagtatttcataacatactactgattaaaccagaatatgtgatattactggtataggtcgggggaaactaaatcttcacctttcaggcaatagataatggctggaataaactgagaaagcagtaaaagcacattctttagaaatactctatccattttgtgcattgaccacaagatttaaaaaaagaaaaataagtaaatacaaagagaaagcaaaaaacaaaatcgagagtgatcgcctgtgggtgttggtagggagctgctctttttcataagccttttaatactctgacttttaaaattatgtacacggattagtttgatcaaagtaactacagagagtgtaagtgaagggcatttaaggatacacaagtataaatattcgcagatcaacctctgtattttttaatatttgctgggactctttctttactttccctgttacagccagcgccacatggaatatcttaggtatggcctgaaggaataaacattggtttggtttattagttacctgcagcagaatgtttggctttcagaatttgactgaaggactcattgtcagacgatttattttctttttgataatacttatctcggtctaatcttaatattccccactgctttactacttggtccatttgcagctatgcttgattagtgccccaattgtcaactttagaacaaaggaataataatcacttgtgcccctcaaatgagctgctgggtcgtaattatccaagaaaggtgtcactataaataatctgtcccagttctgttgttttctgcttttgtttagcaagtatgaaaacagtgaccgagctaaccagaacggggctttatttttatttagttatccacagatctaggttgtgtcctatattcatggctggagacgcttcactacaccgttcattgtactactgccagttcctcatcgtctgatacagtatctcagggttctcacagaatcttttacctgcaaaatgcagtttgcatcagttttatactctgcttgctctaagaagctgtgcacagggtgactgtgagagagacttctctttgaccttctgcgggcaccatctccctgcactttctttcccaaacaagatacttggcagctcagattctgaaaaagggattcctttcaagtgtagattaggacttcagctctgctccttaggttagttagaaataatgtggagctatttctggagtgctgagccttggtcatttatttcattcctggtggggaccccagagtcttggggatctgccggggaaagggagccttatgcaagagcgtcatccccaccatttccactggtacacagcttggagctgtgatctttctctggttacctgagcttgccgatcacaacatggaagtgcagggggaaagccgccggtgcttgtagcagtaaatggattgaaaaagcagttcctacatttactttctcctgctctcctgggagcagatcatggtttagtttcgagaagagtgcagcagctcgagaccaaagagttttgctttgcttgctcttgactgtgcagtagggaagccagcattctcagaagaccagaaaggatggcggtggggaagggagggagacaggcctgtttaaccgagaagagacaggtgccatccccagggtgaggccttcctttcagtggaccgtatttggtgctggagaagagcctgtgaggagtaaaggaggaaaggcggagactgagtgggactccagccggttcctgcacgcagtgcacacccagcgggaaggaagaggaagtgtgttcaggaatagctcaggcagctgtgccattggccggcaggcctgtcagtcgcctgggggccgaggctgaaaagaggaagaagtcggcggggggggctgttgcctggaagggagggaggagggctgagccaggccgagccagggggcgtgggggctgggacagcaggccgattggcagggcggggttgccttcaatcctggccactgctcttaatcgtccctctcctgcttcagggtggcattgtgtgtcccagagtgccggagcgagtcccagaagagaggcgaggctaagcccagagcgctgggttgcttcagcagggaagactcccttccccctgcttcaggctgctgagcactgagcagcgctcagaatggaagccatcgccaaatatgacttcaaagctactgcagacgacgagctgagcttcaaaaggggggacatcctcaaggtaagtgctgatgccgagcacaatgctgagatcgctctccctgtgctcacccaccttctttcgccctgattacacacaaagaagctgtgtttttcattgtacacttttaacatttaccatcatatttgttctggagagctttagatgctgagtagaatattaaatatgacttaagtgagttggtgcgatgtgtggtgtttaactgcctttgtgtgaatgcctcatttgtctgttgatactggtaatatttcaagtaaagtcaaagtaatgtgattgtagaaaggaagtatatgagtagattgatttgccctgtagagttttattttaaaaatagcattttttaaaaagacccagacctgaagtatttatgtaaaagcattcagttagtcttactttgtatagccaaaggattttgcgttctggaatatgattttggtaggttagaaattaattttcccagtttagagaggttgttagaagtacataccaaaactcattaaagaacctcagtgtatttttattctttgtgaaaaaacaaatggagttctaaataataaggtgcaacctgctattgtacaagtcagatttcgactttcttaaaagaaacttgaggagcaattaccccatattaaactctaattgcacgaaaagaaacctgctgacagtttaaaaatcagcttctataccatgtgcagcttattttgagccccactatttatgtgaggattcgctctcccccagcacatgttaattatgttgtttacccaattgactgtagcagtttgcccttttggatgtgtaatttattttaacgaggatgagtgttatcaaagagtatgttaactttaaaggaggaaaggccgaagcttcatgtttgagtgttccctgtgtctcaagttttgacatttttccttctgagccttagactgattgttggaatttgctacctcatttgtttactacccctgaatgaaattcttagaattttatgaagagaaagcaagtggagatgtagaaatatggttctttataaaaggacgtgcagtctttttacttttaagttatgtggacttattgatagtctttattttgccctcattgcccaaggcgtagagttctactctgaagttaactgcccagtaatttcttaatgttagaaatgtaggttgagcctcatagaagatgatgctgcagagccctttaaagagaagaaaactttgtgtctgtgtgttcatttcaaagctgtgtttgtgacaccacacttttcgagggtattctcaaagtcaacactaaattgtcagaaagcagacggaaccattttctagaaactaggtttctattttcttgaactagagaaaatatgcccagctagagatcagggcaaagttaacttagactacaaaattcctcagttttcattggtgtatgggagaggtaatttgatgtttctgtaggtgattactgttttctgtagataacccacttgtgatggtataagatgggctactcaaatgcccacatctatagcctgtacaaaagcccttttgggctagtattttttgtttttgatacaaacttagattttttcataagtttatcttagaaacttgaacctagaaggctggtggttcatatttttctctaaatctgtcccattgcacattaagcactgaagcaacaaattaaaacaaaactaggggcatgcggtctctttttaagaattttttttttttttttgagatggagtctcgctctgtcacccaggctggagtgcggtggtacaatctgggctcaccgcaagctccacctcccaggttcatgccattctcctgcctcagcctcccgagtagccgggactacaggcgcccgccaccacgcccggctaattttttgaatttttagtggagatgggatttcaccatgttagccaggatgatctcaatctcctgacctcgtgatctgcccacctcggcctcccaaagtgctgggattacaggcgtgagctactgcacccagcctttttttaaaatttttaaacaagaactttccctgatttctgtctttgaagtttgtcctagacctagaccatgaacattttataaattctttaacttaaattagtaaattctggagcaagtgtaaaaaccttctttcccatcctattattagggaagaagatcctgtttaacagtccctcagaaatttttattatggaggagaaagtaaatcagaatactcacattcacttttagattttctttgaggagagagaaaaatacatatatgtggttcttttcaatttggtagataactgagatatgaagtcataatgccattattgcttttgaacggtggccattagctgtttgttggtaatgttgtggctttactccaaaagaaaaaaaaaagagtgacgatacagtagttgccctttgtctcataactgtgtgaaatggctgggtgaagaggaggaacatgctttcttaaaagctgttagttaaaaaaacggagttttcctcatttgattcttcaagaagtaaactggcttcatttgaattgctttgatttgggacgtcttgagggtattagttgtaagccaaaacatgttttaaaagttgctggaatagcattgaacaatttaactttcattgaaataggcatatatatgccttctcttgataaaggagacgtgcatatggatattgaataagtttcatttcaagataatgaaataggcacttagccttcatcctctgtctatagttcagaaggatcacatcttctcctgtcttggagttcctggttaacttttagttaaaaatggtgactcctctcctccagcagaccccttccctactttctgtctacacattgacctgttactgtccagagaaaaagaggaaaaaataaaagcattttactggaagcctaaaatagagttgaatggttcaatatgtctgcctttgtttctctctcttataaaagcttgtgtttttcttggctgggggagggagaggacactgggatgtaaaatagaaggaattgcccttccactgcaggtttcaggcctggtgtggttggaatacatcagaattcctcccaccattgtagggcaggcttgagacagtcccagaggttctccactgacaagacccctaaatagtctacactagagcacataaaacttacctaggagttgcaactgccatttaggggcttatgtatacatacttcaaactgtgcttataggaattaagagacccattttgagctctcagatctgtgctcattccattctagagccagcctcttgctttcttcagctctagtggagagccagcctggatcatctaggtgtattctaccctctctggcactaactacctttaccagtttcttaaactactttaaaaacaggtcttgagttcacattgagatcttcaaagcattctgtctcagcactgcctggcctatttcagtgtcacactgactgagcatctcttgagccagatactgggataagttgctttgagagttgggagagaaatataagatgtactttctcccttcagaagctccaaaatctcaagtaagagaattgagattaatatgtgaaacagtacaagatggtatataaaaatttttttagaacaggaaaagatcttttaaaatttatttttatttatttttttatttttttgagatggagtctcgctctgtcacccaggctggagtgcagtggcgcgatctcggctcactgcaagctctgcctcccgggttcacgccattctcctgcctcagcctcccagtagctgggactacaggcacccaccagcacgcccggctaattttttgtatttttagtagagacggggtttcaccatgttagccaggatggtctcgatctcctgacctggtgatccgcccgtctcggcctcccaaagtgctgggattacaggcgtgagccaccgcgcccggcaagatcttttaaaatttcttaagttagacttactcttttacagatgaggaaatggtggcccatataggttaaatgatctatccaagatcacacaactatcattcttggtagtgatttgtagtagtgattcttagtagtatttgatggtatacttgagtcgggttgcacactgtaactgctagagtcgttcaggaaggatgaaactggcaagcgctgacatcagtcaggtgtgtgcagagttgtgacttgaaccttgtaaggagaacaggacgtgtaggttaagagaaggaggacatttcaagggagacgaaacttgtgcttgttgtgtttgagataggaaggctggaataagaatctagactgacatagtggaaaataaggtagagttggagcgaggtgagaaaagcccagtaagagtttgatctggtccttaagaagcctcggaaggtttttagcgatgaagagcattgtgtgtgtgtgtataaagaattgcaagggggcaaggctggggccccaagcctggatggtggcaagtaatcgggttgtgtgtcaagtgtctgtatcaacctgggatactagaaatgaaggaggggagtggtttgaaagatactgaaagcaagaatcatgggatttctgcctgtcagataggggcattttaataagtctcctaagaaaggaatgccctttgattatgatcctcaatggagaagatcagtggagagccaatccctagtttggttggttagagttttcacaagttataagtcctgagtttcagtgcacaagtcccatttcaggggttcaaattacctaatctaaataaaaagccaggcatgctcgtgcaagcctgaaggccccacctgctcatgaagctgagagaggaagattgcttgagcccaggagttggagcccaacctgggcaacaaagcgagaccccatctccaaattaaaaaaaaaaaaaagtgtttttcttccccccccccactattttaaagtcctagtatcagtatactctgtagaaccatttattttttcctcccaaagtgctgggattacaggtgtgagccattgcacccagcctttgccttttggtaagaattcttatcaatcttgttgactaaaccagaatattgcatttaatctttaagaaggaggttagtttgtggtcaggcgtggtggctcacgcctgaatcccaacactttggggaggccgaggcgcatggatcatttgaggtcaggagttcgagaccagcctggccaacatggtgaaaccccatctctactaaaaatacaaaaaacagccgggcccggtggtgcgcgtgcgtacctgtaatcccagctactcgggaggctgagggaggagaatcgcttgaacccgggatgtggaggttccagtgagccaagattgtgccattccactccagcctgggcaaccgagagagactccatctcaaaaaaacaaaaacaaaaaaggaagggagcagtttgttgtttgagtgctcttaaagcaaataatctgcttgctttttattatattcattttgtcagctgaatggactatttccaaataggtgctgagaatgaactttcatttcctataaaagattctttttgggagactggctgaagatgattcttcctcctgtttggagaaagaaatgagtaaggaaatgtagtattccttcagaatctttcagtttcacctctaaaccatatggtagaattgcttctaagatgttgggtttgtttttttgttttgtttttttttttaggcgaagtctcactctgtcgcccaggctggagtgcaatcgcacgatcttggcttgctgcaacctccacctcctgagttcaagtgatcgtcctgtctcagcctcccgagtagatgggattataggcgcccgccaccacacctggctaattttttgtatttttaatagagatgtggttttatcatgttggccaggctggtcttaaactcctgacctcaaatgatccacctgcctcggcctcccaaagtgctgggattacaggtgtgagccaccatgcccagcctactaaattatagatcatttctaatcttgaatgctgaaatattgacttttttttttttttttaagacagagtctccccctgtcaccaaggctggaatgcagaggtgccatcatagctcactgcaacctctgcctcccaggctcaaacgatcctcccacctcagcctatagctgggactacaggcacgtgctaccacaccctgctaatttttgtacttttagtagagatgagtttcaccatgttggccaggttagtctcgaactcctggcctcaaaatatccacccaccttggctaggattacaggcttgagccaccgtcctgggcaagattggcactctttttttttttgagatggagtctcgctctgtccctcaggctggatggagtgcagtggtgggatctcagctcactgcaagctccgcctcctgggttcatgccattctcctacctcagcctcccgattagttgggactacaggcacccgccaccacacccagctaatttttgtgtgtgtgtgtttttagttagccaggatggtctctatcctctgacctcgtgatctgcccctctcagcctcccaaagtgctggggttacaggcgtgagccaccgcgcctggccaagatcggcattcttaaccccattttatgggtgcagaaacaggctcaaagcttaagaaacttgctcagattcacacatctagcaagtgacagaggtgaagtttgatcttaggtcttgctgtggtgtactgggtgtacccatcacaatacatggatacccctcttaactgtccaggtatgagtagaccagaaatgttagggtatcagtagtcttgctttgttcagctgcctggcattgcttccatgagtgatttattggacttcctgtctagagtaagtttgtcattttgtatgtcagattaccaaagataacaaagattgaccccatcctttgctggctacagtgtgaagaaatggttaccactttcccatgtctctggagatttttaccaatattgtctttctcactggtggcttggtaataggtatcagaacataaaatgatccagcaagtaacattttaagaatttgttctaaggccaagcgcagtggctcatgcctataatcccagcactttgggaggccaaagcgggtagatcacttgaggtcagagtttgcgaccagcccggccaacatggtgaaatcccgtttctactaaaaatacacaaattagctgggcgtggtggtgtgtgcctctagtcccagctactcaggaggctgaggcatgagaatcgcttgaactcgggaggcagaggttgcagtgagccgagatcatgccactgcactccagcctgggcgacagagtgagactccgtctccaaaaaaaaaaagaatttattctaagaaactcataaacaagttttttaaagatgtagacataaggatgtttatttcaattatgtatataccacctagaaaaatttttttctgccaatactgtcaattgtaagatgcattttagagatgttaaaacacataaaagtggcatgcaccttccagttcatgaaattgccatactagccaaaaagcaaaaccaattagtggggtttacagaggtagattatggcacctattaagtggcaatgaaggtgttaacgttgatctgtatcaacacagaataatgcctacacttgcacagagaaacgtttaaatggatcctgttttaataagtaataatataactaacatattaaatacttagcatgcctttgctctaagctaagtattcaacttcccttctcttttaatctcacgcaaatcttgtaaaggcagatgctgttatccccattttactgacaaaaaatctgaggcttaatttgcccaaattcacaagttaggattcagatccaatctggtttagtcctgattttatgttcttttgttcttttccctttttttatttttattttttattttcgagatggagtttcactcttgttgctcaggctggagtgcaatggcacaatctcagctcactgcaacctccacttccgtggttcaagtgattctcctgcctcagcctcctgagtagctgggattacaagcatctaccaccatgcccagctaatttttgtatttttagtagagacagtgtttcaccatgttggccgggctggtctcaaaatcctgaacgcaggtaatatgcctgcctcagcctcccaaagtgttgggattatagaagtgagccaccacggtcagccttattttcatttttgaaacagggtcttgctctgtcacccaggctgggatgcggtggcatgatcttgactcattgcaaccttgacctctcagtctcaaggaatcctcctacttcagcctcctgaataggtgggactacagctgtgcactaccacacctggataatttaagggttttttttgtttgtttgtttgtttgtttgcctttttttttttttttttttttttttggtagagccaggaggtctcactgttgcccacgctggtctcgaactcctgggctcaagcgatccgcctgcctcccaaagtgctgggattaccgacatgagctaccgcgcccggcctctgtaaataaagcctttctatacacaaatgaggtcaaactagagagagaggccatttaggaaaaattgctgtcttttcctctttttttatcatatacatagatctctttctgaatggtctcccaaggagtaattgttgtctccaagtaactgaatttcaggtgacttttactcttcatactcttgaattagttaccatatgtatcagttttattatttattttattttatgttatgttatgttattttgagacaagagtctctgttgcccaggctggagtacagtggtgtgatctcacctcactgcaacctccacctcccgggttcaagcgattctcctgccttagcctcttgagtagctgggattataggcatgtgccaccacgcccggcttattttttgtatttttagtagagacagggtttcaccatgtcggccaggctggtctcaaactcccgacctcaggcgatccacccgccttggcctcccaaagtgctgggattacaggggtgagccaccatgcccagctatcagttttattaaaagaaaaaagttacattcagatagtaagcagtttacattctgcatctagtttaccttgaaggatattctaggaaggtgaagtgctctgctgaggagtggttttgtttcttaagcgttgagatttaacctgattttaaatcttaggctgaagttcactgtgactgtgctcaggatcataaaactttgagacatttgaaaaactgacccaaaatgactttttgaggaaaacctttgtccttttggcagctactcccttaattttacctccttctggatgtggaatgagagacatctgaagtattgtaaagaatactggctctaggcgagacctgcctgcttggaatcctagctctgtcacagacagatcgggcattgcgatcttgggcaatttacgggatggctttgtgttttggttctgacatctgtaaaatgggaacaatagtttcctaccttcctggggtcatagtgaagactaaaagagccaatatgttggtgttttttgttgttgttgttttctttttgggaaggagtctcgctctgtcacccaggctgtagtgcagtgtagtgtagtggtgctgtctcggctgactgcaacctctgcctcctgggttcaagcgaatcttctgcctcagcctcttgagtagctgggactacaggagcgtgccaccacacccagctaatttttgtatttttagtagagacgggctttcaccatattggccgggctggtctcgaactcctgaccttgtgatccgcctgcctcagcctcccaaaatgctgggattacaggcgtgagccacccgcccagcctatgttggtgtttttaaagcagtaactagcataaagtagacagtaattgctagcttttagttttattaatgctattcagtacacagcattgataagaggtgattagtccagatcccgggttcaggaaactattgagtcacatgactctacgcataaaagtggccaaaggttatctgctgttacctcagactcagaactgttccagccctgtcccagagctcagctgaaagcacagtattgatggagagtttttctccattcttacacatctatagcaaatagatggatacctatgctgtgtcctactgggggcctcttttgtaagtttctgtagtttaccgaagctttgggattgtgcaattggctaacagtaaggaatgtttgaaaaaacagccttgggaaaaactcatagtatttactttaaggatattaaggtcgatttcagtatctctaactgccctcagtgagaagccatgggtaaacattctctctagtctcaataatgagaataggcgtgtttttcccaaacaacttttaaaaatcttaaggatgccggctaggcgcagtggctcacgcctgtaatcccagcactttgggaggccgaggcaggcggatcacgaggtcaggagatcgagaccatcctggctaacatggtgataaccccgtctctactaaaaatacaaaaaattagctgggcgtggtggcaggcgcctgtagtcccagctactcaggaggctgaggcaggagaatggcgtgaacccggaaggcggagcttgcagtgatcccagatagtgccaccgcactctagcctgggcaacagcacaagactccgtctaaaataaataaataaataaataaataaaaatcttaggttgccatagataatgcttagtatttccttctttactagaaagtttagcccaccttggtctggtttctagcagtagttcttttactttctgtcctaacatttttatcaaaagaactacatattgagtatccctaatccaaagatctgaaatctgaaacttttttgagcgccagcatggcacacaaaggaagtgcctgttggagcattttggattttgagatttagggatgctgaacctatataaatgcaaatattccaaaatccagaaaccttgaaatgcctctggtcgcttattcagttaagggatatacaacctgtattaattattagcagtaaaatagtgaaagtttttttcttcgttttaacagtggcttttattttcaactaatttattctttagtttaatagtggactttttattcctttttttttgagacaaggtctcgatacattacccaggacttttttttttggagacggagtcttgctctgtcatcaggctggagtacagtggcgcgatctcggctcaccacaacctctgcctcccgagttcaagtgatttttctgcctcagccttccaaatagctgggactacaggcacgtgcctccacgcccagctaatttttatatttttagtagagacgaggtttcaccatgttggccagggtgatctcgatctcttgaccctgtgatccacccgcctcagcctcccaaagtgctgggattacaggaacccaggacttttaaaatctaggtttaacaaaatggcaaaagcccttggtaacatttttcttttgaaaaatgcaagagcttttagtttagttataaagtgagaaaaaatgtattttggaccctgaaactgtaggattcactgagaacaagaaaggggtatgtgtttttgggaagtgttgatcatttcatgtcattatttcatatatctttattttcttttttttttctttttttttttttttgagacggagtcttgcaccatcacccaggctggagtgcagtggcgtgatctcagctcattgcaacctctgcctcccgggttcaagcaattctcctgcctcagcctcctgagtagctgggattacagttgcccgccaccatgcctggctaattttttttttatttttagtagagacgagggtttcactatgttggccaggctggtctcgaactcctgacctcatgatctgcccgcctcagcctctcaaagtgctgggatgagccactgtacccagccgtatctttattttcatacataactatgaaaaggagtttgaaaaggaatgctggggaaaaagaatagattattttattagcagtatttccacttcactgtaacatttaaattactttagcttacattaatagataggaaagtcaataagtccctctattccagtatttttactatttcagatctctcttaagcattgtcattatgtatacatttttataatcctgtaattgtagtgaatttaaaatgttaccattttccatattagttttactaattattttcagtggttgtataacatatcaagttaatgttctgtaattgacttaattatttccctattgctgtatatttcacttgtttctgttaataatttagttcgtaatctcaagggaggttttgatatatgtattgtcctattgtctgaatggctgaacaaatggttacctacttaagatgaccttaagtgagaatggcccataatccctaaccagaatacataataatagcacagctaatgtttgcttcattctctagtctcctttaacaatagaacattatttcaaagtttgacagtgttttataggactatgttaaccagatttctgagatgattaaacatccttccctcagcatgtaagatgcttgacacagtttttccgccgcacattttattttgtgctattttttaagtggttaatttcctttttttatagctttgtcaggttaaattaataagtgattatgatagagaaatatggcatgtattcataatttaatttgtctttgagctaaatgaatattttctagaggaagaccatccatcttaactcatgcttggaacaagatgggaagacagacaaaccagtctttgtttagtttatgctgcaaatgtttagctttaagccaggaggctctgctgagagcttttgagaaacaagtattgtaacttaatgaaacatccttactcacatatactgcaatataaagaaaaaagaagagtgtgatgttgggtaacagttggttttctctggatgtagggattatggagaactttaactttctatatggtgcatttctataatagttttttttttttttttactacaagctattagttttgtaatcagaaaaagcagtaaaaaacaaaaacactacagtagttttccagatgtcagtttgcaggtcaacaaatattttagggccgtcttgctgtctaataaggaaagaaaaaatcactgtgcacagcttcatggagcaaatttgtttcctattaaaactcttcttggtgtaggcagtacatcatcttccacctgtataaggctattacatagaaattttgtagaatctaataagataaactagaaacatgacatgttcagctgttttctctacgaataaacaaattggcgctaaaactggtcttgctatctagatttctagttatatctcagttatcttttccccacatgggatgtgaaagtaatgttatatgctttcttatgtacgtacttttgacttaggtcagtctccacactgcattaaaattactaatgagacaaattgcagttttccagaggttcatgtttccatttctccttccttggctttcctgcatttttagctccagtcaaaattctatttattatgtatcaacttttataaaatgcttggctttgaaaagtataattaaaagacaaagatctgaaattaatagtgggtttttagctatctatcatgcattaagaaatcaagtgaccaggtgtggtggcctgtaatcctagcactttgggaggctgaagtgggaggaccacttgagctcaggagttcaagaccagcctgggcaacatagcaagaccctgtctctactaaaaataaaaaaaattaaccaggtgtggtggtgcatgcctgtagttccagctacttgggacgctaaggtgggaagactgcttgagcccaggaggtggagactacaatgagctatgtttgccccactgtactccagcctgggtgacagtgtgtgaccctgtctttttttttttttaagaaatcaagtgtcttctttatttaattcttttaaaatttttattagaatcatttaatagaaaaagcataaaataaattaggtcataattccctcctgatgcccagataacaattttgaaattaaataagcaaataaataaatgtctcactcatcattagaaaatttatatgacaaaccttcccaaagaaaatcactattcaggttttctataacctttcagaaaaaacgtttaatgcatatagccatagttacttttattgcagttcctgggtaccataaaacataacaatgaaaccatattcaaaattttataatgaaagtaagcaggtacttcatctttggagagaagaatggcatttctgttaaagtgtacctctttagaaagtggcagtagctcagaggatttctgtgccaggctcttagaaaagatacaatgattaagacttttctcaaaatcatattaaagctaatcagaatagattgtgaaccgaaatttgtgtgaattttccaaaacattgtgctgaagtagtccatgtcatatatcccagtgaatttgtaactaatggcctcatttaatgctagaagtgagaactggtagaccgtacaagccttcccttaattaattggttcgtctccttctatacttaggttaccagtacagaagaactaatactgtagttgttcgtaaacttggagaaagtcacactgtatctgctcagaggcctgtccaatctgccatgtttaagcttgtactagaactacacccacctgaacagttgttacctttaaagttcttagtagtaattttcatatttagctatgagtttgttagtgttgttcgttcatgtgtgaaatttctatatgtttttctctcacttcatcccttccctgttagatattaaaggcctggcaaaaaggacatgcctctcacccgcatatcctcaggtgaccacatgaaaaattattcttgtgtaacttgcttttgggtttgggtgtttgtttgtttgtttgttttttgagacagtctcactctgttgcccaggctgaaatgcggtggcgagatctcagctcactacaacctcagccctcctgtgattctcctgcctcagcctcccaagtagctaggattacagctgcccaccaccacgctcagctcatttttgtatttttagtagagacggtgtttcaccatgttggtcaggctggtctcgaactcctgactgcaggtgatcctcccccccacctcggcctcccaaagtgctggaattacaggcgtgagccactgcacctggcctgggtttgggatttatattgtcaactgaaactaagactattgaggcagaaatgatttcataaaggtttattggaaggcctggcaaatgagaatcgacctgggaagacacaccagcagacttgggggttgttctgaagtctgtcacaaggtgaaagatgtttttgttttgctgtttgtttcttcgtgggttgttttcttttttagagtcttactctcttgcccaggctagagtgtagtgtcatgatcttggctcactgcaacctctgcctcccaggttcaagcagttctaccacctcagcctccctagtagctgggactacaggcgtgtgccaccatacccggctaatttttgtacttttagtagagacagggttttgccatgttggccaggctggtctctaactcttgacctgaagtgatccacctgcctcagcctcccaaagtactgggattacaggcgtgaactaccacacccagcctttttttttttttttttttttttctgagacagggtctcgctctgttgcctgggctggagtgcagcctcaacttcctaggctcaagcacttcatccacttcagcctcccgagtagctgggacagcaggtgagcaccaccatgcccagctaactttttgtattttgtagaaacaagatcccgccatgttgcccaggctgatctcgaactcatggcctcaagcagtcctcctgccttgacctcccaaagtgttgggattacaggcatgaaccactctgcctggccactttttgtttgcaataaacatggggtctcattctgtcaccccaggctggagtacggtggccccaccatagttcattgcagcctcgaactcctgggctcaagtgatcatctcacctcagtctcctcagtagctgggactacagatgcgcaccaccacaccctgtattatatttaaaaatgtaacttttaatattttttttttgtagcggggggtcactatgttgcccaggctggtctcgagtgatcctcccatctcagcctcccaagtagctcggattatagatctgagtcactgggcccagctatgaaggtctgtctttatgtttttgagacagggtctggctctcttacccaggctggagtgcagaggtacaatcatggctcagtacagccccaacattccaggctcagttgatcctcccaccctagtctctggaactacaggtatccaccaccatgcccaactagtttttgtttgtttgtttgttttgttttgttttgtagggatggagtctcattatgttgcccaggcttgtctcaaacttctgggattaagggatcctctcaccttggcctcccaaagtgctgggattacagattacaggtgtgagccaccttgcctggcctgtgaaaggtttttaggaaagtttaaaagaaggaagggtactcctcctcataccagagttgtcttttcattggatggtacaatatgtaagttataatcgttggttacaaattatgttatacaggctaaaaatgtctatgtgcaagacaatcagtagaagttcatgcttcactaatctttttttttttttttttgaaacagagtctccctctgttgcccaggctgaaatgcagcagtgcagtctcagctcactgcagcctccacctcccgcattcaagagattttcttgcctcagcctcctgagtagctgggattacaggagcatgccaccaggtcggggtaaaaaatttttttttttttttttttttttgagacagagtctctgtctgtcacccaggctggagtgcagtggcacaatctcggctcactgcaacgtctgcctcccaggttcaagcaattctcctgcctcagcctcccaagtagctgggactatataggcgcatgccgacacgcctggctgatttcttgtatttcaatagagatggggtttaatcgtgttgcctaggctggtctcaaactcctgagctcagccaatccgcctgccttggcctcccaaagtgctgggattacaggcgtgagccactgcgctcatgcaggccccggtaattttttttttttttttttttttctgagacggagtcttgctctgtcgcccaggctggagtgcagtggcgcaatcttggctcactgcaacctctgcctcctgggttcacgccattctcctgcctcagcctcccgagtagctgggactacaggcgcccaccaccacgcccggctaaatttttgtatttttagtagatacagggtttcaccgtgttagccaggatggtctcgatctcctgacctcgtgatccacctgcctctgcctcccaaagtgttgggattacaggcttgagccactgcgcccggccagtccccagtactttttgtatatttgtagagacgaggtttcaccatatttgccaagatggtctcaaactcctagcctcagttaatctgcctgcctcggcctcccaaagtgttgggattacaggtgtgagccactgtgcccggctgatttctattttcattgtagttgtagaacatactttgtatgattttaatcctttcagatttattggggcttgttttatggcctaccatctggtttgtcctgagaatgttctcctgtgcgcttgagatagatttttattctgctgttgttgggtagagtcttctatagatgttgttagatctattggttaattactttctctctttttttttttcctgaagattgtgttcaaatggatttaactaccatgaaattcatcataattcataatcagcaattacaggaaagaataatgtgagcttttgtggatttgtatccagttgagaacatgaaagatcagccatagaatgtgatgtgatgattggcataagaagtatagtgatagaattatgtagatcaggctagctggctcacatctgtattcccagcactttgggaggctgaggcaggaatagcccttaaagccagcagtttgagaccagcctgggcaacacagtgagacccccccgtctacaaaaaaaaaaccaaaaatgtttaaattagccaatcgtggtggcacacatctgcagtcccagctactcaggaggctcaggcaggaggatgacttgagttcaggagtttgaggatgcagtgagccatgatctcgctactgtactataaacctgagcgactgaatgagaccccttatctcaagaaaaagaaacagaattatttaaatgcatgaatctgaatgccgtgcagagagtatatgccatatagagttatatgagaatgtcatgatagtagtagctttttttttcttcttttcttgagacagagtcttgttctgttggccaggttgggagtgcagtggcgtgattgatcatggctcattgcagcctcaatctcctgggctccagcgatcttcccacatcagcttcccgagtagctgggactacaggcatgtgccaccacactcggctagagtgtgtgtgtttgtgtgtgtgtgtgtgtgtgactacaggcatgtgccaccacactcggctagtgtgtgtgtgtgtcaataggatttttccatgttgccaggctaatctcaaactcctgagctaaagtgatccacccaccttggcctcccaaaatgctgggattacaggtgtcagctactgtgcccagccaaatgtagcattttgaggaattctttttttttttttttttttttgatatggagtcttactctgtctcccaggctggggtgcagtggtgcgatctcagctcactgcaacctccgcctcccgggttccagcgattctcttgcctcagcctcctgactagctggaattataggcgcccgccactacgtctggctaatttttgtatttttagtagagacggtttaaccataatggccaggctggtctcaaactcctgacctcagatgatccgcctgcctcggcctcccaaagtgctaggattacaagcgtgagcctctgcgcctggccttgataaattcttaagaatatcagtacctggcagggcacggtggctcactcctgtaatcccagcactttgggaggctgaggtgggcggatcgtgaggtcaggagattgagaccatcctggctaacacggtgaaaccctgtctctactaaaaatgcaaaaaaaattagccgggcatggtggcgggcgcctgtagtcccagctactcgggaggctgaggcaggagaatggcatgagcctgggaagcggagcttgcagtgagccgagattgtgcctgggcgatagagcgagactctgtctcaaaaaaaaaaaaaaaaaaaaaaaataccagtaccttgatgaattatagcaacaaattattgagtatctcctaagcaaagggtactgtgtttagtgctaaggttgatactaagcagaattaaagatgtgaaatttaataaataccctgttttaagagctttgctaaagatgtgtatggaatgttctgaatgaaacagacttagtaagacatgagtgttgaaaagttttctcagttaatttagcagcactcaggactgctttgtccatgcagatacggctgacttactggggacttttgtttctaacattagccaagcttactgtcaactctgaagagatgttggagttgtcctagaacacttaaacttggaagttaaattgtctttcaatgtgtttggcagagttataaaagtagacatgagccatattgatagcggcacggcatatgaagagcttcagaatacttatgacacttctttgacattctgtgaaaggctatagataagtacctccaaacatcatgcctccagcctcactcttgcttaaggaaatactctgaaagtagattttctttcttttttgagacagtctctctgtctcccaggctggagtgcagtggcatgatcttggttcactgcagcctccacctcctgggttcaaccgattctccttcctcagcctcccgagtagctgggattacaggtgcccaccaccacgcctggctaatttttgttcttttagtagagacggggatttggttgcgccatgttggccaggctggtctcaaactcctgaccgcaagtgatccgcccacctcggcctcccaaagtgctgggattacgggcatgagttactgcgcccagccaaatatctgttcttttagctctttgatagttcctttgtaatgacaaattattttctaaaagcttataaattggtgtttctgtggaagatgttatttctcatcgaatgcgtattgatagtgttttaagtttagaccacaaagtatttgtcttccatgtgcctgatatttacatagtactctaagctgcactgttgagtactgtagcatctagcttatatggctatttaaatttatattaggctaaaaattcaccagtgcagccatatttcaagttttcagtggctgtgagtggccaatggctctgttgtattggacagtacagatataggacatatgcagaaattatcattggacaaccctgctgtagaatgtcaccagtgtttctggaatcactgttttcgtgcttgaagtattttgtgctccactttgaaatgctaggaaatcgtgtcttcccttcacattgtaaactcttggtgattattgtggtctttggaggtgaagcccttgggcagaattgggatgggagtggaaagtaaactgctttgctgtggactagaagtagaattgggatgaggtgttcccgttctcatgagtcccttccctgtctgcactgttccctttccttgtgaacctttatttcccaaaccccttcttcaccttttccacctccagcctgtgcagaggcagatagatactggggacctgttgtactttgttctgcatcttcactagtggaaataagagttctcttaggctcactgctcgggggtggcctgtaagatgttcttgagtctagtcctttctcttttaatttgggtgccttgtgtcattggatgtgtaatgtggtctcgagctaaatgtgcagacagcagcatctgagacatatccagagagcagaggcagcatttctttgaattcagcaaaaccataattattgtgttttcttttcagaactgtgttttacgcaaataatcttcggcaaagtcttactcttattgtagatactcattttaattctgtgtgttaacttgcaccacaattttgcataatttactatcctcctccagaaagctctacagtgttccattggtcaacgcttttgccagtaatgtcagaaataatgggttgggtgatcttagtttctatatttaaacaaaattttgtcaattttcagttagttgcttgttttccctgaccactgggctatctcgtatttctggtcttcagtcatgttgttccttttgtgtggtgtaacctttagcatttacgtgccttggccacctctcgttgcttagaacagacccaatctccagaaggttttctgggtgttcttcttttccctcgggttcccctttgctgccccgagcaccattgtgtacctcttgccacagtgtgcttttgttactccatttcacagtaggttcctctatcagcatcttgcacagttgcctagcaacatagtttaatgtgttggaggcaagaagggaggaaattcacaccatgttcatcctactcagtgtgaactgagtctatagttgatatcctctttgtgtcactcaatgttgtcctgcctgagttcaggcttggttcttacgttgcggcagctcttttgcctttatttaggcaacagaccagaaatagaaacccttgaatttttttttttttattcctttattttccttgccagcaccttggttagatttcttaactacttttttcttgagtctttgtaaagtataattacactttaccgtgcttacgatctaaagaatacttaatcagtgttattttttatttttatgttttatttttgtattgattaggtcttgccgtgttgcccagactggtctcggactcctggactcaagcagtcctcccaccttggcctcccaaagtgctgggattacaggcatgggccaccacacttggcctcacttttatttcttaaagtcactgcccaataaacattccaagtttccactagtttttgtttttggacatttgttccatccaacatcatggtggcattatattttagtagattgtccaaacatgggtaagaaagatcaactatgaaaggaggtgtcgaacacattggctttcccacctgaatttgttctttattctttggatgtataaaaaacaagaataaaactcacagggagagtttgaaggaactgtgaagattcgttctaatttacatagtttacacaacccatagccctagggaaagtgccaaagaacagctttgcagaggactgaagtcctcctgggaagaagagtcccttcgcatcagatggctctcttgagtttactttgctgctaaaaaagtgagctggattgaggggaaggttttctatttttcaagctttgccagaacacttggcttaacaaacagctgtttgaagtcttaattgtgtctctgtatttccagggatgcgttctgacctcttattagcaacacagctagggctggctggcatgctttgtggtgccaaacatagctgtaccagcctggaaggtatccaaaccgaacaagatattgaagtcagaaggaacaagtggtacaaattctctcttagtcagagtttggaaagccttcgtattgaaattcatgcggacagatttgacacacttctgaaaatttttttcatcaactgacatttcagttcttccaggcctggaatagtgggtttcagtcaacaaggcaccaatatctttttaaatttgcccatagtagccagcttttggggtgtatgaatattagtggcagccttggagcttgaacgttgcatcaatgacctctgttaacagctaaccatatgatatccacaaaataatgaatttacatttctcatgggccctggctttagccattacctcgagagtcagtctgagcatcacttttaagcattcattcattgagtgtccctgtctcttagtactgtgatggtccatgttttgagtaagtaatgccatccttcaagcaaaggaacatatatatgctttgagttgtttttctggtagtggtaggtacatttgcatcagagtcagtaagttcttaaataccatcagccatagtcaaaaacagttttttttttttttgagacggagtctctgttgcccaggctggagtgcagtggcacgatcttggctcactgcagcctctgcctctctggttcaagcaattatcctgtctcggcctcctgagtagctggggactacaggcatgcacccccacacccggctaattttttttttttttttttttggtggagacggtttcaccatgttgcccagactggtcttgaacccctgacctcaagtgatcagcccgcctcggcctcccaaagtgctgggattacaggtgtgagctactgcgcctggcccagaaacagtttttaaccagtgcaactcatacccatccatccagagtccttgtctcagtctcacattctgatctaacagctgagctcagagcagcaaaggaataaatgggagtttttctcaatataaggttgactatgccttcttatattttgccttcttaaattttcatatctttggctcatggactgtggtgtaaagaaaccttcaattttcctataacattgtgctgctactcctgttccagcttaaaatcatttaaatacgttacttttgatatgtcgcattgtgaactcctaggttaggaatgtctaggggtaagttgatgcaaaatgaggataatcattaattattaaatttctaagatgttctttttatataccaaagctgtgttttagaaggatgactttgagtagtgtggattgaagtaggggagaggccagatacagaggacctaggctggagccagcttatctgggttcaaactttggctgtgccatttgccatgatcatgatgttgggcaagttttgttctttttttaaacttctttgtgtcacaatttcctcactggaaaaatggggataataatggtccttgactcattagatattgtgaggattaaactaactgaaatatggaagcacttaaaacagcaagtatataagaagcagttttgtttcaggcaagctgatggagtatgttagtggaaatggaaaagagtcatatttatctgggtgcagtggctcacacctataatcccagcactttgggagaccgaggcaggagaatcatttgagccgagttcaagaccagcctgggcaacacagtgagactccgtttctacaaaataaaaataaaaaaatgagccgggcatggttgcatgtgcccgtagtccctgctactcaggaggcttaggtgggaggatctgggaggatcatttgagccgggaggttgagactgcagtgagctatgatctcaccactgcactccagcctgagtaacagagcaagatcctatctttaaaaacaacaacaacaaaaaaaaaaacaaacgcctgacgcagtgggtcacgcctataatcccagcactttggaggctgaggcggatggatcacgaggtcaagagtttgagatcagcctggccaagctggtgaaaccccatctctgcttagaacactcacacaaacaaaaattagctgagcacggtggggggcgcctgtaatcccacctactcaggaggctgaggcaggataatcgcttgaccatgggaggcggagtttgcagtgagccaagatcgcatcactgcactctagcctgggtgacagagtgagagactctgtctcaaaaaaaaaaaaaaaacagctgagcacagtgcctcttatctttaatcccagcactttgggaggccaaggcgagtggatcacttgaggtcaggggtttgagaccagcctggccaacatggcaaaactccgtctctacaaaaagtacaaaaattagccaggcgtggtggcgagtgcctgtaatcccagctgctccagaggctgaggcatgagaatcgtttgaacctgggaggctgaggcatgagaatcgcttgaacttgggaggcaggggttgcagtgagccgacatcgtgccactgcactccagcctcagttacagagtgagactccatctcaaaaaaaaaaccaaaacaacgaaaaaaatctagagtattttaagagaagaaataacaggatttaatgattagatgagacattctgtttagccagaggattccagggctttgaggccgaggaaatattggtgtcattaacagaaatgagtaaattaggaattatctaattggagaaaggaagatactgaatgctaaaaccataggaaaaagtttgactaaaagtactgtggatagtttagaatctttgcccactgctgtatcaagtaaagaataaagggctgaactcatttctcacaaggtaacttctttatgcatatttcccagcaagaagcagccttaaccttgagaaacatgagtcacttctgaggctttactgctctaggcagtttctacctcatgatctcccttaaaaagagggtaacggcccagctcagtggctcatgcctctaatcccaccactttgggaggctgagatgggaggatcacttgagcccaggagttcaagaccagcctgagcaacacagcaaaactcttacctctacaaaaagtttttttaaaaaattagctgggtgtggtggtgcacacctgtagtctcaactactccagaggctgaggtgggaggatcgcttcagtctgggaggtcgcggctgcagtgagccataatcacgctacagcactttagcctgggtgacagagtaagaccctgtcctgaatagggggaaaaaaagagcagtgggtctgattataacctttgtgacaacactagatcccattaccatagactttctgaattggttatagtaagccttaattttatttgtgcctcgtaagaatagtgtggccctataaatgatagatttgagtgagaattcccacatctaaattgtaagaccctcatgtactgaagcctcacgtatttttccttttttttcttttttgagtttttgttagtatatatcacaggaaattttacctgggaaccttaagcttattggtgatctagttattagagatttaagaagtatttttcgttttcattggcttatttcagggaaaaaaaatttgttggattactttcttgttttttgagccagggtctcactctgacacccaggctggagtgcagtgatgggatcatggctcactgcaacctccacctcctgggctcagaggtgatcctcccacgtcagcctcccaagtagctgaaactacaggcatgcactaccacacccggctaatttttgtttgtttttttgtggagatggggttttgccatgttgcccaggtgcccaggctggctttgaattcctgggctcaagtgatccgcccgcctcagcctcccaaagtgctgagattacagtgtgagccacggcagctggccgttttttttttttttttttggaagctgatctcaaactcctgtgttcaagggttcaaatgattgcctgtgccagcctcccaaagtgctgggattacaggtgtgaaccactattcctgtcctgggcattttaaaagtagagaccatactgtatataacttgccttttagaaaaataaacattttcccattgtgttaagccactgttatttgcagttaacagaatgtgttatactagcctacacagtcgagttatgtgtgtattggctcacataatcgaaacgttgaaaggtagtatagagatcagataagatttgatcagggctgaagctcagcatctccatgattttttttttccaagttctgctctgaaatttgtaacggctgcaaggtatttcattatatgaatgcactataaataaatatttaactgttctactactggacattgtagggtatttcctttctgcctcccgctattaaaataatgcttaggtaaacatccttgttatgtttacatgtgttttaaaggaagagtaagacttgatatgtgattaggtacgactatgaaagagaggaaagaggagaaatagtgtgaaaaatggtatttctacaggtagaaatgggcaatttcaatagaagggagacatgggcagctgatgggttgggttgggcatgctgagtgtgagtccattcctctagccattctgttcatctttttggtgctcctgagcaacccctgggcacccactggttattaattgtttctaaccacttctattttatcttttaatgactcattgtactggcggttttttttctttcactcattttctttctatcccccatagttccattgtactttcttttttctttgttgtactttaatttgaactttttcgctttggtatagattgtaccagatgttccttttcaagttaaaccaagcaatccattactaccacagttgtataaggtgaaccttttaagtcatcttctcaccagaataacctgtccccatctagtcttctgtgtttcacttttattaaaaatgcaaaactgatttattctgagtaaaagaatagctgacttttctgtaccattatttatagcaaagtagaattcattaaagtaggatttagaatttcttggatataaagttctgtccaggaagatttaaatggttctaatttagaggtttcggggttttgttttttgtttgttttgttttgagaaagttaaccgtaggagatctagcgtaagatgagccattcgtttctgcccccttgatggacttttcccactgtaaacataagcctctgggtgggcagcagatggagctgcagtggggttggtgtcggacacctgccagcttgtggagctcacatattctcattatagcaatcatttgatactagaactgccagagaatgtcctaaaaataaaggtggccagtacaagattcgtttgattttactcttcatggtctgccattagaagtttgggtgttaggctcaaaactaccaaataaaaacaatttcgatgttttcagactgctctgtcttctgaaaaatgagagatgctttttccctgtgagaattgacctaagtaaataagtagttagtagatttttttcctaaatggacctcaaaacactgcctttttctgcttggctgggtttttatgtttggatagaatggagagattagattgggtactagatacttgtctgtgaagcagtttagagtaatcctgttattctgagttcattgtccataatagtcttaaatctgaaatacctccatcccctacagctgcagaaaatagacaaccctaatagaaacctgtcagatgactgattacaggacgtactggtcagaaatagtatggacgatgatctttgggggtccattaaagatggtataaaacaacacagggagggaagtttacatagtggttacagacatggactctggaattggtcagacctgggttccaatcctgcctcttccacttgtaagctctgtctccttgggcaaggtatctggtttttctgggtggaccttagattcttcatctgtaaaatggttatagtacctatacaccttacagagttgtgaagatgaaatggcctaatttgtcatgaattctggtacataataaatctttactaaatgtaagctgctgtttgctaaaggagagactaactcatttctcaaacatgttgagtgtctacataggtatgtaataaaaccacagccactactgtgaaggatatgggctggcgatttaagcccagttggtttgagttcactagtagaggcaatgtacaaggcagcttggtggctatgcgtactattaattgggcaaggtaatatgggagatagaatattttttggaacatactgagttccatttggttatggttaagtttgtggttcttgtgagacgtagagggaaagagatgtattgggctgttagatatgctggtttaggctgcagagatttgggcatatccaaatagaatacaggcagcaatgaagtttgtgcagaggttggctctttctaaagtgaaactgtagagttagaacaatatcaaaaagcaaaccttgaggaatgccaaacttttttttttttttttttttttttgagacggagtcttgctctgtcgcccaggctggagtgcagtggggcgatctccgcttgctgcaatctccacctcccgggttcacgccattctcctgcctcagcctcccgagtagctgggactacaggcacctgctaccatgcccggctaatttttttgtatttttagtagagatggggtttcgccatgttggccaggatggtctcgatctcttgacttttggtgatccaccctcctcggcctcccaaagtgctgggattacaggcgtgagccaccatgcccggcccgctagtttgctcttaagctcagcaaaaattcagagttgtgatttaataagcgtgagacttagtaaagcattttgtaaatagagtataacattccttgcatttgttgtacttttggtttcctgaaataatagacagtgtatctatcactctcctcaccacaatccacatagctttccagagtagaaaagatactccatggagaaagtttagaggcagaaaatgaaatgagactgtgtggaagtaaaagtagcctatcctctgtaactgattttagaggtgacctgtgacctggcagttccttatttatgagtgggtacagggcacacattgaccaaagaagatagtttaggtgaggtgctaccctatctttgagaatgggactcttggctcttaaaattagaaaccaggagatctatgggatggaaaatagccttccctttcccccaaatcaaacagatacacatactttgtgacaggaatagattatgaaatatggtgtccagaacaaactgtctgctgggcttttaaaagggttttatactttctgctgggcacctagagcacttactctcccttctgtctccttttattacccacctcaagcagtcataatttttttcctttccattccctaggcttagccctcttccttcctctacccccaaaatgggaaagcctttagtatttaactgtagtactttatttggctgtcagtatttgtcatattagtaattgggtgagcttggctggaggtggggggctgttctgccctttttaagattggcccacacaccattgtacttaggtacccacacaggagcagagcaagttggctagattttgaatacaaaagcatgatattgtgggtgggagcatgtatagttttagaatttttaaagtaaggcaaaaaccatgtacctaatgaggccagtggaataaactttacaacagatagaacttctgtttctgtttaacacccagcaataaaaatgctaagaacagggataaagtgaaaattattaagcccttgtatctattgctgactggtaaaaccaacacatcaaaaaatatcttttggctcccaacttgttaatagtttctgacttacgtgtgttctgagtgatttggtggagtgaatgagctaggtcttgatttttccctcaaaggattgaaatttggttcttggagggtgaaaaaacaaaactcaactcttcatgcataaagcacagataaacagtacagtacataaatatatgtgtattttcatctgtggtatcagaatttcatgagaagtggtaattaaggaaaaaatgtctacaaagacatggcggaggtgatgatgattaataaaaagactgagatatggggctctcccctttgaggacctgtaggacctacatatctgtgtcctggagaggctagtggcccttctttatttttctcatctctaaaactggcctgagggtgatgaatggtgtcactagctgaagtgcttcaggaatgccagtgggtactcttaggattattatggcacaatgtatgtggttctgacacttaaccaggaatacaagcagtgctttacatactttccttgtattggagagcctagtggttgcattaaacatgagggaaaaaatctgaaaaaataccaagtatgacaagaaatgaatattattttaataatcccttttttttttttaataaagacacagactggtctcgaactcctggcctcaagcaatcctctcatctctcattttaatagagttgctcagttagtaatggacatgtaatgagcgtaatatattttgctcatgaaatcctaatgttttcagggatattaaaacttagtaaattgggaagctttttccccctagtttggtggggagtttaatgccctgcatgcatcaccgtctccccactccataatttttaaggatggctcctcagactctgtgtatgagtatttccctcataccatatttggtatttttgcaagtagataacttggtacctttgtaatatgataagtctagatagatgaaggaagtagtgtttcctgataaattatgcagttagttggtaaggagacgataggatttatgatgacatttttaggagtcaagtgtttagacccatttttctgaggatttccctgtctttcccacagcataggagaccatcttgtcctatttttctgtccttatactgcctgaaggaaagatgtgcatttggatctttgccactctgtagtttagtttgttcccttgtcctcgtttaagacaggttcgcaaaatgtttttgagaacaacacagactggaatttgaattgaattgcactttttctttttattagctgtttgtggtcaagacatctgacctctttgagctctggtttgttcatctgtaaaataaaagtactatctctgggaagggttgcctttaatacaggaaggaagtgtaacaggtacacaatatattgtaccttttaaaagtttgactttaggtcaggcatagtggctgatgcctgaaatcccagcacttgggaggctaaggtgggaggatcgcttgaggccaggagtttgagaccagcctgttcaatagagcaagaccccatctctaccaaaaaaaaaattaaaattagctgggcgtggcagcacatgcctgtagtcctgactgctccagaagctgaggtgggagttcaaggctgtagtgagctgtgttcacgccactgcactccagcctgggtgaaagagcaagaaccctgtctcagaaaaaattgaaaaaagtttaaagtgaaaaagaacatagcatcataggactcttattttataaggggatttatctgaggcccagagaagccaagtgggcagagagcaaggtgagcaggagcagctgggcccatgccacaaggtccctgtgtgtcctttttgccccacaaaccttgcttttgtattaggtcactccttactgtacagacacaagtggtaatgatggtgttttgctgtcctgtgtgaactagtgttgagtttgacctcagttgaatcagtaggggattacatttctgtgaattctgtggaagccttctaaaatcagataattaccttgcttgtatttgtgacttcagttactaggctttatgataggaatatggattggaaaatactctaaaatcccatctggtcctttgatttttgtgtgtgaagggcttaaaattaccaggaattgttccagacacagaaaactagttcctgttgtccagaattatgtttctaagatagtaatgggaggactaaacttgtaatctgttgaaaacatatttttgagatttaagttattgatgcatttgtttattgtgaataaaaagaaaacagtaaaaaatcataatcacatttccttgtttacatttgggagatcgtttatcatttctttttaatttgactgtttaagtatattagagacaaggtctcgccatgttgcccaggctggtctctaacccctggcctcaagcaatcctcccacctcagccttctaaatttctgagattacaggcatgagccaccatgcccagtctgtcttttttttttttttttaaagacagaaagaactttgtaacacaccactttttccaacaacatttatctttccaagacaagtcaaacacttattgaatgcccttgagtatataccaagattaatagccgaggctactacccacaagtagttcaatttagtagagaaaagagtatattgagacaggtatacatggttcagtggtgggaagaaagtgattcttaaattaggtcttgagtttgccattttaggcagagagaacaacatatacaagtgtgaaaatcataaaacattctggcagttgggaaaccacaggtagctttagtgttgttgaaacttggagttcaaggcaggaaggcaggagatgacagggactggcaggtggagattggggagttaggcaaggtctgggccatggagagctttgtgttcagtgctgtgcttactcacaccaatctgaaattattattattatttattattattattattattattttgagacaatgcctcactctgtcacccaggctggagtgcagtggcatgatcatagctcgctgcaacctcgaactcctggactcaggtgatcctcctgcctcagcctcccaagtagctaggattatgggcatgtgtcaccgtgcctggctgatttttgtattttttgtagacatgggtctcacttttgttgcctaggctggtcttgagcccttggcttcaagcagtcctcctgccttggcctcccaatgtgctagatcacatgtatgagccatcagctatttggagacaatttaaccaaagttgtattgtctattattcctcttttttttttttttttttttttttgagatgtagtctcaaaccctcctgggtttaagggattctcctgcctcagcctcccaagtagctgggattacaggcgtgtgccaccacaccgagctaatttttgcgttttttaaatagagacagaatttcactatgttggtgaagctggtcttgaattcctgacctcaggtaatacacccacctcagcctcccaaagtgctgggattacaggtgtgggccactggcctattttatatatatatatatttatatatatatatataattttttttttttttttgagacagagtcttgccctgtcgccatgctggagtgcagtggcacaatctcagctcactgcaacctctgcctcctgggttcaggtgattctcatgcctcagcctcctgagtagctgggatttacaggtatgtgccaccatacccagctaattttttgtttttttttttttttttttttttttagtagagatgggatttcgccatgttggccaggatggtcttgatctcctgacctcgtgatccgcctgcctcagcctcccaaagtgctgggattacaggcatgcccaaccgcggctggccctgtctgttactcttaatgatcttaatgacagctctgtcagtgttaacatgtttctccgttttaggataatgccatgaatatacagagctaaccactcagcaaacactcaaaggtaatggggaatgagcatgccacagataaataatggaaagaggctagaatgcaacttaaattggaatttaaaacagacaaaaacacactccacccatagtgtaggagatatttagtaacatgaattggagttttaaaactctagtcaaaatgttaaatatttgaattcttttctaacaatttaggtaaaatgcaatttggaataattttaacagggcttgtggccacatttttggtttaaatatttatttacttagctattttcttcctctatacttgtgtgggcagtgaacctaataattaggttaaaggattaaaaaaatcaattccagagagctcacctttgactaacatagcaaagaccatcatttagattacatcaatggtaatttcaggctagacatggtggttggtggctcatgcatgtcgtctgcaacctccacctcccgggttcaagcgattctcttgcctcagcctcctgagtagctgggactacaggcacgcgccaccacgcccagctaatttttgttttttgttttttgttttttttgagacaaagtctcactgtgtcgcctaggcaggagtgcagtggcgcgatcttggctctctacaacctctgctgcccagattcaagcggttctcctgcctcagcctccccagtagctgggattacaggcgcctgccaccacgcccagctaatttttgtatttttagtagagacaaagtttcaccatgttggccacgctggtctcgaacttgtgacgtcaggtgatttactctcctcggcctcccaaagtgctaggattacagacatgcaccactgctcctggcctgcctcagttttaagcatgaatagaccgtcagggagcaccagatgtttgaggaatggaatatttgggccattgaaggattttaagccaaatgacctgacagtccaactttaaaagaagacaactttattttttcaaagaacaattttagattgatagagaagttgtacaaagagttatcatatgccccacattcactttcacctattactaacattattatggcgtatttactattaatgagccaatattgatacgttattattaactaaagttcatacttgattcagtatttccttagtttttcccagtgtccttctctgttctacggtcccatccaggacaccacattatacctagtcatcatatctctctagactcctcttggctgtgacatttctgacttaactacatcagtgtagagtgagaaataaaaattaaaaagaaaaaccctcaaacatttctgccttacattttaatgatgctaattctggttgcaggattcagaagattctgatggtggcaaagtgaaagcagtgagacggattaggaagccactgcagtaatccaaggcagagataatgatagggctggatcagaatgatggtggtaaaagtgaaaagtgttccatttggggatgttataaaagccattagcctggatggggaaactaaaggaatgagtgtagatggagaagaaaagagttccagggatggagcccttggggcacctgaatgtttaaaagttagtgagataagaaactagcaaaggagacccaacaggaagtggccagttacgtaggaagaaaagctgggaaatgatgtgtcttggaagccaagaaagtgcttcaaggagaaggaaatgatcacttctgttttgccctgcttataggccaagtcagatgagggcagggaattgacctttggattcagcaacaggagctgattggtgaccttgagtagtttcagtagagtggtacgagcggaatcgtgcttggaagctggttcagagaggatgggtatgcacagggaaagctgcacaaggaaacttgctgtggtgatagatgtgttctttatctcaaaggtagcagatatgtaaattatacatgcaaactaatatttatgaaagaacgaatgatagggtcttgccctgtcacctaggctgcagtacagtggtgtgatcatggctcattgcagcctcgacctcctgggctcaagcgatcctcctgcctcagcctcccaagtagctgggaccacaggtacacaccaccacacctaactaatttttagagaacagggtttcacaacatgttgcctaggctggtcttggctcctgggctccagcgaacctcttgcctcagcttcccaaagtgttggaattacaggcatgaaccactgtacctggcccaaatatttaaatataggtaataatatgtatattgaagtatttagggggaaatgtactcatatctgtaactttgaaatgcattaaaaattaagatagatagggccgggtgcggtggctcatgcctgtaatcttagcactttgggaggccaaggcgggtggattacctgagctcaggagttcgacaccagcctgggcaacatggtgacaccctgattctactaaagtacaaaaaaaaattagccgggcatggcagcgtgcgtctgtagtcccagctactcgagaggctgagacaggagaattgcttgaactcgggaggcgaaggttgcagtaagccgagatcacgccactgtactccacactccaacctaggcgacagagcaagactctgtctctttaaaaaaaaaaaaaaaaaaaaaagaagaaaggaaaattaagatacatcaataggagagagggatgtatatagatggatagatatgtgacagagcaaataatttaggtcaaacttgtccagccccacagcccgcaggccacatgtggcccaggatggctttgaaggcggcccaacacaaatttgtgctttcttaaaacattatgagatttttttgcttttttttttttttttaagctcatcagctatcattagtgttagtgtattttatgtgtggcttaagacctttttttttttccagtatggcccagggaagccaaaagattggacatccccgatttatgtgatggataaatgtattcactgtaaaattcttttcactttgctttatgcttgaaagcttttataacaagatgtttggggaggaggagagaactgggacagagagtatagacaactgttccagaaagttttgatttaaaggggaacagagagatgaggcagtagagtcaaaagaagtctgctttcaccccactcccagagatgagagaaatgacagcatttttatttgttgattagaaaaatccagtagagattttaattaaaattgatgatgcagaagaaaggaaaataactgagttaatgtccttgagcaggcaagaagagatgggattcagcaccttcgtagaattttgttttgctaggaacagggacaaaagtacgagtacaggtcctggccaggcgcggtggctcacgcctgtaatcccagcactttgggaggccaaggcaggtggatcacctgaggtcaggagttcgagaccaacctggcctacatggtgaaaccccgtctctactaaaaatacaaaaattagccaggcatgttggcatgtgcctgtaatcccaactacttgggagactcccgaagtgctgagattacaagcatgaactgtgcccggccatagatctgtttttattcactatggctgggttctcagtgcgcccttcctatctgaaaattcatattcatcagctatgagaagttaagtttttcctttttaaaaaacatttcgtagtgtcttttcttctattttcactgttctctttctggaagtttgaataatagctgtcacatcttttggaagactgcagtgggctcttccagcaattcttgaatccagcagtccccaacctttttgctaccagggactggtttcatggaagacaatttttccatggaagtggggggtcgagatggttcaggatgactgttcaacctcagatcatcaggcattagattcttacaaggagcgggcaacctagatccctcgcgtgagcagtttacaatagggtttgtgttcctacgagaagcactggcaatgtggtgaaaccccatctctactaaaaatagaaaaattagccggttgtggtggcaggcacctgtaatcccagctactcaggaggctgaggcaggagaatcgcttgaacatgggaagtggaggttgttgcagtgagcagagatcgcaccattgcactgcagcctgggagacaagagtgaaactccatctcccccccaccccccccaaaaaaaaagaccatgaataaactttgcttgtacaactctgaataccagaaaacaatgtctcttccaagttctgagggaaaatgctgttcagcccaggattctgttgaaatctatacccagccgaaatagccttcaagtataaacatagaatcaagacatttccagacatgcaaggactcaaaacatttgcccctcacgcaccctttcgtttttgttttttttttgagacagagtctcgctctgtcacccaggctggagtacagtggtgtgatctcggctcactgcaacctccgcctcccgggtccaagcaattctcctgcctcagcctcccaagtagctgggattacaggcatgcaccaccatgcttggctaattttttgtatttttagtagagacggagtttctccatgttggccaggctggtcttgaactcctgacctcagatgatccgcctgcctcggcctcccaaagtgctgggattacaggcatgagccactgtacctggccagaattttttttgttgttgcccaggctggagtgcagtggcacagtctcggctcactgcaacctctgcctcccaggttcaagcgattctcctgcctcagcctcctgagtagctgggattacaggcatgtgccaccacacctggcgaatttttgtgtttttagtagaggcggggtttcaccgtgttgtcaggctggtcttgaacccctgacctcatgatctgcctgccttggcctcccaaagtgctggaattacaggtgtgagccaccgcgcccggtaaaaatggtttttttttttaagggcatagaaactcgaggaaatacagaagcccaaccagtaaaggaggtacagttgacccttgagcaacagaggtttgagctgcatggttccgcttatacacggatttttttcagtctacatgtgtgtcaaaaagacagtattcacaggatgcacagcccacttacgcagagggccaactgtgggacttgagtatgcacagatttgggtatatgcaggggtcctggaaccagtcccccatgaatacaaggtacaactgtgtctttttttttttttttttgagacggagtcttgctctgtcgcccaggctgaagtgcagtggcgcgatctcggctcactgcaagctccgcctcccgggttcacgccattctcctgcctcagcctcccgagtagctgggactacaggtgcccgccagcacgcccagctaattttttgtatttttagcagagacagggtttcactatgttagccaggatggtctcgatctcctgaccttctgatccacccacctcggcctcccaaagtgctgggattacaggcgtgagccactgtgcctggccaactatgtctttttaaaaaaaaaaaaaaaaaagttaactttttctcccagagaacggtcttgtgagcttgatgatgaaaattcaactagagaaaactggaaattttggtgctagtcagttcagagttgatagccttaatcattattgatttattatacatagacatccgtgacattaaaacacttttactgcatagaggggatcataaaggctgagtgataccaggctgtagctgcaaacagtagggatatcttagttgtcacataatatgtctgatcgcttttctcctttgggaaactacttgtcattgtgagcaggagaatgaaccgtttatgcctggtcacccttccatttccagggagcgtggatgttctgttggtactggggcctgacccagaatcatgggattgtacacacatttctcctttaagcacaacatgaaatcaggaagttgttcttgtaacttggagttgcgggtctgacaagcctgttgtttgcgttaatacatcctatcatttagccgtcttagtccctctcttctctgcaggttgtgacagttctgtgggacaaaagtgctgatttttcacatggagcagcgtgtaggtgcttagagaaagaactagaggcggagcaaggctgagcttgtctcttcatgatggtgcctgccaagagcaggggctgtgctgcggctgccctgccccccagccctcccagtgaacctgaacctgctcctcctgagctgtgtagctgcctgaaggaggccaggacctgggtaattaattactagagaagcctctggtctagcagcaaaaggaggtagttaatttagcctgcctgttaacaatagttatatttgtctccgattccattagagatgcttaggaaaaggtttttatatcctgaaccctgatgtccattttcttaatgcaaaggcctgtacttggggtcttgtaagccccctaatgtcactctttgaagtgaagtaactatacgtgataagtgaataaaatgtgtcagagtgtactacttagaattttcatagattgtaaagattttctatatatttatttgaattggtaattggttatgagcagtttggtgtagctgtttttaattgtacaacaattaagatatcacctatattctcgaagaatgggatcattccttctaggtgagggattatccctttaatatattttctttctctttgtctttgtttatggtggagaataattaaacttttttttttttggaggtaggtcttgctctgtcacccagattggggtgcagtggcatgatcataacttactgcagcctcagccttccaggctcaactgatcctcccactgtagtctcagagtagctgggactacagccgcacaccactacacccagctaacttttttgttctattttttgtagagacaggtcttggctatatccctcagcctagtcttgatctcctgggttcaagtgattcttccgcctcagcctctcaaagtgctagattacaggtgtcagccaccagcacttggccgtcttcctctaatttttaattttttcactttgagaagcctatgatatgacatggaatttgatgtctcatcctgtgtggtcctgtgcaccctgttcctacagaagtacagagggaatcttttgggagggagggataaacttagattcttaaaaataatgcatgtgggtttttcagtgttcattttagattctcttcaaaacagtcagaagccccctaccctaatctcaattcctgtctgctccctcctggctccctgcagtaaccccttctccacctgatcttcctgctgctgctctttgtcccctcagagccgtgtgccacacacaagccagaaccatcatcctaatgagcaaattccccaagtccttattctgccctgcacagtcgggctcagttctctgtccctggtctcccctagactatgccacatcccttcctgcctgagaacttttgcacctgcgcattcctctgcctggaatgtttcttgctctcatttgtgtcctcaatgcccgcccccaagcctcactacagcctacttacactgagggtttccattcaaatattaccacccaagtggccaggcacggtgcttcacgcctgtaatcccagcactttgggaggccaaggtgggcggatcacgaggtcaggagatcgagaccatcctggctaacacggtgaaaccctgtctctactgaaaatacaaaaaaattagctgcgcgtggtgacgggtgcctgtagttccagctatttgggaggttgaggcaggagaatggtgtgaacccaggaggcggagcttgcagtgagccgagatcgcgccactgcactccagcctgtgcaacagagcgagactccgtctcaaaaaaaataaaaataaataaataaatgttaccgcccaagtgagctttccttgcattgattagattcggtctccccaagatgtgctttcatacagagcactctggactcatagaacttacacctgaagttgtagtgaacttggcttcccctgctgtcagctctttgaaagtaaggctcatttttaaaattgtatccccaggacctagcatagctcctaactcaaaataggcactcactcatacttgtttactcagtcttttttttttttttttttttcccctcagagatgagatcttgctatattgcctgggccagagtgcagtggctattcacaggtgcaatcatagcacactatagccttaaactgctgggcttaagggatctttcccaggtagctgggactgcaggcatatgccactgtgcccagctgctcccttagtcttgactatgtattttttttttttttggttgttttattaggatagagtcctaagaatggcattactgggttaataggtatgaacattagatctttaatacatacagtcgaattacttttcataaagccatatacctttttatattcccaccgatactatccctatcactaagtattaacttattttcatctttgccaatatgatcatccaaagtgaggcagtgggtggccatcagatgtctgagtcagcagggtgtggtggctcacgcctgtaatcccaggattacaaactttgggaggctgaggcgggtggatcacctgaggtcaggagttcaagaccagcttggccaaaatggtcaaacctcgtctcaacttaaaatacaaaaattagccaggcgtggtggtgggcgcctgcaatcctagctacttgggaggctgatgcaggagaatcgcttgaacccaggaggcagagggtgcgggggttgcagtgggccaagatcgcatcactgcagtccagcctgggcaacagagtaagactctgtctcaaaaaaaaaaaaaaaaaaaaaagtctgagttatgaaaacagaaggctcgaaccagccccttgatctagttattctgggcaagcctacatgtgtcctcgaaggtttctgggctctcaggttttacagccttagcaggctaaaggcaacagggaggacagcttgtcttatctgttaggcagtagttttagtaacatggccagcatggttacctgtaagagaggaccctgcttgattgagccacatccagctgtccaaatgtatgtaattaccatttatcattgaaacatatgacagctccatcaaaagagagcaatgtgtagtctggcagaggacagtaggattaaacaagaatggcttcttttatttaaactcaatgaaaatacaagagggaaaattactttgcttactataccctctcacctgttataagctgttctacctttaggttcttgccctattcctagactatttgaagttgtccttttttctagaacgtccacacatgagttgaattttccatgtcagccatgcagctaatttagaaacatgttgctgggttgggcgcagtggctcatgcctgaaatcccagcattttgggaggctgaggtgggcggattgcttgaactcaggagttcgaaaccagcctggacaacatgggaaaaccgcatctctacaaaaaatacaaaaattatccaggcgtggcggcgtgcacctgtagtcccagctactcaggagactgaggtgggaagttcacttggcctaggaggcagaggctgcagtgagcagagattgtgccactgcattgtctagcctgggtaacagagtaagaccctgtctctaaaactgaaaagtaaatagaaacatgtagcggtgaattctgtgtccagctcaaaatcagcagtttcccttatctcacttttttacttatttcctctttatttacacacatagctcccttagctcataaacacttctgagggcagggaccatgccttttattcttattcccttttcagcttcctaacacaatgctttcagtgtagtagacacttgaacaatatctaaagtgcaattcaaaggggcagctactgcaagtcattatgccagtctagtaatggtcagattacaaatctgaggtttttataccttcaccccctttctcaacttttaatagtaaacagaatagggctgggcattatggctcatgcctatagcccagcactttgggaggctgagatgggaggataccttgagaccaggagttccagaccagccttggcaacatggtgagaccctgcctccacaaaaaaattttaaaagtagccagctgtagtggctggcatctgtagtccgagctatttgtgggaagatctgagacgggaggatcacttgagcccgggaggctgaggctgcattgagctgtgattgtgcctctgcactccagcctgggccacagagcaagacccctgtctcaaattttgaaaaagcggttaacagaacagaattgtttggctcttttatagttttcttctcccaagtagttggtagaatttggatactttctgccccataacaaatgtcactttatataaaggagcatgtccttaatgcattccaaaagacatatacaactgattttaggctaatttcagtctgagtcctggtagagaacacctgacacactgaaattgagaggattttaataatgagactatttgcaaggtgttgactccagctggggacctccacactcagcccactcaggctaagtcttggttgcgcaccagctcagctcatggctgggctgggtatgccccagctcacctgtgttatggcttgttcccaggttcagcagttcccaaggtcttgtcctgtgtctgagaagaatgaggttacactggcaatttaagggtgaggagggtggagaagaattttattgagcggtgaacagctttcaggagcggaggaggtagtggttccccacccctgaagtctggtggtttctctcccagtgtggctgggtgggggcttttatgggctcagaacaggggcatgcatgctgaatggtttgtgggcatgcaaagaaaggctaaagcaaaggcaccactcaaagatgggcatggcagtgtagaaaatcaattcggaaagggtaggtagatgtaaaataggtgaagagtggggatcaatcagaggaaagcctaccaaatgggaagatgggttctcagtccggtccatggatttgacctgtagtgtggctttcaggctttgagttgtctttggcttagaggtggggtttcactggagacccgcccctgtgaggcatttgtctgcctcctgccgctatcagtgtgggcgaagtttctctagaaaccacagggataatgcagtgtccacagctggtaatcaggttaccaccatgaggcctacgacagggagaaggaagggggaggagttgcccaaacctggagaaggaaaggacttactttcaattgagagtccaagactgtccacagacactctcagggtgggagctgggagaatgaatgccctgacctgaccctcccttcgtctgaccttctgcaggcctccccattgattaatagcactgggagccagagagtgagggagcctgttgatgtggttcttacagagccaaaaagtcagagcaggctgggcacagtggctcatgcctgtaatcccagcactttgagaggccaaggtgacttgaggttaggagtttgagactagcctggccaacatgatgaaaccccgtctctactaaaaaatacaaaaattagccaggtgtggtaatcccagctgcttgggaggctgaggcaggggaatcatttgaacccgggcggtggaggttgcagtgagccaggattgcaccactgcactcctgcctgtgcgaagagtgtgactctgtctcaaaaaaaaaaaaaaaaaaaaaaaaaggcaagaaaagcaaggtgtaactggatctggagagacagatggaggataccagcataagattgatacctgtctttgttttttggagacggagtctcactctattgcccaggctggaatgcagcggcgcagtctcggctccctgcaacttctgcctcccaggttcaagcgattctcctgcctcagccccccgagtagctgggactacaggcgcccgccaccgtgcccggataattttttgtattttgtagtagagacagggttttaccatgttggccaggcgggtcttgaactcctgacgtcaagtgatccgcctgccttggcatcccaaagtgctgggattacaggcatcagccactgtgcccagccaatatagcagtttttctaaagcagttttcagaaaaaaaaaaaaaaaaaaaatcagtggccgagaggaagaccactgagcagcatctcatcaccaagtccttttgattctacctccagaaatacctcgactctctcctctctaccgcactgccccacccacctgcacctccttgcagttcatctcacagtcagccagaggagcttttgaaaaatgcaaacctgaatgtcactctcagcgacttctgatgattgtaacatataagcttgagcttcttaatttgcatactgtggtcttctgccagaccacccacaggagagcctttgatctcccttcaaatgtcactggcttggggaggctttctcaggcagcccccaccccgagactagtttaggtccctgtgttttctgctccctgaccctgtccactagcttgaatccacatttgcagtttgtattgtcattacctgttgaactctctgcattcgcctccaccctgggggtgggggtgggggtgggggtagggacttgccactctaccccagttcctcttcctctgtcatgtgattataacaagcctttcccaatttggaactagattaactgcttcagaagtagaaaatgcatttggaactagctttttgagttggaaattaacggtgttcctggtgggaggaccccagccttgagtttttcagtcctgtatccttatgcacacgttggtgaatagttctgtgaccaacattgctttttcttctttcaataacatcctctgaggtggctcttgggtcacagaacgactgaaaatcgatcagtcctttcattgaccccttgaatcatagtcttacgtggaattaaataaactctgttgtcgggcggggtgcggtggttcacgcctgtaatcccacaactttgggaggctgaggttggcggatcacgaggtcaggagatcgagaccatcctggctaacacggtgaaaccccgtctctactaaaaatacaaaaaaaattagccaggcgtggtggcgggcgcctgtagtcccagctactcaggaggctgaggcaggagaatgggatgaacccaggagcggaggttgcagtgagccgagattgcgccactgcactccagcctgggggacagagcaagactccatctcaaaaataataataataaataaaattttaaaaaaaacctctgttgtcattaattttcagggtagaggtttgagctcctgttttctgctttatgctgaggcagtgggaagtgagtggagaccttagagggtggaactgacacacaggagcgggtttgcctgttagcatcacaaaacatgagtaacagctgctcccccaggcgggggggttgggagggggtgtggggggttggggaggctttgtgttttattttttgaagagaggagtgtaggatttcatgtaagattaaaagcctccttctgttagtgaaaggatgaaaaggacagttgctaaatatgtgtcattaaagtaaagaattagctacagttgaggccgagcgcggtggctcaacacctgtaaatcctggcactttgggaggccgaggcgggcagatcacttgaactcaggagttcaacaccagcctggccaacttgatgaaaccctgtctgtactgaaaatatagaaattagccagcttggtggcaggcacctgtaatcccagctactcaggaggttgaggcaggagaatcgcttgaacccgggaggtggaggttgcagtgagctgagatcacgccattgcactccagcctgggcaacaaaagcaagactctgtctgaaaaaaaaaaaaaaaattagctacagttgaggttatttaggttatttccagttagaagttctgataccattaataaatattttacctttaagctaaaagaagcttaaccagtgttttagttaatagcagccaaacaacaatctgtctacttgcagagtctgccatgttccttctactcacagtccacacagactaagcagagctaaagatgcagacagggaataaccaagttcacacttcatctaggatgttttcctgataccccctaacctggagttaagtcatcgtctttggtgtttggaagtcagatgttttctattgaattgatgcctacatagtacccataactccccactcctgacattcgtcacactgtgatgcacctggcagctttctagtcccctaagctccttgggaagggtatccattttatcctcagttcacctagcccagggcttggtgtttgtctagtacaggtcatcatatgattgttgaatttttcaaatacacagatttttcttgaaacctcttgatctctgtgttggtctcttcctgccccctcccttcctctcctttcttctccctgttcgtgcagttgaaattctgacattccaagagcatttcagctccaccaaataggacttccacatgtcacaaaacgcaagacagttattttgaatggaaactttttgtacccctttggtagaagtttattttggggtattgtctatgcatttaggtttcattgcctccagatttatctgggtggagtaatatcacataagtgtgaactaccttcctgttttgttaaaaatatcaagagcaatttctcttgatgataagaggtcaactgaagaggttgatgagcatatcctagttatcttttgaactaaaatatttctcagagaaagaaatatcctgtaatttggttagtcgtcttaattgttcatcttctaacatgtatgaacattataaagaaacttttttaatacatgaatagtcctggtctcttaatgtgatcatttttctccatcaacctagttgctggtcagtgggtgaatcaaaaaatccaaggtcttgcagactgttccataaaaattttgctggcagagttgtagctattaaaattagcaccctgcaaaagtctgtcacaagtcagacaggcagaccgaatcagaattagacatcacattgccaggaagcgctccatcctgagagggattaataggacatgtgtagaaacagacttacacctcctctctccctggtccagccccctttatccctgtcatactgaaagttccctgctctacccacccacccccactccttcccaatcttatacctttttttttttttttttttttttgagacaaggtttctctctgtcacccaggccggagtgcaatggtgcaatcacaggtcactgcaggcctcgacctcccaggctcaagcaatcctcccacctcagcctcctgagtagttgggactgtatgtgcacaccaccatgccaggctaattgttgaatattttgtagagacagggtctccctgtaccctctaggctggactcaaactccaaggctcaaggcatcctcccgccttggcttcctggagtgctgaaattttacaggcgtgagccactgcacccagcctacttagacaaagaagtaggtggccttgtggaaaggtactccacatggcctttaggcagggtgcttacgttacaggaagactgattgtttaattctcttacctcctttacctctccttgcttggatcaacaaactcatggcagtctttctaggatctatttaagaggttcttgtttatcaccaagaatgtataaattgacggtgcggtggctcatgcctgtattcccagcactttgggaggctgaggtgggaggatcgcttgagcctaggaattggagaacagccggggcatcatatgaagaccctcgtctcaattttttattaaaaaagaagagagagaatgtataaattgttgtagacccagcttgctctagggcactaaatgtattacttagaacacttagaacaaagcccccacatataagtcagttccccaaaatatgctagataccatactaagagctgtgaggaagacaaatgagaactgggtatggagccagcttcattgcttgcgggttagtttgggagggggccaagacatagcagcacatggtccaagtagtgatagaccagataccataagggattatattattgacagtaatcctccattaaatactataagattgaagcagagggaaaggtgaccagggtggttgtaagctctgaactgaattttgaaagatttcagtagacaaggaaaagtacagacaagcggtggggaggagtacagtgtgtttagaggtcggtgagttgactagctgactgcacggcagggctcatttggagaagcaatgggagatcagagcagagagtcgatgatggccaaattatgaaaactggaatgccagactatatttgcacttgtagaaggatacttacggctttttaacagaaaaattatggtggttaactttggagcacttaagcgttgttgcctggacatttggtgggtccccatctcctgactcaccaatgtttccctgtcacactgatccccactttgagcagctacttttcagaaaggttgcagttggaaagaaagcagtattcatggggcacaactccttccttcataggcagagggaagtataaagtaatgaatgatttttaccgtggaaagttggagtttggggactttgtcctcctccctgtctttccttcctccttcccttttttttcttcttttcctttaaaaatgtttaaaaggtgctaagtcagaacctctcaccattccatcaccaggggtcaggaggtatacctgactaacaaataccctttgtttttcttttgtgttttttttttttttttttaatggagtcactctgtcacccaggctagagtgcaatggcgtgatctcggctcactgcaacctctgcctcctggtttcaagcgattctcctgcctccaagcgattctcctgcctcagcctcctgagtagctgggattacaggcacgcaccaccaagcccagctaattttttatatttttagtagagacagggtttcaccatgttgaccaggctggtctcgaactcctgacctcaggtgatccactcacctcagcatgccaaagtgctgggattacaggcgtgaggcactgcgcccagccaggagagttttaaaacttcataaatgcatttcatttcttctcaactttctggttgttaaaagccaagtacgtatcacctggcctggttggcgaagatgcttttcagatttttattgagccgtggccttgctgtagttgcggtcattccaaatggagactgatctgctcggcatatgtgagaactgttctctctgtgttcgtgggtgagcaattcaagctttctgtgggaccagaaaccttaattattgaactacctttgctggttatctcatcactaaaattgttaatcgtttatctacactgtgggtgtttttcatgatttggcacacagcatagcaggcagcattgccaagatgtttttcatgttgcagaaaaactgtaacagatggaggtggtgattgtgaagcacttatttaaagtgttagtaatgaatcactatagcttgaaactgagtcagttatccatactaagggaagttgaagaacattctaatagcttctaataaaatacgtaatcaggcacctgaagagaactgactttgagtggctctcccattactgttaccctagccagggcccttagaatttattcttaggggctaaagtcttttaaaagcatgcatgcatgtgtgttttctcttttctaggaacttgaaattatgtagtagatgtcactagaattcttgaaatttgtcttcaagtcatggcagtatttcagtatcgctcctttgggattgcctgagtgatactcaagagttagactagttttatctgggttctttgaagaaccggggacacctcactggcttatgttgaatttctgcactgcagggaccaactataaatggtgtttttggttttttacgtgttaagagctttaaaatgtaattcttcctatcattcatgcacaaatgttctcacacaaattgcttcacagattgataaaactttgaataatttttccctgaagaaatgttgaacttttctgcaagctgttggaattggagcgcgtgttgaaaggcttgatgggaccgtaactgtacagcctatttcttttaaaaaaaattatgatttctattttttattcatttacagatgactgaatatgttcaggccagaaaatatccccttatttcaaaatgcagcaatctataaacaaaatacttgccatttttctaaatgacacctttttctataatttgtatagaaaattaagtgcaagggccaggcaccgtggctaacgcctgtaatcccagcactttgggaggccaaggcgggtggatcgcctgaggtcagtagttcaagaccaccctggccaacatggcgaaactccatctctactaaaaatacaaaacaattagccaggtgtggtggcagacgcctgtaatcccagctacttgggaggctgaggcatgagaatcacttgaacccaggaggcagaggtggcagtgagctcagatggcgccattgcactccagcctgggtaacaagagtgaaaactgaagctgtctcaaaaaaaaaaaaaagaaagaaagaaaaaggaaaatgtatatatcattataggtcagtgaactttcacaaacagaacacacccaggtcaggaaatgtgagataaacagcacctctagagttccttcatgtccccttccattgacttgtacatatatatatatattttgaagtaaacataaactcttgggaggccgaggtgggtggatcagggggtcaagtgatcgagaccatcctggccaacatagtgaaaccccctctctactaaaaatacaaaaaaatagccgggcgtggtggcgggcgcctgtagtcccagctactcaggaggctgaggcaggagaatggcgtgaacccaggaggcggagcttgcagtgagccgagatcgtgccactgcactccagcctgggcaacagagcaagactctgtctcaaaaaaaaaaaaaaaaaaacataaactcaggattttattgtcttcataataaaacaaaagatgacacttagaactggatcacttggccctttctcttcttatctcctcccagttcaaaatgcttgcatcttttaatagccagcattctcttagatctgcagttgggctcaacgcactcaagccttagcacagtcttctttgtggtttcagcctttttccggaaaatcgacttagtctgcccaccatagccactctgcttcctgtcataacgccgctttccctgggcatacagagaatcctttcccttcttgtactgtgtcactttgtggggttgatgcttgccacacttcttagagaaagtccagtgaattttaggaaagttgaccatttgcgtgagtgctatcagcacagaaaggacttgtatatttttaattcttctgtgtaaagctcacctcattcctcatctcttaaatttcttcctgatttgggctcttaacattattttcagtctctttgcaaaaaaaaccaaaaaacaaaaagaactgtcttcactgaaacttgtctcttcctcctcttataatctcatctcttgatcaatctgcttccgttaaaccaaagtgtcgtgtggctacaaagtcataactcgagggaatatgggggttggaatagaaaatgcagctgtggggtaatagctaaaaacattccttggagattttaaagctgaaggaaactttttgtgagctcacccgtggatttgtgcagagggagtgaataagcaagtgaagacacagtgatgggagcagcttgctcatgctcaggagtctgactaggcctttaaaaattatttgtggccgggcacggtggctcatgcctgtaatcccagcactttgggaggccaaggtgggcagatcacctgaggccaggagttcgagaccagcctggccaacatggtgaaaccccgtctctatgaaaaatacaaaaattagctgagcatggtgacaggcgcctgtaatcctagctactcaggaggccaaggcaggcaaatcacctgaggtcagaggttcaagaccagcctgaccaatatggtgaaaccccatctctgctaaaaatacaaaaattagccaggcgtggtggcgggtgcctgtaatccccagaggctgaggcagagaatcacttgaacctgggaggcggaggttgcagtgagccgagattgtgccactgcactccagcctgggcaacagagtgagactctgtctccataaataataataataataataataataataataataataatagtagtagtagtagtagtagtagtagtagtagtagtagtagtaaaagtaggccgggcgcagtggctcacgcctataatcccagcacttttggaggccgaggcaggcggatcacgaggtcagatcgagaccgtcctggctaacacagtgaaacccgtctctactaaaaatataaaaaattagctgggcgtggttgcagacgcctgtagtcccagctactcgggaggctgaggcaggagaatggcctgaacctaggaggcggaccttgcagtgagccgagattgtgccactgcactccagcctgggcgacagagcgagactccatctcaaaaaaaaaaaaaaatagtaacagtaataaaataaaaattatttgtgaaggatgtgagctttcacctaaagccacagcaaatgaaacaatctttgtaggcgcagcctcatcctcagatgcttctggtctctgccacctcgagctcttcaacattcatttgtgttctttgctgttttgttttctttttctttcttttttttttttaacccgacacttcagtagctgttttgtatacttaaacatttgaataaaacttaatttttaagcatctaattacatcactccagtttcagggcttgtgtgtgcaagctcccagtgcaggtggagcagttgggttgaaaggcctggtctctggctcagggttgcagctgcattgttcatcctgtgttttgcctccggcagaaccaagctttttctgaaattctagagtgaagaggtttagaggtatgtgcagcaatacctgggctatctgataacgtgatattctggatactagaattttccagataaccaaaatcgtaaccattcatgtactcaaatgttacatttttggccagcatggtggctcacgcctataatcccagcactttgagaggccaaggtaggtggattgcttgaggccaggaatatgagaccagcctagccaacatggtgaaatcccgtgtctgctaaaagtacaaaaatcagctgggtatagtggcgcatgcctgtaatcccagctacttgggaggccgaggcacttgaatcacttgaacccgggaagtggaggttgcagtgagccgaggtcatgccactccactgcagcctgggtgacagagcaacagagcaagactctctcaaaaaaaaaaattacatttttaaaagcattaattccgtattttccttctttctgggggagaaaaacatactaaacaccaagtaataatttttgttctgtagacagccatagttctaagttgatgtcaaatctaggagttgccctggagttgtgtttgttgggggaggggacactttttagagggatttgcctctgtcttggtaaaggtgacaagaagagagtgtagctctatgaactcctggcaggtaaatagagttatctttttctgcaaagttattggtcacaaatcaaaagtgtccctttctaatgattactttgttctgttttgatgcacaaataggttacaagcagctctttgtcagtctgactctctgtcttccaagaacaagtgtatacagtaaaagtagacacacctcaccatttcaggagttaagacattttcaaaaactcttcatagctggtatgggtgcacgcacctgtagtcccagctactccagcctgagcaacgtagactctgtctctgaaataaaataataaatattgtttataagcctgtggggtttttattattactataggatgatgctttataaggtcattattagaccacattttccttctagaccttatttttggtagataacagaatcctggccttaaataacttttaaagtagctccttttctcaaaggctattcagagttttctgtgctgccagtacaggggcaggtggtggtggcccggcagggttcaagcgcactttccctcctcaaacttgtccttggtgtgtgctttataattgtctatcaatacagcaccattgctggctgcagcacaatgcagtgtttttaaaatgaagacttaaaaattatgagtgtaccttgcatatattgttttatctcattccagtctttgatgtgatttttttacgagaaacaaaatgatgactagaagaaagttttcatcaatactctatcaatatttatgtgactcttggaaactttgaatacactgggatttaccactagctaattttttttgagagtttgctacacatatttattagctctttcaggatttatcaccttatcctaagcattgaaacccagtgtctggcacctgcagtcagagtgtggtaagcatagcagataagcaccagcattgcaaagctctgcagggcataccctctgttaagaaagcgtagtcattaatgcagcctggctagttgtcgatcatctgtcattcttatctaccctttctattgcatctcactttgaatggcagtacacagacagcactcactttagagcaatccagcttctgattggctacgagtacagcattgttcaacatcttgaataaatcattttgtaaagaattttaccagtttcctctcagaactttgttatgcagtgtagattaccactgtactagccaacattttcctgggcccaccattttggggttgtattcacatttttgttttatcttttaccaactttatgccttctgccctttgccttttgttgtaagtctagaattcatagggtggctttcacgctgtacctgattctgttctgctccgtatatactagtccccccttacctgcggccagttgcaatccaacatataaataacatattttggccaatcgcagtggctcacacctgtaatctcaacacttaggtaagctgaggcaggaggatacttgagcgcaggagttcaagaccagcctgggcaacatggcaagtgcctatagtcccaggtactcaggaggctgaaatgggaggatagcttgaacccaggaagttgagatgccatgagccgtgatggtgtcactgtactccagactgggcagcagagcaagaccctgactcaaaaaaaaaaaaaagatattttgagagataacacattcacataaatttttattacagtatattgttataacttttcttttacactttttaaatataaagacagggtctcactatgttgcccaggctggtcctaaactcctgggctaaagcagtcttcccaccttagccttccaaactgccaggattacaggtttgagccagcacacctggcctgttaaaacttttctattttactactagtcatcattaatctcttactgtgcctaatttacaaattaaacttataggtaggactggcatggtggctcacacctgtaatctcagcactttgggaggctgaggcaggagaatcccttgagtccaggagttcaagactagcctgggcaaaataaataaatcggctgggcacggtggctcgtgcctgtaatcccagcactttgggaggccgagtcgggtggatcacaaggtcaggagatcgagaccatcctggctaacatggtgaaaccccgtctctactaaaaaatacaaaaaattagccgggcgtggtggcaggcgcctgtagtcccagccactcgggaggctgaggcaagagaatggcgtgaacccgggaggcagagcttgcagtgagccgagatcgcgccactgcactccagcctgggcgacagagcgagactctgtctcaaaaaaaaataaataaataaatctaaaaaaaaataaaacgtataggtatgtgtatagtgtaggaaaaagcatagcatatctagagtcctgtactatccacggtttcaggcacccactggaggtcttgaaacgtatccatcatgataaggaggactactgtattactctacacattacagcgtcatggcctagcctatgcatggcctggtacatgcaattcaagaggcagcattggagagaacggtcattggaaatatgaaagtctgggcatgatgttagctctgtggggtcactacctcgtaacctgggttgaccattgatcttgtttttttacatctgtagaatgcagtggttcagttccaggatttccaaggcatctgcctgaattctgctggttgatatgctttcagcactatctaactttaatacaatgtggcatttgggttattgaactgagtaggatttgccatgctttttcctgaaaatagttttcccatacgagggcatatggttgtcctcacaagcagcagtgttctggagctgtttggtgggtgacccgtacttgcggtaacccagagaagccatgaggggatccaggactgtatcactgtagattctggaggtcggttggaagatctctagaggagtctaataaaaggttctgttgctgcttagttctgctgtgacacctctctctcccagaaagtagactttgtcttcgtcaggctcccttattctcctatgtgtttgccattttccagaacctcttctccaggtttctctcttagaaaaaccaaaccaaacaaaaaaactggccgggcacagtggctcacacctataatcccagcaatttgagaggccaaggtgggcagatcacctgaggccaggagttcaagaccagcctggccaacatggtgaaaccccatctctactaaaaatacaaaaattagctgggcaacgtggcatgcgcctgtaatcccagctactcgggaggctgtggcaggagaatcgcctgaacccaggaggtggaggttgcagtgagccaagatcgcgccactgcacttcagcctgggcgacagagcaagactccgtcttaaaaaaaaaaaacaactaatacttgccattcttctttctccttccttactgagggtttcattccagatgtttgggagcctgaattttcattttcagagataatttctgtttcattttaacagagtttaacataatgctggttgtttgaagttaaaaggagtcttatatccgtataactgataatacttcgagtgaaaccgttcacagacctaaaagatagcataattgtcttgtaactatctttttaaagggaaaaggaaatgattgggtttttttgttgtcttatttcttttcaggttttgaacgaagaatgtgatcagaactggtacaaggcagagcttaatggaaaagacggcttcattcccaagaactacatagaaatgaaaccacatccgtaagttgagctccattagtcttggaagggttggacccacctccttgtttcaaacactctttttaaaattgagatcactgggatggatgtcatactttttattcacgtttctagggaattaacaaaggatattgattgtgcatgttaatagtatataataatatatcatagtcaataatattatatgttttagattgataataactgtcagtgatcttcaaaaataaaacgatagttggtgcaggtccgtaattctttttctgttaaatatgtcttagagccagatgtgttttataattctgcattttttttgagttttagaaaaggtacttagatgattttgtgtttatatgtgctaatgctgtgggacggtatcttaatatctttgtatccccagagtacggtgcttggcatctaatagttctcaataaatgtttatccctccatcttagtgttcctacttacaagagaacaaaatatgctgtcctccaggctgctgggagcagtgaatatttttaattttttttcagaagctacccttgtcacgattttattaataacgcaacatagtggacccctgagagcccctgcagaccactgtcctcccgttctcacccacccctcattcacaggccctgctcctagcacagaagcagttgctggcttgccttacaagtgtgtcaggggagctgaggctttccacgctcagactagaatgcccttggacattgtccacttgctttcacagcagctggtggcggagactttcaggtggcttgtcgcatcttgagtgggaggggcctgttggatcacagcacatcctccccaggtcccatataagccacataatttgtgtacttctgtttccttcagtcgtcctcaaaagaaactgtaggtcaagggttggctaaactttttctgtgaagagccagatagcaagtaatttcgactttgtgggctgcatacaatcctgtcaaatattccttgtaaaaattttcttttaacaatcgagtagaaatttaaaaaacagtcttaggttgtgggcagatttgggcagaaggccattattgtttgctggctccttcattagatccaaacacaacatcgacttcagttcccttttgttttcatattttcagattgaaagggaattcaacagaacatcatactacacttcttatatgacatgcctgtggctcgaaattcttatttttcttcagtgtttcgggtgacacaggcatttaaatctgactgttgaggaaagataggaaaggctaccttccttggaaagttgtagttactgccaggctgactgggacagtcactcccttgccttgaccttttgtccccactatgaagaactttagaagaattgatggagaagcacccagcacaggctcagctgtgttgttatttgcagactctgcccaaagggtgggcagtgctcagccactctgagctctgaaaaggcaactagcaacttaaaaacccttatttattcaggtctaccatattgctaacaaagaccatgcttgtgcctatgtaggtgtttggccttgcagacgtagttgctgttgtatagggctgctctgtggctggatgttcatgagtatagggtcagggtcagtaccaggccttctcctccacatcctaccacctcctgtttttttgtttgtttgtttgtttgtttgtgggggtggggagcaggggttatggaggaagagggaagcataaaatgtagcaccatgtcagctaatgcagcattcaagttaacaaattagactacaaaatgattgttggcattagtgctgcagcgtgagttgtatatgcttgaggggtggatccaaatatgtgcttttcacactaaatgcatatggatgggagcctacgggatgtagtaaagaattatattggaaaattagccttctcccctcacccccttagctctcgcccttgctatttctgttgtataagcccaccttttttttttttgttttttgtttgttgttgttcttgttgtttttatgagacggaatcctgctctgttgcccaggctggagtgcagtggtgctatctcagctcactgcaacctccgcctgctgggttcaagcgattcttgtgcctcagcctgccgagtagctgggactacaggcgcgtgcctccactcccgtcgaattgttgtatttttagtagagatggggtttcactgtgttggccaagctgatctcgagctcttggcctaaagtgctgggattacaggtgtaagccaccgcaccctgccaaagcccatcttttgtttgtttgtttgtttgtttgtttgagatggagtctcgctctgtcgccaggctagagtgctgtggcgcgatctcggctcactgcaacccccaactccctggttcaagggattctcctgcctcgacctcctgagtagctgggattacaggcatgtgccaccatgcctggctaatttttgtatttttagtagagatggggtttcactgtgttggtcaggatggtctcaatctcctgacctcctgatccgcccgcctcggcctcccaaagtgctgggattacaggtgtgagccaccacacccggcccaaagcccatctttttaaagactttcaaaacatttgcctgttagagcttgcagcaagccaagatcacgccactgcactccagcctattcaacaaagcaagactctgtctcaaaaaataaaaaataaaaaaaattcacccgtaagcatgtagtcacatgtacatatcatcattttaaaaagtcaaatttataaatgatataaaatgctatagaaatgtagaatggtggtatttcagtgttttagtagtgacagctattcacagggtcttgctctgtcatccaggttgggctcaagttatcctcccaccttagtctcctaagttgctgcgtctacagctgtgcaccactatgcctggctaattttttatttttcgtagagacagggtctcactgtgttgcccgggctggtcttgatctactgggcttaagcaatcctcccaccttagcctcccaaagtgctggaattaacaggcgtgagcaactgcacctggtgccagattttttatttcttgatctgggtgcttataacagagttgtggtttttttggtttttggttttaattccagttagagtactttttaaacattataatttgtacttcactacaatttattttttttaattgaaaataaaattgcgttaattttaagctgggggcaagaaaacacagcagccatgtctatgtgacaccagacagaaaggtctggaaacctaagtgttagaaccgccaacacgtgctgcctctggggagtttgagggaagcatcttactttttatgtttgcttcatgtacatctaggctatttcagtttatattcattattttatacctacaaatgggaaaaaacctccctagtggagagatcttgggggcctaggaggaaagagagccttgctgattgagaatcttcaccctcaccattgctattggaagtggcaatggtggggagtgtggggcagtgtggggagagccagccgaggccatgtgtggattttcactgctgtacccagtcagatgcatgctgcatacacttatattagaaacccagggccccccgatatgagaaggtttaaataccgttgattggggccccccgattgagaaggtctcaataccgttaagtgtccttatttatttatttatttatttatttatttatttattttttgaaagcgagtctcgctttgtcgcccaggctagagtgcagtggcgcgatctcggctcactgtaagctccgcctcccaggttcactccattctcctgcctcagcctcctgagtaactgggactacaggcacctgccaccacgcccggctaattttttgtatttttagtaaagacagggtttcaccgtgttagccaggttggtctcgatctcctgactttgtgacccgcccgcctcggcctcccaaagtgctgggattacaggcgtgagccaccacacccggcctatttaatttttttgagatggagtttcactcttgttgcccaggctagagtgcaatggcacgatctcggctcaccacaacctctgcctcccggagattcaagcgattctcctgcctcagcctcccgagtagctgggattacaggcatgcgccaccgcgccttgctaattttgtatttttagtagagatggagtttctccatgttggccaggctggtctcgaactcctgacctcagatgatccgcccacctcggcctcccaaagtgctgcgattacaggcattgagccaccgcacccagcctccttttttattttatttatttatatatttttttgagacagagtctcactctttcgcccaggctggagtgcggtggcacagtctcggctcactacaacctctgcctcccaggttcaagtgattctcctgcctcagcctcccgagtagctgggattacaggtgcccaccactgtgcccatctaatttttgtatttttggtagagagtgggtttcaccacgttggccaggctggtctcaaactccggacctcaagtgattcaccccacctcagcctcccaaagtgctgcaattacaggcatgaggtaccgggcccagcctgtccttttatatttagagagcattctattctagtgatatgtgatttctcttgtgtggcctgatttccaggcactgcaggccctagccttgagttatttgtagaagcaggaggatctattgtcccagctcctcagcatcctggcagtagagtatgcaaaatgagaaagactccaagcaggtagatgtcagactattcagagttactaagagtccctagaggctgacacacacacacaaggacaaacttactaagggcagcttctaagtgtatccttcctagcagatcacatctttctgtttgaatttgagtatagtatattattttaggtacatcttccaatatggttgcttataagtaagatatgtaaattagccgggcgtggtggctcgcgactttaatcccagcactttgggaggctgaggcgggcagatctcgaggtcgggagttcaagaccagcctggccaatatggtgaaaccccgtctctattaaaaatacaaaaattagctgggcgtggtggtggccgcctgtaatcccagctactagggaagctgaggcaggagaattgcttgaacccaggaggcgaaggttgcagtgagccgagatcgtgccactgcactccagccttgatgacagagtgagactctatctaaaaaaaaaagggccgggcgtagtggctcatgcctgtaatcccagcactttgggaggccaaggcaggcggatcaacaaggtcaggagatcgagaccatcctggctaacacggtgaaaccccatctttactaaaaatacaaaatattagccgggcatggtggcgggcgcctatgtatagtcccagctgctcagctacttgggaggctgaggcaggagaatggcgtgaacccgggaggcagagcttgcagtgagcgagatcgtgccactgcactccagcctgggtgacagagctagactcctcaaaaaaaaaaaaaaaagaaaagatatgtaagttagatttacaactttaatggactatttggtccattaaaaggacttttgatattataattagcatattaaatgaatgccagtttccatgtttataggtctttatttgctataacttttgcttttaaaaatgataactaaagacaattttgagaagagaacatggttttcacagtttcttcttcctaattatagttttcatttgaaatagtgaggcagcttgacttgaagctcttgtagaagtgttcctctcctcttcctcttgataagccacagccagttgcttcacagtttttcatgaatttagccactttttcttctggccaaggtgaatcagcaattgggagcagaagagtctgcaacttgcctcaaaaatctgaattttgcagctagctgctgagcatatggtaaattacaatattcctggtggcttctgaaagctgaactctgagcagtggccccagaggcaggccttgagaggaatgctgaccttagttactggtagaggcaccctcatactatctgaaccttttgcctttgggctgttagcaaaagtaaccctgcctccagctcctggccgtccaggtttcctccccactttcccttagtcccactgtggtgaagctgtgatcttatcacatggctgcaggaaggggccagtctctccttggcagttcatcccgtacaccaagcccaaaggcctgagcttttccccaggcgcctttgtcatgagtcagtagggagtccagtgggctttggcctggggggcccattttcaaatgtctccctctatagaaagagtgacccacggttagtgccttggtgagtcgctttctgggaaatggagtaggctaaagacctttgaaggtccatctctggggacccaacccagtgtcgatcttgggcactgtgaggctggaggatgaggagggaggccccttcctctggcaaggagtgttgtgttactcacattttgaaggctggatatcccgtttctttgtggggaagcagatgttgaccagcttgccttccttccttaggtggttttttggcaaaatccccagagccaaggcagaagaaatgcttagcaaacagcggcacgatggggcctttcttatccgagagagtgagagcgctcctggggacttctccctctctgtcaagtaagtatttcctgctgcagttgcctggaatcctgtctctgactgatccaaattgtgaagccgttggtcaggtgcctggctacacacaaaatggtggaggcttagcctaaacagtttcttcatttcacattaaaatcctaatttctggctcctctcaaaatgagttctagaagcactggatgtagattcccatgtggacacagccttcaggaggtgagcagcagctccctgcagccagctggagcctgccagttttccctagtgcccagcactcctgagcttctgccctccgagggattcccgcagctctctctaatgggatagtggagcgcctgtcggctgccttggcttgccttgctcaggtccactgacttaaatcaaccagccccatcctaggccctcacagtcacttaagaaggctgctgcaggggatgtggggcttgcatttccccggtggaaagttcaggtgtgaaagggagcgggtaagcagggaatggagaagacaggaagttctgccgccatggagagtgtggagaatagaaaccagcacttgaagattctaaacaattcacacctcagctgtgaagtcgggattttgaattaaattgttatttccatatgttttttactttcagttattttctagttaatgtattatcataggaccctccccaggagtccggcagatcacttcatcagttatatataaagaagtaattagattcaacactcagatcactacttagtttagattacattaagattgttttgtttttgaatgggggatagaaaaccattttccttttattttatttacttatttttgagacagagtctcgctctgtcccccaggctggagtccagtggcatgcctcagctcactgcaacctccacctcccaggttcaagcagttctccctgccccaccctccgagtacctgggattacaggtgcctgacaccacgcccggcttatttttgtatttttagtagagatggggttttgccatattggccaggctggtcttgaactcctgacctcaggtgatccacccacctcgacctcccaaagtgctgggattacaggctagagccactgcttccagccaccatttcccatttataactgatgtaaagcgtgagacttttccatttcaaaaatgaactgaccagcctggccaacatggtgaaaccctgtttctgctaaaaatagaaaataacccaggcatagtggcacacacctgtagtcccagctacttgggaggctgaggccagagaatcatttgaatccaggaggcggaggttgtagtgaggcgagatggcgccattgcactttagcctgggcgaagagcaaaactctgtctccaaaaaaaaaaaaaaaaaaaaaaaaaaaactgggtgcggtggctcacacctgtaatcccagcactttgggaggccgaggcaggcagatcacctgaggtcagaagttcgagaccagcctggcgaacatggtaaaaccctgtctctactaaaaaaaaaaaaaaaaaaaaaaatacaaaaatggcctgggcgtggtggcgtgtgcctgtaatcccagctactcaggaggctgagagaaaagaatcacttgaacccgagaggcagatgagccaagatcgtgccactacactccagcctgagtgacagagtaagactgtgtctcccaaaacaaacaaacaaacaaactgaatatcttatttggttttagaaccacttaatgtgtgattaaaatgtagattttttttttgaaacgtagattttaaatttatagttgtggcccggcatggtggctcatgcctgtaatcccagccctttaggaggctgaggcgggccgatcatgaggtcaggagtttgagaccagcctgaccaatatggtgaaacactgtccctactaaaaaaatacaaaaattagccaggcgtggtggcacatgcctgtattcccagctactccggaggctgaagcaggagaatcacttgaacctaggaggcagaggttgcagtgagccgagactgagccattgcattccagcctgggtgaaagagcaagactccatccatctttaaaaaaaaaaagaaaagaaaagaaaaacatgtgtgacacctgtctttctttagttttatactgacccaagtgtaactgaaaccttataagatgaggggaacaagcagtaaatcactgggtggtggccaaaaccacgggggcagccacgtgctcggctggacgctgcctgtttgctcagcagaaactctcaaacttccattttctcaagtagaatcttttaaggatttaatgcatttattgttttagaagcaaagcaggtgtcatgactctctttaacaacacacacacctctgcaaaaaaggttcaagaatcaacagttgtcagatgtttcttagttttaggatgttttgagcctgtgatttgaaacactgctcattattggggccctgggctcttagaaaccacctgcattgcatgggtggaagtgggcctctgtggggccagaagtgccgtggaatatacccttgctaatgaagctttctcaccttccacattttgtcttaacatgtaaagcagtattttttccaaatgcgaggcatcttgtgctgagtggcttccttgaggctcagtgctgccacctgccggattgattttctgaagcctttggtttccatcagctgaaagactgaaggagaggagggactcattcattcattgaacaagcactctcagagaatgcctttttttttttttttttttttaatgagatggagtgtcactctgtcgcacaggctggagtacagtggcccaatctcggctcactgcaagctcctcctcccgggttcacaccattctcctgcctcagcctcccgagtagctgtgactacaggcatctgccaccacacctggctaattttttgtatttttagtagagacggggtttcactgtgttagccatggtggtctcgatatcctgaccttatgatccgcccacctcggcctcccaaagtgctgggattacaggcatgagccaccgcatccggccgagaatgccgagtgcccggccaggtgaacaggacaggcagaagcgccctcgctaggctggtgttttagccaaatatcctgtgacagaccctgtgagctagtaccagccagccacgctgttgccggttttgcttgccagtataaaagggtgtgatctagtgatggagaagcttttgggttttgaagtctgggcctcttttattgtcccagtacgtccttttgttcagagaccttttccccatgagtggagctaaaattcctgaatggaaaacattactttgaactattcccagttacgagagaattgttgaaagtatttccagccctcctcaccttcttcctgcatataagattttaattatttttttattcaaaggatgttaagtcacactcctttgtcttaagtacggctgtttttatttggtagggttcagggcacatggactctttttttttttttttttgagacagagtttcactcttgttacccaggttggagtgcaatggcgcgatctcagcccaccacaacctcggcctcccaggttcaagtgattctcctgcctcagcctcccgagtagctgggattacaggcatgcaccatcatgcccagctacttttgtatttttagtagagatgggatttctccatgttggccaggctggtctcgaactcccgacctcaggtgatctgcccaccacggcctccaaagtgttgggattacaggtgtgagccaccgcacccggcctggactctttatcttacaaacatcttcagaatgagaatgactgatggcctgtccctctctggtttctggatgttgtcctggtgcccatcattcatagggagaggtccgtcccagggacacccagtgaggaaacttgttgctctgcagtccctgaggagtgctgctgggacagtggttctctcgagatagctcctatatggaaataccctcgatttgccaagttagagcctttagccggtcacatgtgctttctgtccctcccaggtttggaaacgatgtgcagcacttcaaggtgctccgagatggagccgggaagtacttcctctgggtggtgaagttcaattctttgaatgagctggtggattatcacagatctacatctgtctccagaaaccagcagatattcctgcgggacatagaacaggtgccacaggtaagcctcatcagggtgagatgggatcatttttagttaagaatagctcctcagtgtgcattcctgtaggaaaggggaggcgcccctcaacatgcaggcgcccttcagggattgccgctggggcttctgtgctccttactgaaaatgttaccctccattcacactaaagagttcttttttctggcccagcatagtagctcacacctataatcccagcactttgggaggcggaggcaggcagatctcttgaggtcaggtgtttgagactagcctggccaacatggtgaaaccctgtctctactaaaaatacaaaaattagctggatgtggtggcgcacacctgcagtcccagctactcgggaagctgagatggaaaaattgcttgaacccaggaggtggagattgtagtgagctgagattgcaccactgcactccaacctgggcgacagagggagacttcatttcaaaaaaaaaaaaaaaaaaaaaaaaagatttgttgtttcaaatacaaggtttttgcttttccagaggcagtgtgtagccagcttgccagcctctctagggagatggtctttaacacacccacccaaagatcctgtccctggaagcaaattatgaggaaaactatgcttgtgagggaatggggtcggcacccgttcctgtccctcgagccctggtcgtaagttacggttagagccccttatgttattcgagctccagaactttaggctttaataccttaagggtgtcgtagaagggatttgcgattctgggcccacggcctaaacacagatggctgtttctgaagaactttctcctccaagcactgcctgccctctacttgataatacggcacagttggccaccctcctctgggagacatactctaatattttctgagcactgggaaatatcacactaaacccgcttggcctgtaaacttagaataggtaagaataaacggggggttgggagatgggaggtgagtttaagaaacatggagaatttggcacgcattcgtttccccctggaacccatctggcctcggaggtggccagtcagagaccaggaatgcaatgtgggtttttcctgctcctgttttgcagcagccgacatacgtccaggccctctttgactttgatccccaggaggatggagagctgggcttccgccggggagattttatccatgtcatggataactcagaccccaactggtggaaaggagcttgccacgggcagaccggcatgtttccccgcaattatgtcacccccgtgaaccggaacgtctaagagtcaagaagcaattatttaaagaaagtgaaaaatgtaaaacacatacaaaagaattaaacccacaagctgcctctgacagcagcctgtgagggagtgcagaacacctggccgggtcaccctgtgaccctctcactttggttggaactttagggggtgggagggggcgttggatttaaaaatgccaaaacttacctataaattaagaagagtttttattacaaattttcactgctgctcctctttcccctcctttgtcttttttttcatccttttttctcttctgtccatcagtgcatgacgtttaaggccacgtatagtcctagctgacgccaataataaaaaacaagaaaccaagtgggctggtattctctctatgcaaaatgtctgttttagttggaatgactgaaagaagaacagctgttcctgtgttcttcgtatatacacacaaaaaggagcgggcagggccgctcgatgcctttgctgtttagcttcctccagaggaggggacttgtaggaatctgccttccagcccagacccccagtgtattttgtccaagttcacagtagagtagggtagaaggaaagcatgtctctgcttccatggcttcctgagaaagcccacctgggctgggcgcggtggctcacgcctgtaatcccagcactttgggaggccaaggtgggcggatcacaaggtcaggagttcgagaccaacctagccaacatggtgaaaccccgtctctactaaaaataagaaattagccgggtgtggtggcacgcacctgtagtcccagctacttgggagcctgaggcaggagaatcgcttgaacctgggaagtggaggttgagtgagccgggaccgtgccattgtactccagcctgggtgacagagcgagattccgtctcaaaaaaaaaaaaaaaaagcccacctgaaagcctgtctctttccactttgttggcccttccagtgggattatcgagcatgttgttttttcatagtgcctttttccttatttcaagggttgcttctgagtggtgttttttttttttttaatttgttttgttttaaaataagttaaagacagtccagagcttttcagccaatttgtctcctactctgtgtaaatatttttccctccgggcaggggagccagggtagagcaaaggagacaagcaggagtggaaggtgaggcgttctcctgcttgtactaagccaggaggctttaagctccagctttaagggttgtgagccccttgggggttcagggaactgcttgcccagggtgcagtgtgagtgtgatgggccaccggggcaagagggaaggtgaccgcccagctctcccacatcccactggatctggcttacaggggggtcggaagcctgtcctcaccgtctcgggggttgtggcccccgccccctccctatatgcacccctggaaccagcaagtcccagacaaggagagcggaggaggaagtcatgggaacgcagcctccagttgtagcaggtttcactattcctatgctggggtacacagtgagagtactcacttttcacttgtcttgctcttagattgggccatggctttcatcctgtgtcccctgacctgtccaggtgagtgtgagggcagcactgggaagctggagtgctgcttgtgcctcccttcccagtgggctgtgttgactgctgctccccacccctaccgatggtcccaggaagcagggagagttggggaaggcaagattggaaagacaggaagaccaaggcctcggcagaactctctgtcttctctccacttctggtcccctgtggtgatgtgcctgtaatctttttctccacccaaaccccttcccacgacaaaaacaagactgcctccctctcttccgggagctggtgacagccttgggcctttcagtcccaaagcggccgatgggagtctccctccgactccagatatgaacagggcccaggcctggagcgtttgctgtgccaggaggcggcagctcttctgggcagagcctgtccccgccttccctcactcttcctcatcctgcttctcttttcctcgcagatgataaaaggaatctggcattctacacctggaccatttgattgttttattttggaattggtgtatatcatgaagccttgctgaactaagttttgtgtgtatatatttaaaaaaaaaatcagtgtttaaataaagacctatgtacttaatcctttaactctgcggatagcatttggtaggtagtgattaactgtgaataataaatacacaatgaattcttcacttggtatctttttttccccttgcctgccttaaaaatttaaaaaccgcatcggggagtcaggaatcttgggtccttatttcagacgtgatcacccagcttacatccccctaggggagcatgtggggctcacaggccttcctgggagcgatgcctgcagttggctgtcaggaactcctggggagcctgttaacaatacagaatcgcaaaccccgccccacatcctcggacattgcctttgaggacacagacacgcccgctgtttctgatgtagagaaaccactgaccacgctttgggaactctggtctagaccaagggctttgggaagataaagagcttggcttatttggttctcctgttttctgtgttaaacaagaagaaggacagaaacacctgtgaagaaacggttttaatatgctgagtaactgaaatatacttgtttgctcaataggctgcttttagggtgagactaggcatatttacacacacgttggctacagaggcaaagaagactgaacaaaaaagaaatgaggtctggccatggtagctcatgcctgtaatcccagcactttgagaggccaaggtgggggatcacttgagcccaggagttttgaggccagtctgggcagcatagggagactccctgcctctctacaaaaagcaaattagccagatgcagtggcgcacgcctgtagtgaggattacttgggaggctgaggtggatcacttgagcccaggaggtcaagactacagtgagctgtggttgcaccactgcactccagcctgggcaacagggtgagaccttgtctcgaaaaagtaataaaaaggggataggcagggtggctcacacctgtaatcccagcactttgggagactgaagtgggtgaatcacaaggtcaggagttcaagaccagcctggccaacatggtgaaaccccatctctactaaaaatacaaaaattagccagctgtggtggcaggtgtctgtagtcccagctactcgggaggctgaggcaggagaatcgcttgaacccgggaggtggaggttacagtgagccgagattgcaccactgcactccagcctgggtgacagagctaggttccctctcaaaaaaaaaaaaaaaaaaaaaaaggtaataagggccaggctcagtggcttacgcctgtaatcctaacactttgagaggctgaggcgggtggattgcttgagctcaagaatgccacaccagcctgggcaacatagtgaaacccatctctaccaaaaattagctgagtgtggtgatgcacacctgtggtcccagctactcaggaggctgaagtggaggttgcagtgagctgtcatgccactatactccagcctgagagacagtgagacctctctcaaaaaaaaaaaaaaaatacccaagaaatctcgacttgaattcttcttggtgtagccacactgagcaggggaggcttgtgggttgttttgttttgtgacagggtctttatctgccacccaggctggagtgctacggtgcaatcatagctcactgcagactcaatcccctgggctcaagtgatcacctcagcctcccaagtagctgggactgtaggcatacactactgcacccaagtagctgggactacaggcatacgctactgcacccaagtagctgggactacaggcatacgctactgcacccaagtagctgggactacaggcatacgctactgcacctggctaatttcatttttttttgtacagtggggtctgtgtttcccaggctggtctcagactcctgggctcaagagatccccccacccttggcctttcaaagtgct

SEQ ID NO: 15147 - DNA, 4357 bp, Human
gcttcaagatgtcaatgggacatttgtctgggtgccattttctcctccatatagttcatcctgcagccatccagcccagacttcacctcagcacatggcatgaccccaaggcagtgagtggacacatgcaaagccttttcatgtctaggctcagggctgccacgccattgcttctggcaaatattacccacattacaggacaggccagactcaagggatgggtaaacagacaccaccacttattggaaagagctagaaattcatataaccaagcaagtggatacagggacatgtgagtgttggaggaagtgtttcttattaatctatgatggattaatatatgataggttaatatatatgatagattgatatatatattatagtttaataagatatatgagatagattacacatacatacatatatatattctgggtattaatcgtttagagatttagatgtattattgaagtaccacctcccaaattgcatatgtgctgtggttttctctgtagttatgtattcatgaacaaaagttgctacttttcatgtagttaaattattcatgcctctttcctgtggttgatgagtggcatgtcttttcttatattgggaacatgacaatcttttaatatgttatcttgcaaaattggtaattctctttacttataaattagttgtaaattcaaatgaatttctttttcaatactaagtaaaataaaaacccaaatatgcacatggaatttctaaattgatatcaaaaggtgccaccaacaattattgaaaagcattcacatttgctcacatatcttgattttttacctctaccataaatgaaacattcattcacaaataatattcttgcctctcttttgtcttcaattgacttatttacttttctgtactgtctaaataatgaaaggtcttgctaccagaatggtacaactttttttctaactctttattttatttgataatatcttgattattcttgactgactattctgttatatgaaattttgaaacatcaacatccatgaaagagtacatattttagtctttggttgatattgtattgaaactgcagttcactgtgaagagaactttttgacaatattgagactttcaacctatgatgaatttccaactatttaaatggccttttaatatatatatcattaattttataacattctccattaaaccatatgtatttttaaatatttatccatagaatactgaaaattattagaacctcttgataacgttttcctttttgttttgtggattttctaatgtgtagaaatgttaaaagaaaaatgtaatgaacaccttttacctagactaattgttaacttgttcatgttttttattctctctctctcattctctgtatcactattagagtgatttattcaatttatagatttattcaattccatgtgttagcaattagtggcatcctcttgatatttaaagtctctcaaatttagagagtaagatacacttcaagcctgtatctgtttcctttagacatgaaattgttagtaattagacaattcctgccttgaattatgttgaaaacaaatgttgtttgcattatacctgtttattaaagagatatagaaattcaacaatatctatcaaacttaatatataatcttgttatttaaaaatttgcctctagattcttgtgggccttctaggtacatgaccctatcatgtgggcacaatgtcagcgctgtttcttctccattttctgttgaaattttctctttgtctgcagagttgcacagtttcaatacataatatctaggaatggatttctgcttatttttcgtgagctattcattgacccacctgagtgtttagagctgacttctataactgtttaaaacttaccaatattttaagtattgtctctgcaccctactgtctaatatacttggggattcacaactggcaatctaaaaataataaaagttttttatttctgataggtttttgagttccagttgactgcagaggacatgaaagccatagatggcctagacagaaatctccactattttaacagtgataggtaagtttcctttgtaaatgggtgatctaatttatttctagagaaggaatgtaggatgggtgttgagagtgacctccataccagagggacagaggccaatgtgagtcagaggtgagactggaactctcctgctggattcactccagagctctgttctctggcagggtgagtgggcagggatcagcatgggtcaacctgtgcctctgctctcctgactccatggaactttccagagcagccaacatcattgccaagtctgcacgttccatataggcctggtgtttctaccactggacatgctgtggatactgcccatgtgacttcattagatgtttccaaatctgtgcttatatcacattgtcccaaacctgctcagctccttatcaaatcaaaaacatttccatcaactttgtggtccaggtgccaattcccacctccttcatatggaattgcttgctagatcctgtcaattcagcatcttttattatttcaaatgtttttcctccttctccttgcatgtttgttcatgccccaaactctgcttttgcctccagaaagccttccttagtggagtgaataggagcgcttgtccttgatttcctgcaatatggagctctcaaggcagagaatttaaaaaaatttaaaatcaaggagtgtgagtgtggaggcagaagctccattgttgtatataatttgtagctgataaaagatctttactattccttcatggtctaaggttctaggattcatagacggtcattcatgtaaatgcaggaaaagcaggaagttatggccgggcgcagtggctcacgcctataatcccagcactttgggaggctgaggtgggcagatcgactgaggtcaggagttcgagaccagcctggccaacatggtgaaaccctgtctctactaaaaatataaaaattagccaggcatggtgacacttacctgtaatcccagctacttggaaggctgaggcaggagaatcgcttgaacccaggaggcaaaggatgcagcagtgagctgagatcacaccactgcactccagcctgagtgacagagtgaggctccatctcaaaaaaaaaaagcaggaagttatgtaactgctggcagtggaaattttaacaagtgatagggtgagatagtgtgtgaaaaagcataagtacagtggcccttcataagtgcttaaaaattggtagatatcattgttaatatttttttagtttcaaggaaaataaataataaaaaaaggaaaccatgtaaaagaaaggaagagtggcgagcatgagtaattcttatcatccattaaaaatgtaataagttggtgtttatctgttcctttatatttcatgttatttctatataagaatttttaatgcactgtagctccttggatattagaccctatatcatatataacaatttacatttctgaatcttacaaaatatattgcatacagtagacagtagcaggtaataagtaaagtaacaaaagaaagtataatcagagtatctctgctctgctgacagatgtacaggaatatacttgaatatttgactttgtgtgttttacgtgttaacttccagataagggaatatgattgaataatttattattttgaaaatactgtattatgaagccatgttcataaaggtaagaaaggcagattctacaactagtcagacaacttaacattcatactaatgacagcttcattgaaatcactttactactcccctagtaatggagtcattgcatttatattatacattattctcttttcagttttgctagccaccctaattatccatattcagatgaatattaacatggagagctttgcctgatgtctaccagaagccctgtgtgtggatggtgacgcagaggacgtctctatgccggtgactggacatatcacctctacttaaatccgtcctgtttagcgacttcagtcaactacagctgagtccataggccagaaagacaataaatttttatcattttgaaataattgaatgttttctcaaagattctttacctactctgttctgtagtgtgtgttttcttctggctcagaagtgtgtgtgtgtgtgctttcttctggctcaacagggctaaaaactgtgtgatttgcctgtaagtaagttaggagtgggggaataattaataatcatttatagacatactatagtgggactgcagtagagttttcagcctctagagaaggagcaggtgacaggtgtggatcagttagtgcctctttagctctttca

SEQ ID NO: 15148 - DNA, 102409 bp, Human
  misc_feature (1)...(102409): n = A,T,C or G
cactgcccacaagtcaccgttgagaaacccgccctgtgaaaagcagaaattgctctggtcacttctcccggcgcctgcagagagaccggctgtggcgctggtcaggtaatggcagccatggctggaaaccgggaacaatggggcctgggctggcctgatatctcctcaggaaatgaccggccttcctgaggggccaccgaacgcggccgctttgtttagtttctttagggaaaaaacaaggcacaagtgacatttgccttggcgttcttgaccctccctctgtctcgcctgggtttgggggcccttctcatggcactgtgaggggattcctccctgcctccagcctccacccaccacccaaagggctgctctcccaggacatccagaaagatctctctgcttttccagtcctccccttcccccatcaaagagggcttttgccacacagcataagtctgggccccctgcctttcttgggctgacttttccccaaaattgcaggtttgtcaaagagacctgctgctggggcaggctgagcttggaatgcagcggaactgaggcgagagaatagcagaggaagtagggggcaaagagcacccttgggcgtaggctagcttaagcaatagcaaaagcaaaagatgtaagatagaagaagaacatacaaaataagggagtaagcagtaagaatagaattaacggctgggcatggtggctcacgcctgtaatcccagcactttgggaggccaaggcgggcggatcatgaggttaggggtttgagaccagcctgaccaacatggtgaaactccacctctactaaaaaaaaaaatacaaaaattagacaggcatggtggagaacccctgtaatcccagctactcaggaggctgaggcaggagaattgcttgaacccaggaggcagaggttgcagtgagctgagatcacaccattgtactccagcctgggcaacagagtgagactccatctcaaaaaaaaaaaaaaaagaatagaattaacttcttccatggcgataaggagtgacatgttaaccaaatatcgtaccctttagaagatggcttcaaatctaaaaatacactattcctactcctttaagcctcaaaatacgttattcctactccttttaaaagataccttgtagctttaagattgacctttggggccgggagtcgtggctcatgccggtaatcccagcactttgagaggctgaggtaggaggattgcctgaggtcaggagtttcagaccagcctggccaacatggtgaaaccctgtctccaataaaaatacaaaaattagccaggcacggtggcacacgcctataatcccagctacccaagaggctgaggcaggagaatcgcttgaacccgggaggcggaggttgcagtgagccgagatcgaaccactgcactccagcctggggtgacagagcaagactttgtctcaaaaaaaaaaaaaagattggcctttagacttttcattgggtaatagatattttgatggtagaaaatactagaatctggcagagcgcgatggctcatgcctgtaatcccagcactttgggaggccaaggcgggaggatgacttgaggtcaggagttgaagaccaacctggccaacagggagaaacccgtctctactaaaaatacaaaaattagccttagccgggcatgaaggccggcacctgtaatcccagctacttaggaggctgaggcagaagaactcagaaggcggaggttgcagtgagccgagatggcaccactgcactctagcctaggcgacagaagtgaaactccatctcaaaaaaaaaaaaaaagagaaagaaactactagaatctgatcctttgcatcagtttctaaaaatctaacttgttacagtcatagagtcaaacgttatgggatgctttggaaaagaagcaaaccatgtggatattaataacacatcaaaatctctcagactgtcttaatattttatggtgtttctttatagtctgtaatttaaaacatcaatcaaatattgccacaaaaagtaatataatagataagggagtaagcagtaagttgggacatggtaagagaagtaagttggaaggacttccagtagctatttggtcgcaaaaaataaaagtaaagatgggcaatttggtcagaagaggtaaagtgggggtaaacaaggttgaacaactatcttacaagaaataaagtagggtgaaggcactataagagaaaggcaagtgacattaagcaagtgaggaaaaacatgtaaaaggccgtgaaatgtaacaaaccggcactgataaccactcacaggtcagcccactcacccctctccgagagtgtcgctgtgcttaatcatttgctgcttcgctatttgtacgtgtgtcatgtccaattctttgttcatggcaccaacagcctggagctgcgcggcaccatctggtaacagaactaggaagctctcctcagcttttggtgtgggtgacatacgcagccctatgagaggcccctccccagcatgcacccctaaacaaatgcgtactctactgggccactatgcgggagcttcctaagatatacatcatttctgctgggcgtggtggctcatgcctgtaatcctagcactttgggaggccgaggcgggcggatcacctgaggtcaggagttcgagaccagcctgaccaacatggagaaactccgtccttactaaaaatacaaaaattaatcgggtgtggtggcgcatgcctgtaatcccaggtactcaggagactgaggtaggagaatcgcttgaacctgggaggtggaggttgcagtgagctgagatcacgccattgcactccaacctgggggacaagagtgaaacactgtctcaaaaaaaaaaaagatatacatcatttcctttcactcctctgtttgagaccagaaaaagtcaatttacagcctgccataatacagcctttgcttacctttcaagcctagtctctcaccacttccttaccttgcacctacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaggctagagtgcggtggcgtgatcttggctcactgcaacctccacctcacgggttcaggcaattctcctacctcagcctcccaagtagctagaattacaggcatgcgtcaccatgcccggataatttttgtatttttagtagagacggggtttcaccatgttagccaggctggtcttgaactcctgacctcaggtgatcgcccaccttggcctcccaaagtgctgggattacaggtgtgagccaccgggcccagctgtcggacccttttatttttttttgagatggagtctcgctctgtcgcccaggctggagtgcagtggcgcaatcctggctcactgcaagctctgcctcccgggttcacgccattctcctgcctcagcctcccaagtagctgggactacaggcgccccccaccacacccggctaattttttgtatttttagtagagacgggtttcaccgtgttagccaggatggtctcgacctcctgaccttgtgatccacccacctcagcctcccaaagtgctgggattacaggcgtgagccaccgcgcccagccagacacttttattataggatgtgtcataatggcctgtcctcccccaaatggactgcaatctccttgatgacagggacagtgtctggaacctagtagatgatgaaaaagcattagtgcaatggatgattgtctagatggatgaagacaaactactgtattgtctgaatcagatgatcactgccttgagggtgccatattgtttctgaaatgccaccctctaggacttccccatggtaaagctaagacagatacaaactggccacagtcaaaaccagattcctctacctcagggcaagaaccaagaagtaatggcttccagctagaaaacaattcctctctctgacctatggttcagtggaagttttgataagagccttgaacagcaatacacactttacccatttatttctaaaggaatgttttccattgcgttatttgctgttgttttgtgctcgccattccccactataagctatcttctttggcaacctactggaaattaccctcacccatctaccaaattttgatgtgggaacagaaaaggaaacaccatgattaataaaataaattttggcttcaatggtaatttttagacactgcagagtaagcaccttttgcagagcaacaattcaaatgatagtgataaatgccaagaccccagaccccgtgccctcaagttccaaagtaaatttctaaaatgtggcaattgcttcataaatgattctaatattttcaggataccatgataaaataaagctttatttcaaaaataaatgttttttttagaaaattgaaaaattgtatcccataattcacactgtgtaccagaatacattccaaatggaccagtgatatgaatgtacaaataaacccataagagtcctagaaggggccaggcacagtggctcatgcttgtaatcccagcactttgggaggccgaggtgggcagatcacctgaggtcaggggttcaaggccagcctggcccacatatagtgaaaccctgtctctactaaaaaatacaaaaattagctaggcgtggtggcacatgcctgtagtcccagctacttgggaagctgaggcaggagaatcacttgaacctgggaggcagaggttgcaatgagccaagatcatgccactgcacttcagcctgggcaacagagcaagactctgtctcgcaaaaaaaaaaaaaaaaaaaaagttctagaagaaaatacaaaagaagaaaagaagtccttacaaccttgaatggcagaggctggtttaactaaaacttaaaatccagaagccataaaattgattgataaattgtactttatgaaaaaaaagttctgttttgccaaaaaaaaaaaaaaaaaaaattagtcaagagaaaaactactaactggaaaaaatgtttgcaactcacatcacggacaaagagctaacttccctagtgtgtgaagaacactcataaattaagaagaaaaagttcgggagtctgtctaagctactctggcttgggaggctgcctgattaaaagaaagaaaataaaagagaagaagaaaaagaaaagaccaacaatccaatagaaaaatgggcaaagaatatgaacagatagtttccataatgtaagaaaaagtatctgaaattggaaataggcaaaaatgagtactgcatgcctgtccagggtttacctcacactctaaggttattaacgtttgtttgacttgctatttacagtagactagaatactttacaatcagtaggggagggtaaacattaacttgtagaaagtcagtaaggatgcaaaggattcttattatctgtggcagaggggtgggtggcagaaactgagcagttggggacttttctttgtaaagctttctgtacttttgttatttaaatcatgtgactgtattaccctttcacttttttctttttttttttgagatggagtcttgcgctgttgcccaggctgttgtgcagtggcactatctcagctcactgcaacctccacctccagggttcaagtgattctcctgcctcagcctcctgagtagctgggactacaggcatgtgccaccatgcccagctaattttcgtatttttagtagagatggggtttcaccgtgttggccagactggtcttgaactcctgacctcgggtgatccacccacccaccttggtctcccaaactgctgggattacaggcgggagccaccgtgcccggcagtattacctttaaaattttaattaagaaattgaatttctgttcagctttatgaagtattatataattgacataaaataagctgtgtttaaagtatacactcagaaaagtgttgacatgtgtatactgatgaaacaacctccacaatcaaggaagcagacacatccaccacccccaaaaggttcctatgcccctcgtctcccttgccctctgcaccctccccactgcaaagattgatctgctttctgattagtttccatgttctggaattttgtaaagattcatacagtatgtaccttttattattattatcattatctttggtgtgtcttttttctttttcttttttttttttttttttgagacagagtctctctctgttgcccaggctggagcacagtggcacaatctcggctcactgcaacctccacctcccaggttcaagcaattctctgcctcagcctctggagtagctgggattacaggcacctgccaccacgcctggcttattttttgtatttttagtagagacagggtttcaccgtgttagccaggatggtctcgatctcctgacctcgtgatccgcccgcctcggcctcccaaagtgctgggattacaggcgtgagccaccgcgcctggccttttttttttttttttttttttttgagacagggtcttgctctgtggcccaggctggagtgcagtgccgcaatcttggcttgctgcaacctctgcctcctgggttcaagcaactctcctgcctcagcctcccgagtagctgggatcacaggtgtgcaccaccatgcccagctaatttttgtatttttagtagagatgggatgtcaccatgttggccaggctggtctcaaactcctgaccataagcaatccgcccacctcaacctcccaaagtgctgagattacaggcatgaaccaccgcacccagccaacatcttttttttgagacagggtctcactctgtctcctaggctggagtgcagtggcacaatcatggctcacggcagcctcaaactcctgagctcaagcaatcctcccacctcagcctcccaagtagctgggactacaggtgtgcaccaccacgcacagctaattttttactttttgtagagacagggtcttgcccaggctggaatccagcttcttgtctcagaagatcctccagcctcagcctcccaaagtgctgggattataggcatgagccactatgcctggcctggcctttttcaatatagtaaattgaatgggtttttattcgtttgtgggcctctcctttctcctcacttcttccccttgaccttggtggattccttgattgggttgaggcaaaggttcccacacggctttggcttcttggtaactgatcaagagactgactcctacataaccaagggaccccaggagttcccaccaggcttaacaaactcacccaggaccctgtttctcccatggtgttgttcgcttcttctcagccaagcagaattgaaggaggacagacacacagttattcctacctgcagtgctcctgccttcaaataccggggaagtaacgcagatccgaaacatagcgactcgttaactgcacagaaaaagctgtctgctggaataaacttcaggaagtggtttttctgagcaactggaggtggagtggggggaggaaggcggaggcaggtgggcaacagacatgtcggagggcacagcaggccaaccacctatttcatgacaatggtgattggaaatgagattcaccggccgttccatttcccccacctgtagcctcagatctcattagtcttggagagttgatgagccagactcaacagcccccatccactgggtttgggacacaccccagcctgggagtgaacgtgcactaatgcgtaaatcagaagcctgggttccctgtctgttctctgcagcttaatagcttaaatgctctgaggctcatgttcctcacctatataatgggaataatgtgcccatctacccattgaataggcttgttaggaagatcaaacaagagctagcctttgaaagcacatttaaccagcagagcacagtaagaacatagtaacaacaaaaaaatataaaaaatagctgcatacggtggtgcatgcctgtggtcccaactactcgtgaagctgaggtgggagcaatgcttaagcccaggagtttgaggctgcagtgagccacgatcacaccactgtactctaacctgggcaacagggcaagaccttgtctcaaaaagtaataataattaattaaaaagtttaaaaaaaacaatagttatgattgaacaataataacaacagttgttgatctggtttggctgggcctgccacatctgaatcgctgctctggagctcagctgacttagtgaacccaaggggcagcgctcagtgccttttcttccacacccaccatatgctgccctcaccaccccggtctggcccctcacaaagttgggcagctgggcaaaagggaggcaggcagggacattgtggaggagtctgtgctattccatcccctgcaggaggccccctccagttacaagggacatggttgttttgtttttgggattttttggggttttttttgagacaggttcttgttctgttgcacatgctggagtgcagcggtgtgatcacagctcactgcaacctccgcctctcaggttcaagccatcctcccacctcagcctctcgagtagctgggactgtaggcatgcaccaccacatccggctaattttggtaatttttgtagagatggggtctcgtcacattgcccaggctggtcttgaactcctgagctcaagcgatttgcacgcctcggcctcccaaagtgctgggattataggcatgagccaccgcacctggctgacatggttgtattatgactcataaccataggcatttttgcctttgtagacctcttcctccacaaaaaaaaaaaaattacattttgaaactgtactggtataaataagaagatattcatattatatatttaaaaatttcttttacctagacagtggttttattcttctgatgactgtatcttctaaacctaatgaagaagggcctgacaacagatcaggcacacaacagcccaaggggttaagggacctactgtcttccaccctgagtggcctggccgctggcctgggaagagcaccaccatgtcccaggcactgaagccaaaacaggtgtttgtgcattctgttctcaaaaccacaaaagcacaagcaacaaaataacaaaaacagataaactagactgtattaaaattaaaaatgtttttattgcaaaggatagcattaggaaagtgaaaggtaattcacagaatgggagaaaatatttggaaataatatatctgataagggtctaggatcttgaatatataaagaactgttacaactcaacaacaaaaacacaaccattttaaagaattggcaaaggggcagggcgtggtggctcacgcctgtaatcccagcacttggggagcctgaggcaggaggatcactcaaggtcaggagttccaagaccagccctgggccaatatggtgaaaccccatctcagctaaaaatgcaaaaaattagccgggcggtggcacatgcctataatcccagatactcaggagctcaggaggctgaggcaggagaatcgcttgttccccaggaggcagaggttgcagtgagctgagatcatgtcactgcactcccagcctgggcaatagagtgaatgagannnnnnnnnnnnnnnnnnnntccagcctgggcaatagagtgaatgagactccatcttaaaaaaaaaaaaaaaaaaaaaaggatttgagcagattatttctcctaagaagataaaaaaaaaaaatgaccccaagcacatgaaaagatgctcaacatcattagtcattagggaattgcaaatcaaaactacaatgagataccacttcatacccactaggataactataaccaaaaagacagacaacaaatattgatgaggatgtagagaaacaggaatgcccatatgctactatggcattgtaaaatgatacagccactttgaaaacagttggtggttccccaaaattaaaaatagagttaccatgtgatccagcagcaattcaacccttggggatatagtcaagagagctgaaaacacgtccacacaaaaacatgcacacaaatgtttatagggctgggcacggtggctcacgcctgtaatcctagcactttgggaggccgaggcgggtggatcatgaggtgaggagatcgaggtcatcctggctaacacggtgaaatcctgtctctactaaaaatacaaaaaaattagccaggcgtggtggtgggcacctgtagtcccagctactcgggaggctgaggcagaagaatggtgtgaacccgggaggcagagcttgcagtaagccgagatcgcgccactgcactccagcctggggcaacagagcaagactccgtctcaaaaaaaaaaaaaatcacaaatgtttatagaagcagtattcacaatagccaaaatatagaaacaacacaaatgttcatcaactgatgaatgagcaaacaaaatgtgttatagccatataatggaatattatttggcaataaaaagaataaagtactgggcagggcatggtggctcacaccggtaatcccagcactttgggagcccgaggctggagaatcgcttaaagccaggagtttgagactagcctgggcaacatagccagaccctggctctaccaaaaaaaaaaaattttttttttcacctcccaccaacttctctcaaaaaatttttaaaaattagcctggtgtggtggtgtgccccggtagtcccagccactctggaggctgagatgggaggcttgtttgagctcaggactttgaggctacagtgagctaggattgcaccgctgcactctggcccaggtcatagcatgagactctgtctctaaacaacaacaacaaaaggaacgaaatactgatacatgctacactatagatgaactttaaaaacatgctaagtggaagaagctacacatgaaaggccacatattatataattccatttctatgcaatgtccagaatacgcaaatccatggagatggaaagtagtttggttggctagggctgggggattaggcaagatagctaaagaatacaggtttctttttgggataatgaaaatgttctaaaattgattggggtgatggttgcacaactctgaatatatgaaacaccattgaattgcacgctttaaataggtaaatggtatggcatgtgaactatatctcaatgaatctgttattttaaaaattttagagggtatgttttcatttcctgtggctacagtgacaaatacccacacacttcctggcttaaaacaacagaaacttattctttccccattctggatctagaataagtatgaatggaccaaaatcaagctgccagcagggctacactccctgcagaggctctgcgggaggagaatctgttcctggcctcttacaggagcagattggtggctgctggcattccttggtctgtgggtgcatcactccagtcttcaaggccagcatcttcaaatctctgctcaatcttcacatcacctctcttctgtgtgtctaatctcccttatttattatttatttatttatttgagatggggtctcaccctgtttccaaggctggagtgcagtggttcaatcacgactcactgcagccttgaccaccagtgattctctcacctcagcctcctgagtagctgggaccacaggcacacaccaccatgcctagataattttttaattatttgtaaagatgaggtctcgctatgtttcccaggttggccttgaacttttgagctcaagggattctcctgcctgggcctctcaaagtgctgggattataggcataaaccaatgtgccccgcctccctctgcctctctggtaaagtcacttgtgattgcatttggagcccatccagataatctccccaactcaaaactgttaacttaatcacatctgcaaatcccattctcccacatgttacaaactgaatgtttgcatccccgcgacaattcacatgttggaaccaactccccagtgtgatagtacttgcaggtggagcctttggaggtggttatgtcatgagggtggaggcctcatgaatgggactggtgcccttatgaaagggaccataaaaaaatccctaggcccggtgcggtggctcacgcctgtaatcccagcactttgggtggccaaggtgggcagatcgacgtgaggccacgagtttgagaccagcctggacaacgtagcaaaatcctatctctactaaaaatacaaaaattagctggcatggtggcgcgcctgtagcctcagttacttgggaggctgaggcacgagaatcacttgaacccaggaggcaaaggttgtggtcagccgagaccgcgccactgcactccagcccgggtgacagggcaagactccttctcaaaacagaaaaaaaaaaaaaaaaggcaagaaaagaattccctagtcctttccatcatgtgaggacacagcagagagacagccatctataaatgaggaagtaggcctcaccagacactggagctgctggagctttgatgctggacttcccaaactccagaactgtgagaaatacatttttgttgtttcttttttttttttttttttgagatggagtctcattcttgttgcccaggctggagtgcaatggcacaatttcagctcattgaaacctccgcctcccgggttcaagcgattctcctgcctcagccagctgagtaactgggattacaggcatgagccaccatgcctggctaattttgtgtttttagtagagatggggtttctctgtgttggtcaagctgatcttgaactcccaacctcaggtgatccacctgcctcagcctcccaaagtgctgggattacaggcgtgagccaccgcggcccggcccatttttgttgtttctaaggcacccagtccaaacaaactaagacaccatatagggcaacattcacaggttccaggggtcagggcctgatatccttgggggtcatcagcagcctaccacaggggtatcatgacccatattacagatggggagctgagggccaggaggtgaaacatcaaccaagttcccagcaccacatctgcctgcctgtgtctgcctggcttgctacaaggcttctgtgactgaccttttacagcacctttctgggcagaaggctcagacccagtccctgacctgacacacatgagtcatgagaccagagccagcttcatagatgtgtgacccgtgccgtcacaggggccctgtgctcagaagctgccatgcttggtttgatgccttgctgtcgccaccttgaaattcctgataattttgaattttcatttgcactagacccacaaattatgtaactggtcctatatgtgacactgagcaagaaaagggagagttgagatgaggtgggtagaagctgccctgcccacggcctcacctcagacctgaaaagtacctgacaccccgatcctgcacagcctaaataattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgaactcctgacctcaagtgatccacccaccttggcctcccaaaaaagtgctgggattacaggcctgagccactgcccccggccttagagtggggtttctgttctcatttgactgtgtcatggttctgagacgaatcctcaggtgagaaagcaacgggcctggcttccttgggctcctcagccatggccctcccagagcccaccatgcctggaggacccagcatgggccacagacatgcaccttcattctcacaagttcatccgagaggaggaggaaggaaaagccaaggaaacccaaaaggcaggttagagaaagaagtcactctgtgtccgcaaagagctcccctcccctggccctgtgcccttcactctctataggtcaaggttttgctggactgtttccagtgtttgagcctgaatccaccacgccggggctccctgatgcactaatccggtgttcaaagaagggaagggctgtgtggccctgaacctgtgcctacacagcagaaagaattccaacctttccttatcagacataaagtggatctacaaagggtcacattagagagttttcctttttaaatggctctacaaatgttctgaggtaggcggcggaactcaactccaaaggtagggcttggacactggaccaaattgaagactagctaaacagggactgagagaaagcagctttccataagacacgcccaccagtgtgccgtgtcagtttaccgttaccatgacaacaccggaagttaccacccctttccatggcaatgacctgacaacccagaagttaccaccctttttctagaaatttctgtatagtctggcccttaatttgcatataactagatgggcacacatatgatgcagaactgccctgagctggtgctctgggcacactgcctatagggtagccctgctccacaaggagcagtctgtctgctgctgctgtgcactgccgcttcaataaaagttgctgtctaacaccaccggctcccctagcttgcccttgaattctttcctgggcaaagccaagaaccctgccaggctaagccccaattctggagttcacctgccctgcatcagttgcacgtagcacagtttcattagtttggccttgaggggccaagagcaatcctgctttgcaccacccaccatgaaagggagcaggagctggcggggtgtggtggctcacgcctgtaatcccagcactttgggaggacgaggcgggaggatcacctgaggtcaggagttcgagaccagcttggtccaacatgatgaaacaccatctctactaaaattacaaaaattagccaggcatggtggcaggcacctgtaatcccagctactagggaggctgaggcaggagaatcacttgaacccaggaggcagaggttgcagtgagccaagatcacaccactgcactccagcctgggtgacagagcgagactccatctcaaaaaaaaaaaaagaaaagaaaagaaaaaagaaagggaggatgagctgccctgggggaggtttgtggacttctgaactcatgtgagccaagtctaccaagcctcagctcaccagcctgtagattgctcctcataaggccactgcgggcctcaatatcataaaactctatagggatatgggtcacgttaagtattgtcctttgacctcatatcaaatgaacaagcatcaggaaaaattgtgaaagggtttgaaataggcctaaaacattcctgggtgtcttcaacaaaaagtagaggcaatctagcacattcttccagcttatctgactctatgaggtttctgtgcctttcattgtctttgagatatcttataattttccaggttgtccagagaaatgcaagttgtgaccagtggggatgatgcagttgataattcccctaatgatattgagcaattttgcatcttttgttttgaggcggagtttcgctcttgtccaggctggagtgcaatggcacaatctcggctcactgcaacctccgcctcctgggttcaagtgattctcatgcctcagcctcccgagtagctgggagtacaggcatgcaccaccacgcccagctaattttgtatgttttggtagagacggggtttcttcatgttggtcaggctggtctcaaactcccgacctcaggtgatccacccgcctcagcctcccaaagtgctgggattatagccgtgagccaccgcacccaaccagtttacatcttttaagccaactcattttagcatccctgatggtagatatctgcatatctaatgatcaattggtcaatcaatctaatcatatatacatatcctctttgattctcctttgagtaagttatagcatttcactggttcactcattaattgataagttaaataaaatatttgacacatgttcatattatatttgcatgagagttatgattttactcctaaaaattataagactccgctatggagcttttatttaaataataataactaatatttattgagtgcttacatatttctcacgtttcctttaatcctatgagtcagttactgttattaccctctttttacaagagagaaacaagactctcagagaggttagtactcttgtccacgatcccacagctgaagtggtgatgctggctgcctgccttcagccctgagccctaattcctcacacagggcctctggaagaaaaacatttcagggcccggtgcggtggctcacacctgtaatcccagcactttgagaggccaaggcaggtggatcgtctgaggtcaggagtttgagactagcctggctaacatgatgaaaccccatctctactaaaaatacaaaaaattagctgagcatagtggtgcacgcctgtaatcccagctactcgggaggctgaagcaggagaattgcttgaacccgggaggcagaggtgagccgagatcacgccatcgcacacaagcctgggtgacagagtgagactctgtctcaaaaaaaaaaaaaaacacaaaacagaaagaaaaacatttcaggacttcttgaaatactccacaatagaaaaatctttggtctagaacaaagatggaagggatcaaagtctgaaacagttgaaatacactgaatgtaacatatgtattcaccaaggttatgcaaggatgtaatccttcaccttgttctataccactgtctccatgtttcctgtttctttagagcttcattacctgattaaacacaattgaaataaatagatacgtaaaaatcaaaaaggcagccaagttggggtatgagaatatgcacaggaaatggtgcttctagacagaaatgagattcatgtgatttaggaccacgtcaggagcctgtgtaaacattcctaatactcagaatgtgagaacacatctgggcttgtggatgaatacctcccaaatgtcaaggacgtgctttaattagagctttttaaaaatggaccagttgcagccagcgctatggctggtgactgtaatcccagcattttgggaagctgaggcgggaggatcacttgagcccaggagttcgagacccccctggacaacatagtgagacaccccatctctacatgaattttgttttttaattagccaggcatgggggtacatgcttgtggtcccagctactcgggaggctgaggtgggaggattgcttgagtcgggaggtggaggctactgtgagccatgattgggccatggcactccatcctgagcaacagagcgagaccctgtctcaaaaacaaaacaaacaaataaacaaaacccagaaaacttggttgtgatggtgtactgtagctttgcaaaatgttaccattaggggaaactggcacatatctctgtattatttactgcaaatgcatgcaaatgtactattatctcaataaaaatatttctatttaaaaaatagggctggatgccatggctcacacctgtaatcccagcacttttggaggctgaggcaggaggatcacttgaggtcaggagttggagaccagccttgccaacatggtgaaaccctgtctctactaaaaacacaaaaattagccaggtgtggtggcacgtgccgtgggcccagctactcaggaggctgaggcaggagaattcgcttgaacccgggaggtggaggtcgcagtgagctgagattgcaccactgcactccagcctgggcaatagaccgagatttagtctcaaaaaaaacaaaacaaaacaaaacagaaaaccttgaattttcacattgctctttagaatgtggaaggaacctggaaattttctctgagggtgagagggagaaaatatgctcccaataaggggaaattctaaacggaaaacaaacaggaacattttgcacctagaaaagatcttgtatattcagggaggtaaaggggatttctgcaaatcattgtgagatgcattgacaagcctcagctcctaaatgaaatgtttttctcccaggtcgtttgaaggccagtttccccagaaagctactcttagatgaacctctcttaagagagagatgggcaagtaggaggtgctcttagctccctctctcccatcccccataggatgaggctacagaggaatcccttaggtcaacttacagagaaggaccctgaggccctgaggttggccatgtcttgtctgtgtggccagcaaggggactgctgggcctggcagtgtctcaggacttcctggccagggagcttcctttgttgtctctggaatccccccttgccctgtgtccttgagtctaggacctggcacaggtacatgtgatgccatgcccagggtgctgtaatccaggcactggcctctaaggaatggttacggagggccagaccaagtccagcagagccagctctcaccaggcctgtgcagtgggtgagcatatgtgatgggaggacatatgcagtgggtgggcatatgtagtgagtgggtatacgtagtgagtgggtatatgtagtgagtgggtatatgtagtggatgggcatatgcagtgagtgggtatatgcggtgggtgggcatatgcagtggatgggtatatgcagtggataggcatgtgtaatgggcaagcatatgcaatgggtgggcatatgcaggggttgggtatatgcagtggataggcacacgcactaggtgggaatgtcatgggtgggcatatgtcatgggtgggcacatgaaatggacaggcatatgtcatgagtgggcatatgcagtgagtgggcacatgcagtggatgggcatgtgcagtgggtgggcatatgcagtgggtgggcatgtgcagtgggtgggcatgtgcagtgggtgggcatatgctgtgggtgggcatacgcagtggatgggcatgtgcagtggatgggcatgtgcagtgggtgggcatacgcagtgggtgggcatacacagtgggtgggcatgtgcagtgggtgggcatgtgcagggggtgggcatacgcagtgggtgggcatatgcagtgggtgggcatatgcagtgggtgggcatatgtgatgggtaggcatatgcagtgagtgggcaaatgcagtgggtgggcatatgtcatgggtgggcatatgcagggctgggcacctgcagcaagtgggttgtcgcgggagactttgcccacactaagagactctgagtttcagttttctgccgcctaacatgatatacttgcgactgcctgtaaatccatttttaacccccaactagggaagctgaaggaagaggaacagcagggccaccagctcagcccgctggctgcattgttctcccctgacattgttctcaggccggctctgcttacccagaaggcccccgtaacccctggggaatccgatgagattgtttttcccaagactgggctcttcaggtgtgagctgcagttcttgggccacgtaggttactgtggcatttctgcagcaggaaagaggaaggaacttctgatctgtggggcaacggcatcaacaatgtgcacccccaccagccggcagcgcgaagaggaaaggagctcagtttccatagtgataaatcacgaggaagggagcctggagggagccggcagtaagacttctcccttcccctggctccctgcaaacgcattcccaatgccagagtcagttagccgcctggcgcctctccagactgagcccccagaaccgcaggtagaggaagacggaaggggctctgccagatggaaaacaaattcccagctcctcttcaatgtgtcagtaaggcatgggtgcccgagcggatgcgtcggggcccagggctgtgccacacctgggtggccaccacatgcgaagctctcgatgcatgccacctacattattccattccattctcttctattacgccctacacacgactgtgttctattaaatgagcccacagcacaggtgctattagcccttttatcacagaagaacaaacaggccttgtgagggagagagatgcaccagagacaattcaccaagttaacaatagctcctgaaggtctcaaggctctcttctgagattctttctcttgccaaaatcagactattttccccaaagaaaacatttgagtttttttgaaatgttctgggaagtcgtttatcccaaacgtcatcagccactctttatgcaggccacggtctcttgcctgtaacccttgcatgtgctgttccttctgcttgaaatgctgttccctgcttccttggtcagctaactcctcagggtacttgtctcatccctccttcccagtagctcagatgccttgctttctgggctcccacagaacttacaccatattatgaagcaacacagagtaatagtaggagaaaaggctcttctaggcccagactagctgtgtgacctcaggggatttgcttaacttctctgagccttgatttcttcataggcaagatggagagaatgcgagcatctgcctcacagtgtgtctgtgaggattggacattaacatatgtaaagctcttagaaaatgcttgcctgcggttaatgctctagaaacattagtcactaaagaattaagttcttaaagcaagagccattcttcatggatatctctagatctagaggcttaggcccaactgggtatggagcaaatgtcactctggattcgtgggagactattttccagctacactttaggcaacaggcacggtgctaggcaccttgattcataagatttaatttagttaagtcattccaggactggtctcagatagcccaggaccagcattttgtcactgtagcctgcagcattctcgaatggccctctgatcacctgatatcccctccagacttcctgccctgcccaggcctgaaaagagtccccacactcagtgacaggtgaagaggccctcagccttgccacaacaggggttacccatgtggtctgtaaacaccaagagatttaaataatggacatacctgcatcccaggggccactcagacagcaaaagacaaaccccaccttgggcagccactctcctccatggttccacttgaaaaaatgaaatgaaactcttcatgcaaatactcgggtgctaaacagttatgtaacagccaagtctctccacttaaaaatacagtcttctccaaatctatagagacaggatgccgaccagaggttgcctgggacttggagagggatcggaggacgactgccattgggcaagagggaacttttgggggtgaagaaaatgtgctcaactggatcgtggtgatgcttgtacaactctgtcttcacaaattgtagggttcccgaatttcgtcaataaagatacaggatgcccatttaaatttcagataagcaataaatactatttttaatataagtatgtctcagatgggacatccttgcatattgcatgggatatacttacactaagaaagtatttgctgggctgggcgcagtggctcacgcctgtaatcccagcacttcgggaggctgaggcaggtggatcacctgaggttgggagttcgagaccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacagttccacttgtccatggtcaacacaaagctacttgctagtaggtctggctctcagctatccagtatacgaaattctgaccaactaccaaaatcataataacgcattctttaaattcacctcatcggagatggagtcttggagacttaattacatgtgctgttggtgtaattaaacttttttctttgtgaatactgttgtccctcgatatccatgggggattgtaccagacccccacagataccaaaatctcaggatgctcaagtcttttctgtaaaatggcatagtattagcatataacctaggtacacccttctgtatatttaaaataatctctagattacttatggccaactctaggtgtactgcctatgagttagctctgctccataaggagaagtaaaaaaaaaaatcatctatagattacttataaaaccacataagatgctgcacatcatttcgtttgtgggggattcaacatagtactcagcacgtggaaaattcaagtttcaacttttgaaactgtggaatttttttctgaatattttctatccacggttggttgaatccatgaatctggaacccatggatatggacagctatatctgcaaaggggctcttttttttgaatgaggaagactcaatgacattccactctattccttccacttccatggtgccattccggtactagaggatttcacaaaaactgccccatacagtggaggcttcagccactgtaaacttataagcccaagaatcccattacttagctcatcaatgatatgaccacggcaatctgggcatttcaagaaggaaggagatgcattctctctctctctctctcttttttttgagacagacagagtcttgctctgtcacccaggctggagtgcagtggtgtgatctcagctcactgcaacctccacctcctgggttcaagcaattttcttcctcagcctgctgagtagctgggattacaggcacctgccaccatgcccagcttacttttgtatttttagtagagatggggttttaccatgttggccaggatggtctcgaactcctgacctcaagtgatccacccgccttggcctcccaaagtgctgggattacaggaattagtcactgcgcccggcagggatggagttttatcaatttagcaaggttgtcccttatctactggggactttaattaatcaaatatacatataaatacaaatagaaaaatcattgactacttagttaatgctattttggataaaatattcccaataatgagatttataaaatacaaataatgaaggggccaggagtgttggctcatgcctataatcacaacactttgggaggcagaggcaggaggatcacatgagtccaggagtttgagactggcctgggcagcatagtgagactccatcactaaaacaaacaaacaacaacaaaacaaaacaaaacaattagctgggcttggtggtgcatgcctgtagtcccagctattagggaggctgagttgggaggatgaggccctggagttcaaggctgtagtgagccatggttgtgccactgcactccagcctgggcaacagagcgagaccctgcctcaaaacataaaataaataaatacataataaaaataatggggggtttttgatggtgaaaaggtaggactgccagcctgctcagaattatggaacattttaaagtagccaaaaacatttttctctgtgataatcaaggtatcaggtatgcatttctgcaggactaaaagaaactctacatacatttgatggtatttttcatgtaaggactaaattcttttaacgagcacctcatttggtttaccctctataggcttgaagcaggagggtatttctgaagggaacttcaacttgtttcttgtctgtttgttttgtttgtttgtttgtttgagacagagtcttgctctgtagcccaggctggagtgcagtggtgtgatctcggctcactgtactcactgtaaccttcatctcccaggctcaggtaatcctcccacctcagcctcctgagtagatgagactacaggtgtgcgccaccacacctggctaattttttgtatttcttgcagagacgaggtctcactatattgctcaggctagtcttgaattcctgggctcacgcgatccttcctcactggcctcccaaagtgctgggattacaggagtgagccgctgtgcctggcctcagcttttttttctttaatttcaagtgactcaaaagaaaaacaagcgaaaataaaaataaagtgttaaggcataaacaattaatgggcagtctttcctccctagcgcttttgaaattacagacacttgacaatgacgccatctagtggaagattagcaggtcagacgaaaacccatctatttgtaatttatcagccgcagcttctcctaaacgcttttttcttttttttttgagacagagcaacctccacctcgtgggttcaagtgattctcgtgcctcagcctcccaagtacctgggattacaggggtgcaccaccatgcctagctaactttttgtatttttagtagagacggggttttaccatgttgcccaagctggtctcaaactcctggcctcaagtcgatccacccgcctcagcttcccaaggtgctgggattacaggcgagagccactgcacctggccacccccaacacctttaaaatagctttggacgctcccagtgcttatttcacttttacattgttatttctaatacagacatactattgatattaaaaagtacataaaatatgtaatgcagaaatagtacattgaaaatatataaagtaggccaggcatggtgtctcatgcctggaatcccagcactctgggaggccaaggagggaggatcgcttgagttcaggagaccagcctgggcaacacggcaagacctcgtctccacaaataaaaaaaattagccaggtgtgatgatgaagtatgcctttagtcccagctactggggaggctgaggcaggaggatcacctgagccatggaggtcgaggctacagtgctcaccgcaagttttttgcccccaaaaaacttgcgtttcagcccaaacaccattcccattgagtagcaagcaactttgagcaaatatctcagcttctccctctgtaaattccaacagtaaggctcttctagcactatgtacaaacaagtattttcagccttcctacaaagagacagactacctttatagttacagtttcctttttatttatttatttatttttgacagggtcttgttctgttgcccaggctgcagtgcagtggtgtgaccacgcctcactacagccttgagctccggggctcaagcactcctcctgcctcagcctccccagtagctgggaccacaggcatgccccaccatatctgactagtttttaaattatttgtagagatgaggacttgccatgttgaccaggctgggttttttcatgtgtgaaacagaacacgtcacagggtcattatgagaatggagtcagctggcccatctaatgaactgatctttaaccaggaggtactcagtaagtgctagattcttctctttggaacttgaaagaccagaggagagcccagcaaactcagagaagcaggaaagaccattcataggatgttgttcctgggtgctgatgccccacaattggggctagtccactcctgggatggccagcaaaactcacttattcagagctgtggactgacagagcaagaatcaggagaaatagatgggtttcgtctgacctgctaaccttccactagatggcgtcattgtcaagtgtctgtaatttcaaaagctctagggaggaaactgactgcccattaactgtttatgccttaacactttatttttattttcgcttgtttttcttttgagtcacttgaaattaaatttaaaaagttgaggccaggcgcagtggctcactcctgtaatcccagcactttgggaggctagtgtggaaggatcacgtgagcccaggaattcaagaccagcctgagcaatacagtgacaccttgactctacaataaatacaaaaaattagccaggtgtggtggtgcgcacctgtaggctcatctactcaggaggctgaggtgggaggatcacctcagcctgggagatggaggttacagtgagccaagatcacaccactgcactccagcctgggctacagagcaagaccctgtctcaaacaaacaagcaaacaagcaaaacaaacaaacaagaaacaagttcactcaggtcagctgatgtagtcttcccagaatcctcagcacccccttccctgaagggggtctggaggtccactggcatcactttgggacctagggagtgcagcattctcccaggcggcagcccaggccattccggatacaagacagcaagacagagtcaccagagcccttacttgtcccctgtccctacaaggaaacccaaagccttccttccttccttgtgctcagcctgtggtaaacacccagattttctggaatcgtcttctctccactaacaaaatcttgacaaatcatctcttaggataggtcacttctgctggcagctaagggcctacccagatccttattggctttggtttaaaagggtaatttcagctgggcatggtggtgtacccctgtaatcccagcattttgggaggctgatgtgggaggatcgcttgagctcaggagttcaagaccagcctgggaaatatagcaagacctcatctctactaaaattaaaaaaaaaaaaaaaaatcagccgggcatggtggcaagcacccgtaatcccagctactcggggaggtgaggcgggagcttgatcctttaaccctgtgaccatgtcagggtactttctcttggcttctgccatctgaagggtgggaattttggaggttcatatcatatttagctctaaaaattaacttgagcagctaaaagcctttgcaagctcgaaattgactgctttaggctccttctgggaagagtactagaaattgcccggcaccctagctaagtggctaaggccttatcttttttttcacagtggtggcctcggttcaattcccggcttagggaataagtgctttctggtttgctgtctgtgtgacttttgccagttattaattatcttccctaccatgaacaacttctgacttcccatcttgaattttcctttctctgggctacatttggcgattctagatccttgtaacaactgcttaccacctctttgaaaataccacacacaccaggcacagtggctcatgcctgtaatcccagcactttaaaaggaggccgaggcaggtggatccctaaggtcagaagtttgagaccagcctggccaacatgacgaaaaccctgtctctactaaaaatacaaaaattagctgggcatggtggcacgtgcctgtaatcccagctactggggggctgatgtaagaggatagcttgagcctgggagacagaggttgcagtgagctgagatcgtgcgtgccactgcactctttgaaaataccacacatgccggacacagtggctcacacctgtaatcccagcactttaaaaagaggccgaggcgggtggatcccctgaggtcagaagtttgagaccagcctggccaacatgaagaaaccccatctctactaaaaatacaaaaattcgctgggcgtggttgcgcatgcctgtaatcccagctactaggggggctgacgtaagaggatagcttgagcctaggagacagaggttgcagtgagctgagattgtgcgtgccactgcactctcgcctgggcaacagaccaagactccatctcaaaaaaaaacaaaacaaacaaacaaaaaaaaaaaacaaaaaaatgcacatccatggttaagtcataatcctagttaagtcttattcgtttcacctggaaggttacctttggtcaagtccaaaagccaggaatatcagctatttgtcctggctagagtggtaataagagatttggttaaaagtcaggctctgctctgttttgcattgtgttacctgatgttttttacatttagggtatgagagattacattatgagagagcttttagccttaatgtgtaataactaggtaggaaatatacttcaagggatggctaatggcagttataggggagtactcagttctttgcatgtttggatcagagaagcatgctcttgaccacctagaaggtatggaaacatacccacccacccccactgagagataagactcctataagggatagcctgattccctttatttggggatccaagcctgcttattagtccctagaaactgcatactttcctggccctgttccttaaaaggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactccatttgcttctaacctccaatctgtccgtgtcctttcctaggcaggctgaactaactttgggagaaacttggtttatagtttaaaacaaagataagtcgggtgcagtggtggctgggtgaggtagcttacgcctgtaatcccagcactttgggaggctgaggctggtggatcacctgaggttaggagttcgagaccagcctgaccaatatggtgaaaccctgtctctactaaaaatacaaaaattagctgggtgtggtggcgggcacctgtagtcccagctactcgggaggctgacacaggacaattgcttgaacctgggaggtggaggttgcagtgagctgagatcccgccactgcactccagcctgggcaacagagcgaagactccatctcaaaaacaacaaacaaacaaacaaacaaagacaataacagccctttcccaaagcagacctccttcttgcctggggactagattgcctttttaggactaacattagccacaagattagaaattatggtttaagagtcatgcagctggaggctgcaagattctgaccctccctaaactgctcctaagatcagggcttgaggtattttgcagaccctgctcctgatggatcagctggcaccacccaggtcaataaactgactcatctgatcttgtggccaccacccaggaactcagtgcaagaagacaacttctactccctgtggatttcattcctgaccaatcagcactcctggcttcctggcttccccctacccacccttaaaaactgtgctccctgaatgcttggggagactgatttgagtaataataaaactctggtctcccgcagagccggccgtgtgtgaattaccctttctctattgcaattctcctgtcttaataaatcggtctgtctaggcagtgggcaaggtgaacccactgagccgttacagtcttaactgcagttattcacacccttttccttggtttgagtaaaatatagatttgttattggaaaggggtctcaatctagacctcaagaaagggttcttggatctcacacaaggggtaatccagggtgagtccacagagtaaagagaaagcaagtttttattagaaaagtaaagaaacaaaacaatggctactccataggcagtgcagccccaagggctgctggttggctatttttggaaatttcttaattatatgctaaacaagggatggattactcatgagctttctgggaaaggggcaaggaattcctggaactgaggatttctcttccttatagaccctataggttaacttccagacattgccatggcatttgtaaactctcatggcactggtgggagtgtcttttagcatgctaatgcattataatgagcatataatgagcagtgaggacagccagaggtagctttcctcaccatcttggttttggtgggttttggcagcttcttactacatccttttttatcagctgggtctttgtgacctgtatcttgtgctgatcttctgtcctgtgactaagaatgtctctctgggagtgcagcccagcaggtctcagcctcattttacccagtccctattcaagagggagttgctctggttcgaatgcctctgaaacatttgctaaatgctttaatatcataaactgctttaactttttctttttttttttttttttgagactggagtctcgctgtgtcacccaggctggagtacagtggctcgatctcggctcactgcagcctccacttcctgggttcaagcaattctcctgcctcagcctcctgagtagctggaactacaggtatgtgccactacgcctggctaatttttgtatttttttagtagactcagggtttcaccatgttggccaggacgtttctttaatttgataattgttcatcttaactgctttggagccattagattctaagtaagccccattagattctagataatgcctaacctcctaggaatgcagcccagcaggtctcagcctcactttacccaactcctactcaagatggagtcattcttgttccagtgcctctgacacactccccctcccttttacagggagacttttcatcctaagtgttgtagagcgatgaggatccatcatctgtaatttctttaggagaaataagggtgatgacattcctgcctaactattagtttctctagtattcagggtagagagaagcttaatcagagagcattggtatggtcaaggccaatcataactctgagttctgacaaaaggtgagatttagaagattaacaggtgttcaatttaagaaattatctaaagtaaactaagtaaggaggctttccatgaactagacaactgttggaaccaaggtgatatggagtcgctagccaattccatctgtcccagaattagatattgatccagattttttttttttttaattgagatggagtctggctctgtcgcccaggctggagtgcagtggcgggatctcggctcactgcaagctccgccttctgggttccggccattctcctgcctcagcctcctgagtacctgggactacaggggcccgccaccacgccctggctaatttttctatttttagtaaagacggggtttcactgtgttagccgggatggtctcgatctcctgaccttgtgatctgcccgccttggcctcccaaagtgctgggattacaggtgtgagccaccacgcccagccaatccagatttttatattactcattcctctcttttcctgagcagctgccagaaatcactggttggttcccaggaataagcagggtcagtttaaattgcagaaaaaactaaaaagattttttggctttttattagttcagtctatgcagttagttcctgttttgctcaatgcttatagactcattttccaagagagtcttggaagttctttcctctcctttttaatggcaaactttgcaaagttatcagaaacttgcatttaagagtccttgtcagagttctatagctgattataagccaccttttgaagaggatcaaaacaagacaattgtctgtagatgatgtgaaaggaaaataaacctcgggactctgaaatcactaagcaaaatggaaaagtcacactgggaactgcgtcaggcaaacctgcctcccattcttaataagatagctacaaagattaaaaaaaaaaaaagccatatacctcccttacaatttgcccacaagtaaattccttgtgggtctcaagatctttaccttagaacattctgttgaatttcaccctggcaatgtaaattgatagcttattttcacaggtgcaggacaaagagtagaactcaaagtcatccctctgctcacctgagacagatgcatatctgactgcttcctctgccctactgtttacattagcatatgtaaaaatgcagattcactgagccagacatggcataagtggctattcatctactcccctgccttatgtaaactgtgtattcagtgaaaggctgagcaaagactcagaaagatgcaaccatttgtctcttatctacccagacatttaaaaaatttttcctcttcccccagtatccatccttccccttttaaatattgaagccctcaaaatctttggagaatggcacagtttcctaggcgcatgtccttaaccttggcaaaataaactttctaaattgattgagacctgtctcagatacttttagttaacaatgacaaaaagtcttagggcagccacggttaaagacacaattgactaggagttttggttatttctgtggcatacaacaattttacataacagttataattactgatagcacacaataagtcatgtcagaattacatgagtttcccataattttggagcatacatcaataacacattcatacaaataaaatccaaagaaagccaaacactgttttatatttgacagctttctgtatgattttaatataccaaataagccaaatatttcattttgaacttatggaacttaacatctaaaaggattaatcaggtcagaaaaagacataatttagaatttgattttggaaagtttgtcaaatatcaaagatttaaagcacttgatattataaaataaaatcccaggacaccacaagtcatttatttagtcaaatcgatgactcaaagatttttaaaagacaaaaacctttactcattgatagcgggaagacagctttccaaacaatgtcttttttttctcccttctttttcctgtagcgtatttaaaagcgaagaaaaatctttcattgtcttttaatattatgtgaaaatgttgttcaagagagaaagctaaattttacttttgcattaatgtactattaacgtcaaacccaattattaataaaaccttatagacaaatctatacaatcttaatgtttcaccatgaggtaagattctcataaaccttttacaagattttttctttttctttttctttttttaaagaagagaagttccaaggaaaactgttgtgcttttatttcaatgttcgatttattgaaaaaactgaataataccccctttaactttagccagtatgttcacacatataatttcttttatgagattaacctttcacaaccatccacaacttgctgaaacctcagctttatcctatctaaattttacagtcctttttttttttttcttttttcttttctctttttgagacagaatcgcttcgttgcccaggctgcagtacaatggtgtgatctcggctcactgcaaattctgtatcctggattcaagagattctcgtgcctcagcctcctgagtagctgggattataggcctgcgccaccatgcttggctaatttttgtatttttagtagagatatggttttgccatgttgcccaggctggtctcgaactcctggactcaaatgatcaagtaacctgcctcagcctctcaaagtgttgggatttataggtgtgagctgctgtgcccggccaaaacaatcctttaaccctctaaactaggccaaaaaacccacattcccatgccatcttgtaatcttttgccaaaaacattgtactttccttacacaccttgtatgcatatgtcccagtgttaactcttagcaacttttatttttggtgaaaaacttcgcaagtaccgagtgtggcacctaggacagcaggcagtagtgcagataaggtgtgactctttctagcatagccagggggcatggctaccctcatatatccccaggccttccctagactctaatggttccaaaagccacagaagcagtttatgtagtttagtaaacacagtatctgaccttcctaacttagaccaaatgtttaaattttgaagacatttttattttaccaataatctttaaaactatctttatctcccaaagattaaagtcatgggaactaaaaggcattaaaatttctactttcctgagaaatatttaagtgcttatttttctttaaaccaattaattagagatcttttatataaacattatatacacaacacatataaatatgcacacagatacacagatagaagagcttttttttttttttttttttttttttttaaagaacagagtctcactccgtcacctaggctggagtggagtgccatgatcttggctcactacagcctcaacctcccaggttcaagcaattctcgtgcttcagcttcccgagtagctgggactacaggcgcccgccaccacgtccagctaatttttttatttttagtagagatggggttttgccacgtttcccaggctggtctcgaactcctgtcctcaagtgatccacccacctcggccccccaaagtgctgggattacaggcatgagccacttggcccagtttttaagttttttaactggattgctagcttcgggttggagccctttgaggaacagggctaggaaagcatgcagcttccaagaagatgagtctctgatccaaacatggaaagaactgagtattccccatagctgccattagccatccctaaaagtatattttccaccaagttattacataccgagaccaaaagctctcccaggtgaaaccaatgagccttaactaaagttacgacttaatcatgggcataggaggtattttcaaagaggtggtgagcagtttttataagatctggaatctccaaaggtagctctgagaaaggaaaattcaagacaggaaatctgatgggccggcttgaatagtgggcttataggggtcccaagtccacattctatcctgtggtacccctctcttcatgacagaacaacacagaaagacaaattcatgacacaaggtacaccagattcactacagcctaagactagcctcacaaatcatttttcctattaatcaaaaccttgcagaggagacagacactattttttttaaccatttattcaaccagtttgcacacagagagaggccagaagcttgactggtaagaaattttttatttttatttttttttagacagggtatctctctgccacctagcctggagtgcagtggcaagatctctgctcactgcaacctccacctcccaggtccaagtgatcctcccatctcagccctccgattagctgggactgcaggcatataccaccacacccaactaatttttgtgggtttttttggtagagataggggtttcaccatgttgcccaggctggtctcgaactcccaacctcaggtgatcctcccacctcagcctcccaaagtgcttggattacaggcatgagtcactgcacctggtctctgactggtaagaaattcttacccttttgccagcatgccaagtttctaggttccctttctctgtatgactttgatggccctgcttgctgtgtcatagctatgggggccaagccatgtgacaaaagaaaatcatctttttctgtttcatggaaccataagcaaaagcctctcaattttgcaagatgctgcccaaaaggctgcatggagaaatcgaattaatgttttttcattctggctggagcaaaatacatgtgacaaaacagccaccccgctgggcaccaaatatcagcctggcaaggctcaaaattgcccctgttggcccctgtcatctttgatctactcaaagtggggtggaaggacctccaaaccaggagtttcaatatgtggtctctgggcaagatggaagagtggacagtcaccctgagtgacagaaaagatagaaaagggaaaggaaaggaagacagacagaggaaactggagggagaaaagcattgcctgtagcagagaaagggagatgagaagcaccaggaggccatagaaccatccaccatcacagcaacactgaaacaaaagttcaggcaactgcttgtcagtaacgaagggatcttttccaggagtcctgtcagctctcaattttcccctttgatggaggaaaaaaacccgcagtcatcagcaaagaacgcaaggtggattaatccaaagagaatagctgttagcatcccatagtgccaaatccatttttttttttttttttttgagacagtctcactctgtcgccaaggctggagtgcagtagcactatctcggctcactgcaacctccacctcctgggttcaagtgattctcctacctcagctttcccagtagctgggattacaggtgcacaccaccacgcccagctaatttttgtatttttagtagagacggggtttcatgatgttggccaggctggtatctaactcctgacctcaagtgatctacctgcctcagcctcccaaagtactgggattacaggcgtgagccaccgcgcccggccactagatccatttttaactaagaggggccttactgagggggacctctaaccccctatgtcttaggggggaatctaacccttcgaagttgggcttctaacccaaatttttgtcccttaaccgggataaaagctacccactacttacccaaagtcggccaattagtgctgcacagatgattttcctttgggccaagggtctctctggtaatgtcttttcgtggtttgccaggaagatgttcctggaaaggggtcccaatacagaccccaagagagggttcttggatctcacacaagaaagaattctgggtgtgtccacagagtacagtgaaggcaagcttattagagaagtaaagaaacagaagaatggttattcaagaggcatagcagcccagagtgctgcgttggctgtttttatggttatttcttgatcgtatgctaaacaacgggtggattattcatgagttttctggaaaaggggaagaaattcttgaaactgaggcagtctatataactttcagacgttgccatggtattgtaaactgtcacggcagtggtgggagtgtcttttagcatgctaatccattataattagcatataatgagcaatgaagagattccagaggtcactttacttgccatcttggttttggcaagttttgattggtttctttattgcatcctattttatcacttgggtctttgtgacctatatcttgtgcggatctcctgttctgtgactaagaatgcctaacctgggaatgcagtccggaaggtctcagcctcattttacccagctcctattcaaaagaatagttgctctggttccagcacctctgacacatttgctaaatggttaaatgtcataaattgcctatttaatgtgataattgttcaacttacctgctttggagcaaagggctgaggaagtggagttagctatgccccctagctatgctgagaagagtcagacctcatctgcacttctcagcaggcgttctaggcgccacacctggtacataaatagaacctcttacttgctaggtttttcaccaagaataaaagtaactaagaggtaatattataacatatgtaattgagagtactggagaaacagtttcacatgcaaggtatgtaaggaaagtagcatgtgtttttggtaaagaagatatgggaatgtaggttttttggcctaatttagagatttaaaggattgttttaagtttgataggataaagcgaaagttttgagtaagttgtgaaagattaatcttataaaacaaattctatgtgtgaatatattggctaaagttaaagggatattattccatttttccataaattgaacattgaaataaaaccacaacagggttttcttagggcattgatttgatccttctttttttgacacagagtctcgctctgttgcccaggctggaatacagtggtacaatctgggctcactacaacctccatcgcccaggttcaagcgattctcatgcctcagcctcccaagcagctgggattacaagtgtgtaccaccatgtccggctaatttttgtatttttagtagagacggggtttcaccatgttggtcaggctggtctcaaactcctgatctcaagtgatccacccacctcagtctcccaaagtgctgggattacaggcatgaaccatcgtgtctggctgatttgattttaacagaaaattgtaaagggttataaaaggtttacgagaatcttaccttatggtcaaactaaatgaaattaaataaatttgtctatagcttttattaagaattgggtttgacattaatagtacactaatgcaaaggtgaaatttggctttctctcttgaacaaaattttcatgtaatattaaaagataatgaaagatttttccttgccttttgaataaactacaggaaaaagaagggaaattaaaaagactttttttttggaaacctacctcttcctctatcaatgagtaaaggtgtttgtctttttaaaatctttgagttatcattttggctaaataaatgacttatgttgacctaggattttattttataatatcagtattttaaatctttgatacttgacaaactttccaaaatcaaattctaaattatgtctttttttgacctgattaatccttttagttattaagtcctataaaatccaaaattaacatatttggaccaggtacagtggctcatgcctataatcccagcactttgggaggccaaggccagtggattgcttcaggccagtagtttgagacgagcctggccaacatggcaaaaccccatctctactaaaaatacaaaataaataaaatacaaaatacaaaataaataaaaatacacagccagtcatggtggtgtgtgcttatagtcccagatactcaggaggctgaggcacaagaatcacttgaacatgggaggtgaagattgcaatgagctgggattatgtactgcattccagcctggggcacagagtgagactgcgtcactgcactccagcctgggggacagagtgagactgtctcaaaaaatcaaaacaaaacatatttgacctatgtggtatattaaaatcatactggaagcattgtcaaatatgaaatggtgtttggctttctttgggatttatttgtataagtatgttattgatacgtagtgcaaaattatgggaaactcctatagttctgatatgagttagtgtaagttatcagtaataataatttttaggtaaaattgttggataccacagaagtgaccaaatttccttgtcaattgtgtctttgaatatggctcccttaagaccttttgtcattcacagacaattactgtcttgttttgatcctgttcaaaagatgttttataattagctataggactctgactcttaaatccaagtctctgctaagttttgaaagtgtgccattaaagtagaggggagaaatttccaagactctcttggaaaactaatgtgttcataaatatcaagcaaaacaggaattaattgcatagactaaattaaaaaaagaccaaaataatcttcttacaactttttgcttcaaacattgctgatcctttctgttttgtttttcagagtcaagaaaactcttcttttgaattatttacagcttttaacaattgagtaaagtatactcctacgagcaaaatttggagcatatttctttctctctacctgatttttccagaatctggaaactatttgtgagtattcatgagtgttttttgtttgtttgtttggtgggtttttgtttgtttgtttgtttggccagggcctttctctctcatccaggctgaagttcagtggcatgatcacaatcatcacaggtcactacagcctcagcctcacaggctcaagtgatccactcacctcagcctcccaagtatctggggctacaattgtgtgtcaccacgcccagctaatttttttttttttttttgtagagatgaggtctcactatgttggccaaggtggtctcaaactccggggcactagtggtcctcccacatcagcctcccaaagtgctgggattgcaggtgtgagccaccacatctggcctagtattcttaacttatggcaatatagctatttgcataagtgcaataagaatctgtttttcttttgtataaggttattttatctggcgtgctttcaaatacaaacagactgctttaaggaatcaaagttgacatttcaagccaataaaagccccttaggaaaactgccatcataccttgtctacacaatccctgtacagggtttctgacctgtggcaagtaaagaatgtcactttctgacaggcccagaagcctcaagttatcttgggacctcaagaagagagaaatttaccaactcatataggtatttgcaggcacagattaatcagtggctgggctcaaggccttaaaaactctaatctaagagtccttacagaacaaagttacatcaaagccaattttatttttctattatgattattattattattgagatggagttttgctcttgttgcccaggcttgagtgcaatggtgtgatatctgctcactgcaacctccgcctcctgggttcaagtgactctcctgcctcagcttcctgagtagctgggattacaagcatgcaccaccacgcccagctaattttgtatttttagtagagacagggtttctccatgttggtcaggctggtcttgaactcctgacctaaggtgatctgcctgcctcagcctcccaaagtgctgggattacaggcatgagccaccgtgcctggcaatcaaagccaaatttaaaagaagcctatatagcaaataattattcttgctgcacattatgccgataatatgccaagtatcataagattaaagcctgttttgcaaacaaatcagtcctatcatgatttgttttaatttaataaaaatggaagatgagagagagaaaaaattgtgtatcaaaaactatggtataccttgatatggtttggctgtgtccccacccaaatctcatcttgaattcccacacattgtgggagggacctggtgagagggaattgaatcatgggggcaggcctttcccatgctgttctcatgatagtgaataagtctcatgaaagctgatagttttataagggggagtttccctgcacaagctctctctttgcctgctgccattcatgtaagacgtgacttgcagctccttgccttccatcatgattgtgaggcctttccagccatgtggaactgtaagtccattaaaactctctttcttttgtaaattgtccagtcttggctatgtccttatcagcagtgtgaaaacggactaatacatatctgttattagagtctggtctcatccattgtttttgagttttttctgctttttaaattttattttttggacagaatctcactttgtcacccaggctggagtgcagcgacatgatctcggctcactgcaacctccacctcctgggttcaagtgattctcatgccttgacctcccgagtagctgggattacagacacccaccaccacacccaggtaatttttgtatttttagtacagatggggtttcgccatgttggctactctggtcttgaactcctggcctcaagtgatccaccttcctcagcctcccaaagtgttagaattacaggcgtgagccatcacacctgaacttttctgctatttagactgaccctgattatttttgtgaaccaatgagtgatctctgtctgctgctcagcagaaacaggaggaatgggcaatgtaaaaatttgcatcaggtttataattctgggcatgcattgggattggctagcaactccatatcagcttggttccaacaattgcccagttcatggaaagccttcctatttagtttacttggaattattttatctattttgttttactattatggaatatatggctgttgtactctttgtgtaggaatgcaggataaacttactcaacattttcttttttttttttttttaagatggagttttgctcttgttgctcaggctggagtgcaatggtacaatcttggctcaccacaacctccgcctcccatgttcaagcgattctcctgcctcagtctctcgagcagctgggattacagacatgagccaccacacctggctaattttgtattttcagtagagacagggtttctctatgttggtcaggctggtcttgaactcctgacctcaggtgatctgcctgccttggcctcccaaagcactgggattacaggcatgagccactgtgcctggccaacattttcttaaattgaatacttattaatcttccagataccacctttttgtcagaactcagagttatgaatggccctcaccatactaatgctttctgactgagctcctctctaccctgaataaaagagaccctaataattaggcaggaatatcaccacccctattcagcccaaagaagttactgatgatggatcctcctccctctacaacacttagtcctcttgtaaaagggaggaagaaatgtgtcagaggtgttggaacaagagtgactccatcttgaacaggggctaggtaaaataaggctgagacctgctgggctgcattctcaggaggttgtggattcttagtcacaggatgggataggaggttggcacaagatacaggtcataaagaacccactgataaaacagcatgcagtaaagaaaccagcccaaacccattaaatccaagatggcaacaaaagtgacctctggccatcctcactgctcattatgctaatataatgcattagcatgctaaaagacactcctcccaccagcactatgacagtatacaaatgccatggcaacgtctagaagttaccctatgtggtctaaaatggggaggaaacattagtttgctggggtctggatcagaacccctttctggaaacactgtagataacatcactattgtaaaacctacaattggtgttttggagatctttcagactgaccccacctggacccatgactcatgagtcagctgatcctgtggctccatgcagaggtggactcaactgatgaagactgttttccacacccctatgatttcatcctcaaccaatcagtaacacccattcccaagccccctgctcaccaaattttccacaaaacccttaacatcatagcctttagggacaactgctttcacaggctggcattgagtgcctgcagtttttccaggcacatagtgcaagttgtcagtggatctaccgttctgggatctggaggatggtagccctcttctcacagctcaactaggcaatgctccagtggggactctgtgtagggagctccaaccccacatttcccctctgcattgccctaatagaggcccatgagggctccacccctgcagcagacttctgcctggatatccaagcatttccatacatcctctgaaatctaggcggagctcaactgttgtcttctgtgcacgtacaggcccaataccacatggaagctgccaagacttggggcttgcaccctctgaagcaacagcctggactgtaccttggtccctattagccatggctggagctggagcagctgggacgtgtggcaccatgtcctgaggctgcacagagcagaagggccctgggcctggcctggaaaaccatttttccctcctaggcctccaggcctgtgatgagaggggctgccatgaagatttctgaaatgccctggagatatttgcgccattgtcttggctattaacattcagcttctctttacttatgcaaatttatgcagcccaggggcttgaatttctccccagcaaatgggtttttcttttctaccacatggtcaggctgcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcacctcccaccagatccctccttcaacacttggggattacaattcgagatgagatttaggcagggacacagagcgaaatcatatcattgggtatataaaattttcaaacagcatcatcatttgagctaaaacattttttttttttttttttttgagacggagtcttgctctgtcgcccaggctggagtgcagtggcgcaatcttggctcactgcaacctccgcctcccaggttcacgccgttctcctgcctcagcctcccgagtagctgggactacaggcgcctgccaccatgcccagctaatttttttgtatttttagtagagacagggtttcaccatgttagccaggatggtctcgatctcctgaccttatgacccgcctacctcggcctcccaaagtgctggaattacaggccatgtagccactgcgcccagcaagctagaaacatttttaaattttgtaattgttattgttcatcaggtagttgaggatttaacaccatgaataatactattagtatgaagagaaattccctttttatggagaacatacgttacccagtggccatcaatttgaaagaacttattggaaaagttcaaggcccatgttaagtcatgccaggattcaaaagaccacaccatccacttctttttcttttcttttttttttttgagacagagtttcactattgtcgcccaggctggtgtgcagtggcgcaatcttagctcactgcaacctccgcctcccgggttcaattgattctcctgcctcagcctctaaagtaggtgggattacaggcatgtgccaccacgcccggctaattttgtatttttagtagagacaggttttctccatgtgggtgaggctggtctcgactcccgacctcaggtgatctgcctgcctcggcctcccagtgtgctgggattacagatgtgagcccggccatccatttctaaacatcaacaaaaccttggaaaatatgagaatggtgtgattaacaatttgtatgaaaacttctatctcttgataagtataagtagttttgtaatataggtcagttagagacaaagtgggggcagtggtgaaatctatttttaaatcttttatttatgtcttgagttatatatttatgttctcctactgattgttgttgttttttaatagagacagagtcttgttttgttgcccaggctggtctaaaaatcctggcttcaaggagtcctccagcctcagcctgccaaaggggtgagattacaggcatgagccaccttgcctggacagtaaatattttttataatacttctgcatttctcattagaagtttgtgaggattaaatgagattatcagtatgaatctcttagcacagcaaaaaggaatatagcaactttattgtgtgttactatatttaccgtcagtcttatcaatatggtaaattactgcagacctcaacaacatggatttggcatgattttgagaaatgtgtcaggtctatggggaaaatgttttctttttcaatttaagacttcacctctggtttattatgccacttttttttttgtagttgttgttgttttggttttggttttttaagacagtgtcttgctctgttgcccaggctggagtgcagtggcacaatcacagctcactgcagccctgatttgtcaggctcaagcaatcctcctgccatggtctcccaagtagctgggactacaggcacgtgccaccaagcccagttaattgtttcaattttttcaatttttttcaattttttttttttttttgtagagatggggtctcactctactacccaggctgatctcacactcctaggctcaaacgatactcctgcctcctactcagcctcccaaagtgcttggattacaggcatgagcccccacgcccagctgattaatattattccacttttgacaaatccgtcttccacggccttgctaaagcgctcctagcaatgtttgctaacagctgtaagcggtatttcccttggtttcctctgctgtctttggatcagatctgcggtcagcaagcttcctgcttgcagcagagaattctagacatgtcagctgttctgaaaggtccccagtcctcccaggcacgatggatctcaggggccccatccctccctctgcccaggctagcatggaggacacgctggtggggaaagtgtcttaactgtcatgcttacaaaacctccaattccctttagcagaaattctagcactgagagttatcccatcagagattaaacttgtagggttctttccatcctcgcttctttgctgagagaaattgccactgatgtcacagtatgaaaagcaccatgtcatctcttttagaagggaagtgcctgagaagtaatttttactgtaagagggaataaaggccttttgtgaactgagggttacagatgatttgctaccaggcagtggtggacaggtagggaggaagtgggatgagggcagcaggcccctggtggtggcagggtgtggcccctggggtggctgaccaccaggaggtgggccctggcgagcctggagtgagtcaacgctggggtggggaggatgtcctaggagaatctggacatgggcagagaactggctttcctacagagatgacacctgtctttggttttttttgttttttgtttgttttgttttgttttgagacagggtctcactctgtcacccaggctggaatggaatggcgtgatctcagctcactgcaacctctgcctcccaggttcaagtgattctcatgcctcagcctcccaagtagctgggattacaggcatgcaccacgcccagctaattttttatattatttgtagaggtggggtttcaccatgttggccaggctgatctcaaactcctgacctcagatgattcacacacctcagcctcccaaagtactgggattacaggcttgagccacctcgcctggcctgacgacacctgtctacaggaatgtgcaggacctacctacagggttaaccctgtgtggagacaagaatcagtaacccaggtgaccctgcctgatcatagggcttcctttcacttgggaagcccctcccatcatttcccacctcccacttcagactgatgagactggaatatgtggcgttactttgtgtacacttcagagagccaggagaattctggatcctgtagaagtgaaccaaccacaagctactccacattgttaatttagggattctgagacctcaagtcaagaaagttctgatcgtgggcactgggcagacagagacagtggaaaagaattgggagcccaggctatgacttcagacagatgaggaagttttgtttgttttatttttatttacttattctttatttttattttttgagacagggtctcgctcagctgcccaggctggcatgcagtggcaagtcatagctcactgcacccttgacctcccagactcaagtgatcctcctgcttcagtttcctgagtagctgggactacaggcgcacaccaccacacccggctaatttttatttttagcagagacaaggtctcagtatgttccccaggcgagtcttaaactcctgagctcaaatgattctcccgtcttggcctcccaaagtgctgggattacaggtgtgagccgctgtacccgacccacacagggtttgaatcccagccatgctacttcctagctgattttccccaaatgtataatggggacaataaccctctagagaattacaggagatcatgaggaaaaagcatttcacacaaggcctagtcaatacacaacagctgccactatgactatgaaccgaaattcatgataaactgcttctaacaatgcatgctatacccaacaaagaatgtatgcaggggacggggtgctaaagacattcctgggggcagggacaagcggaaatgaattatattcatgcctattggatattttctttggattttgtatgctgtttcgatttttataattttttttcttaaggaaaaaaacacatatttttttcttaaggaaatagacactggccaggcgtggtggctcacgcctgtaatcctagcactttgggaggccgaggcagggggatcacctgaggtcaggagttcgaaaccagcctggccaacatggtgaaaccccatctcaattaaaaataagaaataagccaggcatggtagtgcatgcctgtaatcccagttacttgggaggctgaggcaggaaaatcgcttgaactggggaggcggggaggcggaggttgcagtaggccgagattacactattccactccagcctgggcgacaaaagtgaaactctgtctcaaaaaaaaaaaaatagacactgttgttgcaagcctatgggttgcctgagggcaagtatgggctccaggtaggtcttttgaggaaaggatcttgtttttatctttcatgtaaaagttactttatctttctcaatacctcagtggttttgaacccaagcctctgggaaatgtcccaacctcctgtcctcactcagtgcaccatactaccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagaggttatagtgagccaagatcatgccgttgcactctagcttgggggacaagagcaagatttcatctcgaaaaaaaagaaagaggagctagaataagaaaataaaagctggagagaatgtggagaaataggaacgcttttacactgttggtgggagtgtaaattagttcaaccattgtggaagtcagtgtggtgattcttcaaggatctagaactagaaatatcatttgactcagcaatcccattactgggtatatacccaaaggattataaatcatgttactgtaaagacatatgcacacgtatgtttattgtggcactattcacaatagcaaagacttggaacccacccaaatgtccatcaatgatagactggattaagaaaatgtggcacatatacaccatggaatactatgcagccataaagaaggatgagttcatgtcctttgcagggacatggatgaagctggaaaccatcattctcagcaaactatcacaaggacagaaaaccaaacaccacatgttctcactcataggtgggaattgaacaatgagatcacttggatacagggaggggaacatcacacactggggcatgtcggggggttgggggttagggaagggatagcattaggagaaatacctaatgtaaatgatgagtttatgggtgcagcaaaccaacatggcacatgtatacctatgtatcaaacctgcacattgtgcacatgtaccctagaacttaaagtataataataaaaaaaataaaaataacattctactctccagatatagctattgttaacattttgagaaaatatccttccagatagtttttctctttctttctttcttcctttcctttcttttccttttttaatttagagacaaagtctcattatgagtctcccaaagtgctgagaatacaggcatgagccactgtgcccggcctccagatagtttttctatgtatacaaattatgcactttcttatttagaaaaatgatttatgttattacaactgttaataataccttttctcttttcttaagtatattgtgattctcttaccacatcatgaaatgttcttctacatcaccattaaaaattcttttttttttttttttgagacagtgtctttcaaaagtgcagttctgaatcaaggcagccttgaagtcttgttattatggcaagccctccagtgccaggagaactgaggtaggagtaaactcagatcagcctttgaaatagaatgtgtgaggccaggtgcagtggctcatgcctgtagtctcagcactttgggagactgaggtgggtagatcacttgagatcaggaatttgagaccagcctggtcaacatggcgaaacctcatctctagtaaaaattaaaaaaattagctgggcgtggtggcaagtgcctgtaatcccagctacttgggaacctgggaactgtggaggttgcagtggcccgagatggcgccactgcagctattactccagtttgaaaatactagaagttgccaatatatattttttccattgccagacttgtctgcaatttgtactggatctgatagagaaaccatttccatgggtctatatgaaaatgtggagccgggggtagtggctcacgcctgtaatcccacaacttcgggaggccgaggcaggcagatcacctgaggtcaggagttcgagaccagcctggccaatggggtgaaatcccgtctctactaaaaatacacaatttagccaggtgtggtggcacgtacctgtaatcccagttacttgggagggtgaggcaggagaatcccttgaacccaggaggtggaggttgcagtgagccgagatagcgccactgcactccagcctgggcaacagagcgagactccatctcaaaaaaaaaaaaaaaaaagagagagaaagaaaatgtgggtgcggggaatgattctatggttgtctgttcttttccagctggccagcagtggtagccaaaaagtgacaggatgctgatgaaaaacattgcagacgtgaagaaaagaaaaagttgatggaattttgcacatgtatctgacagttcacccatccaaacttttataaagtgctgtaaagttgttgtagtaagggttgggcatggtggttcatgcttgtaatcctagcacttttggaggccacacgcaggagaatcgcttgagcccaggagttcaaaaccagcctgggcaatatagtgagacttcatctctataaaaaagttaaaaacctagtagtgtatggtggtttgtgcctgtggtcccagctactagagaggctgaggtggaaagatagtttgattctggtaagtggagattgcagtgagccaagatggtgccactgtgctctagcttgggagacagagcaagattcagtatcaaacctcctagctagaggatgctagctaggtgacgctgagtcaataaggaaggatttggttacatcttgggacctaaggtacagagatgaatgtcccagctcaaggctgccccagccattcaactccttgcttcctctcttggtggacctgtcaattcttgcaagtgtcaaccagctgtcttgcccacctagccctatagtcatacctttctatccttttggtgatctccactccatcaagaagtggctctgcacattctatttcaactgactttttttttttttttttgagacagagttttgctctatcacccaggctggagtgcagtggtgcaatcttggctcactgcaacctccacctcccgggttcaaacgattcttctgcctcagcccctcaagtagctgggattataggcacgcatcaccacacccagttaagttttttgtatttttactagtgatgggatttcgctgtgttggccaggctggtgtcaaactcctgacctcgggtgatccgcctgcctcagccttccgaagtgctaggattacaggcatgagccaccgcacccagcctgcacgttctatttcaaaggctgatctaaggtaactcctacttcagatctcctggcactggagggcttgccgtaatatcaagtccccaaggctcccttgattcagaaatcactgaggcagcagcaccttgtacagatatttctcagccttcactgtgcgtaagaattgctcagggcccttgtttaaaaaaaaaaaaatcagcgtcctggacttgaaacccagtaagtctggagtggggtctaggaatcaacgtttaacaaaagcaggcatttttggccaggcacagtagctcacacctgtaatcccagcactttgggaggctgaggcgggaggatcacttgagctcaggagtttaacaccagcctgggcaactagacccctgtctttacaaataaaaataattagccagtcctgatggtgcacacctgtggtcccagctactcaggagcctgaggtgggacgagcacttgagcccaggagtttgaggctgcaatgagctatgatcacagcactccactccaacctgggtgacagagtgaggccagtctcaaaaaaaaaaagcaggcatttttgatacaatatttgtatgtatctgcttaagacagtcggtttgcttccaaagactaaatcaaacttccaccaaactccttttggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtggcaccatctcggctcactgcaagctctgcctcccgggttcacacaattctcctgcctcagcctcccgagtaggtgggactacaggcgcctgccaccacgcctggctaattttttttttttttgtatttttagtagagacggggtttcaccatgttagccaggatggtctcaatctcctgacctcgtgatctgcccacctcggcctcccaaagtgctcactcatcaaatgtttaaagagaacacagggccggctgcagtggctcacgcctgtaatcccagcactttgggaggttgagtgggggcagatcacttgaggtcagtagttcaagaccagtctggccaacatggtgaaaccctgtctgtactaaaaatacaaaaattagctaggcatggtggtgggcacctgtaatccccagctacttgggaggctgaggcaggagaattgcttgaacctgggaggtagaggttgcaatgagctgagatcgtggcactgcactccaggttgggtgacagagtgagactccgtctcaaaacagaaaagaaagtaaataaaaaaaaaattgtttttaagtgtggactcttgaagtcagtcccaactcggccatttactagctgtgtgaccttgggcaaatttctcaatctctctgaagcacagttggttcatctgtggaatgggcatgatactatccacactacaagactgtcgtgaaggtcaaatgagatcatgtgactggcacgcctggcacatgatagatacttaacagcttttcttcctttcctataatactgtcttattaatgcattatatatatatataataaaatgtatagctgggtttttctgttaggtcatagaataggctatgatctaacagagtgtagcagacccatttcctgttgagaatttctcttgaatctagttagcagggttacttcctgctctttggaggaagtgaaagataattgtgcagctgagttctataaataaaagtacagttggagaaaacgatatttttggggctgggcatggtggctcacacctgaaatcccggcactttgggaggctgaggtgggaaaatcacttgaagccaagagtttgagaccagcccgggcaacatagtgagactctgtctctacaaaacatttaaaaattagccagcagtgtgcacctgtagtcccagctacagaggctgaggcaggaggatcacttgagcctgggagtttgaggttacagtgagctataattgtgccacttcactccagcatggttgaaagagcaaaaccctgtctctgaataaataaatacattgaaaagaaaatgatatttttggattaaaaaaacccactgtaaatttacaaggattgagaataaaagcacttcttgggccgggtgtggtggctcctgcctgtaaccacagcactttgggaattcaaggtgggaggatcacttgaggccaggagttcaagaccaacctggccaacatggtaaggccctatgtctataaaaaataaacataaaaaagcacttctcagcttcatacttagaactggatcattgacaaaattatattcattattaacaataaatagattgtgaattctaggaagggcaagcttgcaccccaattcctcaaagcagagagatgccctccactctctggctttctcagcactcagctgagaacctcggctaacaacacactgcacggggttggccacatgcccattggcctttcccagtgggccgtgaacttcttgacttctcaggaagggggtcgttcatcttggttccacagcctggagtggagtaagggttccactcatatttgtggtctgagtgagcacacccagtctgtttatccttttcatgttcactttcattcttccagacccggtgacttccccagtgctgaacattatggtcattcaaacagaaacagaccgacatataacattacattgcctctcagtcaatggctcgctgcccatcaattacactttctttgaaaaccatgttgccatatcaccagctatttccaagtatgacagggagcctgctgaatttaacttaaccaagaagaatcctggagaagaggaagagtataggtgtgaagctaaaaacagattgcctaactatgcaacatacagtcaccctgtcaccatgccctcaacaggtaagagcaacctgagttctttcagccaggtctgaactcacttccagaaactgcagctgctcctctgcccacccatttcccaccatggccacctgaccttccaggtccttctgaaggtgcatttgtcaaggtagaaggatagaaggaaaactaggtcgtgtgcagtggctcacacctgtaatcccagcactttggaaggttgtggctggcagatcacttgaagggtctctttggtagagtccatgcaaactctcatggggttgctttctgccataaaggaaccacagaaaggcctagaaactggagcaggagggggacttgtggcaaaactttctgccctgcctttccaatttgcatctgtcttagaactgccaggtcttttagttttctttgttttttcatcatttgtatgtctgcctttctttcttttccttccttccttccttccttcttgtatgcctgcctttctttcccttccttccttccttccctccttccttccttccttctttccttccttccttccttctttcttttcttttctttttttcagagtgtcactctgttgcccaggctggagtgcagtggtgtgatctcagctcattgcaacctttgcctcccaggttctagagattcttgtgcctcagcctcctgagtagctgggactacaggcacccgccaccacgcttggctaatttttgtattttcagtagagacgggttttcaccatgttggccagactggtctcgaactcctggccccaagcgatctgcccacctcggcctcccaaaatgctgggataacagctgtgagccactgtgcctggccatcttgtactgatttctaataccatgccctcctgcttggctgtttattgctccactgctaatgatgatgggtccagactcctgcaccacccttggctcagggcaagagaggcctctggccaagccctgtgtttagtgggctctggtctggtacctccaggctatgcaccttcccctaggctgaggggttcagggagccgtggggatgcagccacctgaaccctatactcccacttttctgctccacactctaggtacctggaccaaaatcccctgcccaatcagatcagaagccatttccagggcctgtaccagtctctcccccagctcatcctcccgagggtggcccacagtaagggtatgagcatccctgaacctgagccaagggagctgtttatggggggtgtggatggtgtttgcacatgtgggctggggcgtccacgtgcatgcaaggccccttagggtgcaggtcagagcccaggtcgggagcggggcagcccgggacttcagtgggttctgtccatgctgccacgtcctgatgccaaactctggaaagtctgagaattccagattcaaacctgaccttccaggtccttctgaaggtgcatttgtcaaggtaggaggatagaaggaaaactaggtcgtgtgcagtggctcacacctgtaattccagcattttggaaggttgtggctggcagatcacttgagcccaggagtttgagaccagcctgggtaacatggcaaaacccctgtctctacagaaaataaaaaaattagccgggtgtggtggtgcatgcctgtggtctcagctactcagaggatgaggtaggaggattgcttgagcctgagaggtcgaggctgcagtgagctgtgatcatcgtgccctgcattccagcctgcgtaacagagcgagaccctgtctcaaagaaaaaagaaaaagaaaaagaaagaaaagaaaaactaggttagcaaaggcacaaggcacacttggacattgaccacttcacccagccaggtcctcagaacagagcccacgccctggtattcagtgagtgtggtctaacaagtgaggcagcctgctggagtcaggcacttggctatgagtcacagcccttccattcactggctgtgtgaccttaggaaagtcatttcacctccctgagccttactcacctcatctataaaatgggagtgatgccaatgggataaataaggcaacacaggtgaagtgcctaacacagtgtctggcctgcagctaaaactcaacaactggcagttgtttggatgacacgaaacatgctgccagggctcagggccttgcccagtaaacacccaggcttttctggtgctcatgaccccagaaatgttgctggtattcgtcctgttaaattctgtgctgcttttctcttctttgggtggcccctgtggaagatgtgcttggtcatgactttttaaactttattattatttttttattttattttatttatttatttatttatttatttatttatttatttatttatttgagatggagtctcactcacccagtctggagtgcaatggcacgatctcggctcattgcaacctccgcctcctgggttcaagcgattctcatgcctcagcctcccaagtagctggaaatacaggcacgcgccaccaggcccagctaatttttatattttgggtagagacagggtttcaccatgttggccaggctggtctcaaactcctgacctcaggtgatctacctgccttggcctcccagagtgctaggattacaggtgtaagccactgagctcaacctatttttgtttatttattaacttatttatagagacagggtctggttctgtccctcaggctggagtgcagtggcacaatcatagctcactgcagtctccacctcccgggctcaagcgatcaccctgcctcagcctcctgagtagctgggatcataggcacatgccatcacacctggctaatttttatttatttatttattttgtagaaacagggcctcactatgttgcccaggccggtctcaaactcctggcctcaggcaatcctcccaccttgatctccgaaagtgctgggattacaggtgtgagccaccacgcccagtcaagaactttattgactaataagtcccgtgagttttagatgtcatgaccatttgggaacctgggtgcatagtacattggttaacttgggagacatcaccttttctaaaacacttactggcttaatgtcattggaaaagaaaatgctatggtcaccaatggatgcggtcttcttccaggcggagacagctgtcctttctgtctgaagctactacttccagggttattactgttgctggtggtgataatcctaattctggctttttgggtactgcccaaatacaaaacaagtaagttcttttagtcgctttaccacccgttttcccgtgggcttgggatacagacagcaggacagagggtgaggagaaagagaaaaggggattggaaatagaatagggagaaaatgaaaataggaggaaaacatgagaaaggggggcgggaatggaatagacttcctgaacggttcatgcagagggtaattctttctccagggaaagccttttctgtttgagggcaagcagagctggcttcacagacgtacagcctgtgctgtcacacagggccctgtgccaagaagaactccacatttggtatttgtttatttatttatttatttatttttgagacagagttttgctcttgttccccaggctggagtgcagtggtacgatctcggctcactgcagcttccgcctcctgggttcaagcaattctcctgcctcagcctcccaagaagctgggattacaggtttccgccaccatacccagctaattttttgtatttttagtagagacagggtttcaccatgttggccaggctggtcccgaactcccagcctcaggtgatccacctgcctcagtttcccaaagtgctgggattacaggtgtgagccactgctcccggctgcatcttgaaattcttcataattttttgtacgctcttttaaaaattgttaatggtggtaaaatatacataacactaaatgggccactttaacctgcttaaatgcatagttcggtggcattaagcacgttcccattgtcatgcacccttctccaccatccatgtccagaactttttcatcttcccaaactgaaactctgtccccattacacactagctccccatcccctcttcccccgggctctgccaaccaccattctgctttctatctccattagtttgactcctctaggcacctcatggaagtggaagcatttatcctttcataactggcttatttcacttcgattaatgtcctcaaggttcatccatgttgtcatatgtgtcagaatttccttccttgataagactgaagaatgtcccattgtacataaatacgccacactttgtttatccatttatcccccatgggtacccgggttgcttccaccttttgtctattgtttaataatgctaggaacgtgggtgtgaaattattaatgtttttaaacaagaggcccttttcctcggtatgactgcttgtgaaagatgtactcggtcctgactttaagaacttgtgttcctttttttctctctctctctcttctttttttattctatattaaatggagacggggcctcactatgttgcccaggctggtctcgaacacttgggctcaaacaatcctcccacctcggcctcccacagtgttgggattataggcgtgagccactgtgccgggccaagaacttgtgttcttaattaaacacaagtttaaggcctgtgaacagtgttcatttcgcactgggcgctgcaagtggtgcggctgctcctgactgcaagtgcctcaagcgagagctttgccttgagtgactctagatctgccacatacgtaggggaggttcagtgcatgaggacaaacaagcgtcatcccattagcacaaaagacaccttcaaaaggtttacaattgtttggggctggaagtattgaaaatattaggttggtgcataagtaattgcaatttttgccatacttttatggcaaaacccacaattactttttttttttttttgaaatggagtctcgctctgttgcccaggctggagtgcagtggtgcaatctcggctcacagcagcctctgtctccctggttcaagcgattctcctgcctcagcctcctgagtagctgggattacaggcacccaccaccatgtatttttagtaaagacagggtttcaccatgttggtcaggttggtcttgaactcctgacctcaggtgatctgctcgcctcagcctcccaaagtgctgggattacagatgtgagccattacgcccggcccacagttacttttgcaccaacctaatatatacatattttttatttctacatttctatgctttctagattttcaatgtagaagtataatctattctactataagattttttaaaaaactttattaaacacaccagactcaaaaaaacaaaaacagaaacaaaaaagcatcatttctctcttccccaccttaagtgctacatccagcagaaaacttgtcaatgttattagaagcctcagttacagcttttttaaaaaaatgttttttagagacggggtctcactgtgttgcctaggctggtcttgaactcctggactcaggcgatcctcccacctcagcctcccaaagtgctgggattacaggcatgagccactgcactcagcccagttactgcttttcattcctcacgtcttatggccaccactggttaagccttcaaagtggttttttcatttggtacacgagtgcagaaggatatgaagatttacacaaaagacagtttgggtctcagcactggcccccatcagcaagctgagggctgttggacaagcccctcaggctgttgcttctgagcctcagtgttctgagttgtggaatgggccatggagatattgtcagaactggcaagagaaccaattgagaaccatctccagagagtcacaactcagagaagtcagggactcagttgacataaaacttgaacacagaggtcacaagttatacatctgatgcatctttaagattttattttatttcatttcttttttttagagatggggcttcactgtgttgcccaggctggagtgcagtggtgccaccatagctcactgtaacctcccaccttagcctccctagtagctgggaatacaggtatgcaccacaactcctggctaattttttttttttttttttttttttnnnnnnnnnnnnnnnnnnnnctcactgcaacctttgcctcccaggttcaagcgtttctcctgcctcagcatcctgagtagctgggattacaggcgcccaccaccacgctaggctaatttttgtatttttagtagagatggggtttcactatgttggccaggctggtcttgaacttctgacctcgtgatccgcccaccgcggcctcccaaagtgctggggctggtgagccaccgcgcctgacatttttttttttttttttttttttgagacaggatctcacttccatcacccaaggctggagtgcggtggtgcaatcatggctcactgcagccttgacctcccaggcctcctcctgcctcagctacctgagtagttgggaccacaggcgcgcaccaccatgcctggctaattttttttttttttgtaggtttcaccatgtttcccaggctagtcttgaactcctggactcaaaccatcctcctgcctcagcctcccaaagtgctgggattacagttttttgttttttttttaattacaaaattctttttagagacaaggtctcactatgttccccagggtggtcttgaattcctggcttcaagtgatcctcccacctcagcttcccaaagcactgggattacaggcgtgagccactgcaccctggcccacatctcatatgtcttaaaaacatgtttctccttcttataaaaagtccaggttcttgcaaaagtggcattaatatttttgattactggctggagctacaatagaattcagtgaggctggccgggcacagtggctcatgcctgtagtcccagcactttgatcacctgaagtctggagtttgagaccagcctggctaacatggtgaagccccgcctctactaaaaatacaaaaaattagccaggcattgtggcacatgcctgtaatcccagctattcaggaggctgaggcaggagaatcgcttgaaaccaggatgcggaggttgcggtgagcggagattgcaccatggcactccagcctgggcaacagagcaagactccgtctcaaaaaaatacaaaaattagctgggcatggtggtgcacaactgtaatcccagctactcgggaggctgaggcaggaaaatcgcttgaaaccaggatgcggaggttgcggtgagccgagatcacgatagtgccactgcactccagcccaggcgacagagcgagactccatcttaaaaaaaaagaattcaataggccatttacactctcttgaagatattacaaagcttccacagactattctcttcagcgaaggaaagaaaataagtctggctagttcaggcataatctgataggcaaagcatgttcctctgaaggccaggaaaataaatcagaacagcccctggcttggaggagcggtgtctagactccctgttgagtctatagttttcctttgttagacaacagtttgggccattggagcaagtcactctctgtttcagaactttgagggaattctgctccttggccgaggagatgagaaaaatgtggctgaattggtttaatttgatgattcctacctatttacgtaggaaaagctatgagaaataatgtgcccagggaccgtggagacacagccatgggaagttggaatctatgcaaatatccttgaaaaacaagcaagtaagagaactttgttgcgtgttttgggtggtttcaggtttttgtctttttattttgttaaggttgtacagacatacgggagtggggggtggagcaaaagggatagagttcaatgtctattgatgcccagtcccactttctaggggtaataaccagttttttaaatccttccacagatattctgtgtgtataataaacaaatggtagtgattgtagcatattgtaggtatgactttctacaccatgattttgtttttttttcatgtaacaacgtatcttggagatttttcacatctgttcagaatgatccacactgtgtttcacagtctttcacggtcacctctcaaagcaggcattgcatattgctttgcagtaaacaagacccagcgcctcggctgatgtattagtccattctcatgctactataaggacatacctgagatggggtagtttataaaggaaagaggtttaattgacccacagttccgcagggcttgggaggcctcgggagacttacaatcatggtggaaggggaagcaaacacatccttcttcccaaggcggtaggagagagaagaatgagagccaagggaagggggaaaccccttataaaaccatcagatcttgtgagaactaactcactgtcactagaagagtatgacagaaaccacccccatgatttaattatctccacctggtccctcccatgagatgtggggattatggggactacaattcaagatgtgatttgggtgaggacacagtcaaaccctatcatcagctgacaatggaacagtcccagcctacatggccacattccagacgcattgctgagcaatttaccgaccttttctaacacaaacgccaccaacccccaatttatgtcattctcattttacagaggaggaatctgtgccagaagtgggatccaggccgtgtgtttccacagcccaagatggtgagcatgttctgcagagtctattccactgccctcatgcgcttagaaattcacataattggcccaataattcctattccttatcttttgcccagaggccaaacactcccaggagctacagtatgccacccccgtgttccaggaggtggcaccaagagagcaaggtgagccacaggttgggataagaggtactggtgaaatgagacaggtggtccctctgatgtcattatattcaggggcttcaggagcccgttaatggggtggatgggagcaatgcaggcacactgcaaggaaccaatggcaaccagcaccccagctcctaaaaaaatctcatcaggagatggagggtgaggaagagggaaagatgtggtgggggaatgtcatagaaaaaaaacccagagaggaggatacaggatcactactcaaacatttccttccttccttccttccctctctccctccctccctctctctctttctttctttctctttctgtctctctttattttttctttttctttctttctctttctttctttctttctttcttctttctttcttttctttctctctctctctctttctttttctctttcttttctttctttcctgcctttctccttttttttgagactctcactctgttgcccaggctagagtgcagtggcacaatctcagctcactgcaccctctacctcttgggctgaagcagtcgtcccaccttagcctcctgagtagctgggactacaggtgtgcaccaccatgtctgactaattttttttttttttttggatagagacaagtatcttgctatattgcccaagctggtcttgaactcctgggctcaaccaatcttcctgcctcggcctcccaaagtgttgggattacaggcatgaggcattatgcccagctaacattttcaagaataaattatttaacacagtccaggaaaaaattagttaatacctggttctgtcaggccacccagctactagaaataggatttttaaaaacagccttgctggtcacatatcctaagtaaattattttcccttttatatttcagaagcctgtgattcttataaatctggatatgtctattctgaactcaacttctgaaatttacagaaacaaactacatctcagggtaagatgctttttatgaagctgatttccatgaacaaaaagcaaacttgaggctgaggcaggtggattacttgaggtcaggagttcgagaccagcctggccaacatggcaaaaaccccatctctactaaaaatacaaaaattagccaggtgtggtggtgtgtgtgtgtagtcccagctactcgggaggctgaggcaggagaatcacttgagcccgggaggcagaggttgcagtgagccaagatcgtgccactgcactacagcctgggcgacaagagcaagacttcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtgttaagaaaagaaaagagaaaagaagaaaagaaaagaaaaaggaaaaggaaggaaggaaggaaagagagaaaagaagagaaacaggtgaaatgaattggaataatatattttatttaacccagcatatccaaaatcctatcattttaacaagtacaactaccctatttccctcagaatgtagcattgcctctggtttgctgtggatcctgtattggaccactcagctgtagagtcctgtgggatccaagcttcaaggagacccatcatgcatgtttagggccagttccaggtgtccttgacatgacactaaacctccatttcctttgttttggagacggagtctggctctgtcgcccaggttggagtgccatggtacgaccttggctcactgcaacctccgcctcccggattaaagcgattctcctgcctcagcctctcaagtagctggcattataggcgtgtgccaccatgcccggctaatttttgtattttgtagtagagacagggttttgccatgttggccaggctggtcttcaactcctgacctcaagtgatccgcccacctcggactcccaaagtgctgggattacaggcgtgagccacctcgcctggccctccatttcctgatctagtcttatatccacgctcaccacctcagcacgctcagacccacgctgctgtgggctcctctggctcctggaagagtgcgtccgcagatgctgcagtctttgtgtggctcagcaattgccactcacatcaggaactgcctttaccctgtcaggctctactgagacccgaccctggttattaagctataggggagacaaggatggatcttaaagaagacaagcaaaatgtagtgaagcaaatagaatggtggttcctgggggatgggggcaggggacaacgaggagtgactggctaacagatacagcgtttcagtttggaaagacaaaaaagttctggaaaaaagatggaaggtggtgatggttgcacaataatatgagttttgttgttgttgttttttgagacagagtctctctctgttgcccaggctggagtgcaggggcacgatttcggctcactgcaacctctgcctcccgggttcaagcgattcttgtgcctcagcctcccaagtagctgggattacaggcacccaccaccatgcccagctaatttttgtatttttagtaaagatgaggtttcaccatgttggccaggctggtctcaaactcctgacctcaaatgattggcctgccttggcctcccaaagtgctgggattacaggcatgagctattgcgcccggcaatatgaatgaatgtttttaataccattgaattacacacctaaaattggttaaaatggtaaaaaattttatgttatgtataacttaccacaataatttaaaaaatattgtgaagcgcctgcctcatgtgaggtcttctaataagaggggctgttctccttctcaagagcgctcgcgggcattgggagtttcttattctcaaatgtccacatcccaaggcctaccccgtccctgtcagtgtcagaagttagcagagcagaactgctagatgtgctcactccatctcctccatggttggcccaccctttcgatcagatcctggaattggctttcagcacagccttccagctggctgtgataaatgagagtggcttaaaccctgtcatcagggtttcacagcttgccctgaaccgtagcctctcattttctccttgcaaatcttctaaggcagctaagagaagccaattaacttcacaatccacataattagcattgccccaaacctttcaagtgctggaatgctggcgtccactagtgcctcatttctttctaaacctcattccacatggcaggggaaggtcttaggaattgtggagctgtggcgttctaagggttctcactgcctacctatcaccagcaagggagtccttgttgccatccatccctagggggtaattttgttccctgaggctgctttctagggacttctggtcgcttgttttatcctggaccagacctgaaagcagagcctgaaataaggccttctatgcacatcatttatgtaggaggtggccctaggaagcaggcccaatgcgccatgggaaaaaccagtaccagggtgttttgctgagttgagcactgtggtgggcagctggacatgagcccactggaatcttctgaagagcccaagagcctcttctcagtattgtccacttgaggattgatagtgagaggcatttatccactggtgtccaacgctcactggttgaggatcaccccagaaagcgacacctcccccacttctagactagcatgtgggtattccaagcaggcttacctcagtgtctcaccccaggcactgcaaacaccccaggacagaaagtgaacatgtgtattgtgcaattgaagcaagacactatcagtgcaaagtgagtagaccctcagatgctgctgggtcagagggaaggcccagggatatgacacaggacacagaggtggcagatacaccacctcccaacatttcctctatcacagcaactagaacaatggcaacaataggggtgggtgtggtggctcacgcctataatcccaataccctgggaggccaaggcagaaggattgcttgagcccaggagttcaagactagcctgggcaacttggcgaaaccctgtctctacaaacatatttgtatgtgattgaacaagtagaacaatggaacggaaagtccagatgtagttctaaatatgtacaggaacttagtataggataaatatggcatcttaaatcaatggggaaaagatggattattcaacatattgtaaaaacttgagaatcacattaaaaaagttggactcctacctcattctttacaacaaaattaattctgatagatgtagtcacagaagagctagaagaatatgcaggggatttaaaaataatcttgaagtggggaggacttttataggtatgactcacaacccagaaaacataaaggattgttaaatttaattagataaatcatttaattagatgaaacatttaaaaattacatttagaaatcataaactaaatccaaagaataactaggggccgggcgcagtggctcacgtctgtaatcccatggggcaggtggatcacctgaggttgggagtttgagaccagcctgtccaacacggtgaaaccccgtctctactaaaaatacaaaaattagttggtgtggtggcacatacctgtagtccctgctactggggaggctgaggcatgagaattgcttgaacctgggaggtggaggttgcagtgagccaagatcgcgccactgcattccagcctgggcgacagagcaagactccatttcaaaaaaaaaaaaaaaaaaaaaaaaaaaaaaaagaataactagggagaaaacaccatgatgtgttgcataataacatttcagtcattcatggaccaaatataaaatggggtcccaaaaaactataataccgtgtttttactgtaccttttctatgtttagacacatttagatacacaaatacttaccattgtgctacaattgcctagtgttcagtagcatgctgtacaggtttatccctaggaagaatagactatcccacacaccctaggcgtgtagcaggctatgccatctaggtttgtgtgagtacactctatgctgttcaaacagtgacctccactgttaggtgaagcatgactgtattttgagcccaggtctcagatattgtatgaagtttcataatattatgagcttttacaaatcattaagagaaagaccaataatccagtagaaaactgggaaaaggtggcatctgcagggtaacaccagggcagcacagaaatcttgctgggatgaggagctgcaaacatgtgtggtcgactttttggccttctgcctcttctactctcagggatgggggattacaactaaagaagttgtcttttggccgggcgtggtggctcacgcctgtaatcccagcactttgggaggccgaggcgggtggatcacaaggtcaggagatcaagaccatcctggctaacacgatgaaaccccgtctctactaaaaaattcaaaaacattggccgggcgaggtggcgggcacctgtagtcccagctactcgggaggctgaggcagaagaattgtgtgaacccgggaggcggagcttgcagtgagcccagatcgcgccactgcactccagcctgggcgacagaggaaggctccgtctcaaaaaaaaaaaaaaaagaagaagttatcttttctcagtgttgcttctccctaaggatttaaaggggagacctggccagaggaatcatcaacagtggatttgtgatgactggagttcatttccttctttctcaactgtcctggaaggaaatggactagtgccttacctctgactcttccgcagcacacacccaccaccagagacagtaactgagatctgcagtagcacagaaacttacaggttagaaaaattagacacctaaggatttcatgactccagacctgtttccttagcataataccacaccagtaggagaaatacaacttacgaaatttctttgtaaataaattctataacattttgggtaaaaatttatcataaaaaaattattaaaagcaattgggttggaaggaagttctgtcaaaatacaatccaggtgtgcagttctctgataaatttagcagtggttactactgaggcagtctcaaaaaaaagtgtaaaaggactttaaggggtgatgaaaattttctacattgcctttgtggagatggttatacatttgtcaatactcatcaatttgtacatttaaaagaggtaaatttattgtatgtaaattgtatcttaataaaactgattaaaacagacatacaaaccccagaccctactgcagtgcctgaatttgagtggaaaatattggtgtgaactcataatttatttttcatttgttattattattattattttggagatggagtctcaccctgttgcccaggctggagtgcagtggcatgatcttggctcactgcaatctctgcctcccaggtccaagcaattctcctgcttcaaactcccaagtagctgggattacaggcgcctgccaccatgcccagttaatttttgtatttgtagaagaaacggggtttcaccgtgttggccaggctgatcttgaactcttgacctcaaatgatccacccacctcagtctcccaaagtgctgggattacaggcgtgagccaccgtgcccggccttattttttattttttttgagacagggtcttgctctgttgcccaggcaggagtacagtggtgtgatccaagctccctgcggctttgactccccgggctcaagccgtccacacccatcagcttcccaagtagctgggactataggcctgagccactatgactggctaattttcaaagcttttttttttagagatgtggtctatgttgcctaggctggtctcgaactccaggactcaagtgatcctcctgtctcagcctcccaaagtattgggattacaggtatgagccaccacatctggccaatttttttttcagggaggaaatacacactctcctatatttgctagctcttaatactggaaaggcctagaaacaaagactgccttctatcaatgagcattcctagtatccaaagtatggtgtccacttttttccaataaaaaaaaccccagagctccttggaatatacaatctctacagtagttattagaaggaaattatcaaagactagtaaggtgtgtcaaaaagacttgaggctggccaggcacagtggctcacacttgtaattccaacactttgggaggctgaggtgggcagatcacctgaggtcaggagttcaagaccagcctggccaatatggtgaaactttactaaaaatacaaaaaattaaccacgtgtggtagcaggcgcctgtaatcccagctactcaggaggctgaggcagggaggctttaacccgggaggcagaggttgcagtaggccaagatcgcaccactgcactccagactgtgtgacagagcaagactgtctcaagaaaaaaaaaaaaaaagacttgaggccaacttgaggttcccattggccaaagatgggacaatttgagcatcaaaaggaataattactttaaataatccagcatttatcctacctttcccatacctctaggtaagcaaatactcggtgagaagcttttcttcatagaagtactctagcaaacggccgggtgcggtggctcatgcctgtaatcccagcactttgggaggccgaggcgggcggatcacctgaggtcgggagttcaagaccagcctgaccaacatggagaaaccccatctctactaaaaatacaaaattagcagggcatggtggcgcatgcctgtaatcccagctacttggaaaggctgaagcaggagaatcacttgaacctcggaggcggaggttgcagtgagctgagtttgcgccactgtactccagcctgggcaacaagagtgaaactccaactcaaaaaaaaaaaaaaacaacaaaaaaagtactctagccaacaaagaaggaagatagaatatcaccattttgcaagctttaatgaactcaccacttgaggtattaatcaatggttgctggccaccccaaaaaagaaacaaacagacactactaccacttcctttttttttttttttttttttttgagacagcgtctcactgtgtcacccaggctggagtacaatggcgcgatcttggctcactgcaacctctgcctcctgggttcaagcgattctcctgcctcagcctcccaagtagctgggattacaggcgcccaccaccacgcccagctaattttttgtatttttagtagtttcaccatgttggccaggctggtctcaaactcctgaccgcaggtaatccacctgcctcagcctcccaaagggttgggattacaagcgtcagccactggccaactcagtgctattcttatttcatctcccaccacttaaaaaagtttgttttaaacaggagaattataaagcaagtctcaattaccataaatgtatgtatctgtcagacaaggatttttttaaaaagaaaaatataaacatactaccattatcacacccaacaaaattgtaaataattccttgatatcatgtagtgttatttttttaatgtgataatagtgtggttattaacaaaagatccttaaatatttccagattaaatggtagctgctatctgccttgaaataatattcaaggaggccaggtgaggtggttcatgcctgtaatccccatattttgggaggctgagacaggaggatcacttgagcctaggagtttgagaccagcctgggccacatagtgagaccctgtctcttaaattaataaataaatgtaaataaataaattactgatataatatggaagggtggtattagtggatgaggtgggactggccaaaggttgattgttgttggtgctagatgatcactacatagaattagtacaattatatgtctgcttttaaaattctccataataaaaaaaagcataaaataaccaaaacaaggctaggtgcagtggctcaaaattgttatcccatcattttaggaggtcaaggcaggaggactacttgaggctcggagtgaaagatcagcttagccaacatagtgagaccctgtctctacaaaaaaaattaaaattaaaataaaaaaaaaaagagaaaaacctaccaagtaaaatcaattaagtcagtcaaacttttgaaatattttacaggcactatcagttggaatttttgtcaagttggtaacaatgggatattttacacaatcatatcaacacataaaagttaaaagatttcttataaacatagatattagacaggaaacaaactacaatatatgacatctaacatatattttagttgcttttcaaaaatccgtaaatactctaagttttaaaagtttagttttaggttaatttttgatatctgacagtatagatgtggcagattccataaagaccttttccttcctggtaacaaagcccatttctgagagagtaagatactattgcagcctcaagggataaattgcgtttgatctaaatcagatcattttcattcccttggatggtgatttgcctagaaattatcatgtgatttagttctgaccaaagagatgtaaagacatctcccgactgggatgtctggaaaagtttttacttccctaatttaaaagggaagagtgttggctgactagctcttgtctctttaacttttctcctaactagaatgataattaggctggaaatacagcagccacctaagatcccgaagcaacaatgataaacaccagcgtactaaacatggcagaacagaagggaagtgcctgggtccctaactatagaaacagtaatactagctttggacagtctacccgctagagttcttgtatgtaagaaaaacaaaccccaatttgcttaatccagtatagtagatttttgtttcttgtagctgaacatattcctgatacaatgaaagacataaaaaatataaacactgaatgaaagcaagcaccacaaatgtccactttataagtgcaaaggggctagaaataaatctaagtgaacataagacaaccaaattaggagagaagaatatttattatacaaatataaaaatctatacattcttagctgatgatatatacttaatcaaaaagtcttttaatttggatatatgcatcatttccttcattgtggtgtctctgcttctcagatgtattaatccattctccaaagtagtttcagtaaccaaaactgtgaagagaatactcatttcatcatacctaagaaaaaagtagttaaacagacacatgagcacaaatgtaaataataaattcctccacgttgccagctgtaattcagtgttcatgcactctcaagagtcacagactcagggcttaagggtggaccaaaaaaacccaacatttttaaagtttctgaattgtatttaaagtaatattttcagacagtttctaacttattgctagagctgaaaagtcataaaagaaaataaaatctgagaataaacactggtacctcaacacatcatttggggtgatatcacagaagaaccgcataataacctcagccttttggttcttggatgcaatccaagaacaattattttagactgaagtctcttacaataaacaatattataataaagatgcaatttggtataacaaattataccaaaatcatgtttcctttattgagtagctagcttatagcttctagttcagcaataaccaaacagatagatgcacggctgaccttctgtatgcttaccaagtcacactatctcattactgtttatttcctttgtaggactccatcagaaactttttatttctctgtttatttattgtctattttgtcctactagaatataagcttaacaagaatagtatggctgggcgtggtgactcatgcctgtaatcccagcactttgggaggctgagatgggcggatcatgaggtcaggagttcgagaccagcctggccaacatagtgaaaccccatctctaccaaaactacaaaaaattagctgggcgtggtggcaggcgcatgtaatcccagctactcgggaggctgaggcaggagaatcgcttgaacacgggaggcagaggttgcactaagccgagatcacgccattgcaccagcccgggcgacagtgcgagactctgtcttaaaaaaaaagaatgatacatttttctgtgttgttcaccactatagcaaagtgaataaaacatagtacgtgtttaataataatttcataaaaatatcctgggacaataaaacctttaccatataaagaacaactgcaacttgacaatgtccacatggctcaaaggataagaattgagaacctgagaggacaagaaagttcaagtgctgccccttcattttacacataataaaaccattagatgctctaattatagaaaactacttttctttggacatcatctgaaaggtgttttttttttttttttttgagaaggagtctcgctctgtcacccaggatggagtgcagtggcttgatctcagctcactgcaacctccgcctcctgggttcaagcaattctcctgcctcagcctcccaagtagctaggactacaggcacaagccaccatggccaggtaattttttgtatttttagtagagacggggttttgctatgttggccaggctggtcttgaactcctgacctcaggtgatctgcccgcctcaacctcccaaagtgctgggattacaggtgtgagccactgcgcccagcctggaaggtgtattttaacaaatgttcagagaactgaagatcaaaacacaatggttcacaacttttcacccaaaagatacatattcaacacaaaaagcttaaaaaaaataacaagaatggattatttaaaaacaacaattaatgaaatagcatggggtgagactagacacagagagctcaattaggagatgatttcaataatccaggcaagagatattggtgactctaacttgggtagtggcagcgaagacagagatggatgagatacatttaggaagcaagctgacagcatttgatgatagactggatgtagagaatgaggaagagggaggagttaaggatgatagccagtttctctgtcttgagcaattgggtgaacagaggtgccaatcccttagaagactagaacagaccatccctccagaatagaattcccttccactcagtctcagaatggaccacaatgccagcaaagaaaggcattccactcatattccttcagtcttgattcaacacatgctctctacatacatactttcatccataagtggataagctgaggtatacatacttcatgacattaagtcttggaactacatacagcatgtgctcaaacatacttgctgaatactgttccctgctgaggcaattaactaaatgcacatagttctgtaaaagggaaactgaggaataatttaaaattatattttatatataaatttagaagagatttgtttctgtaattcataaacataatcaaaaactcttgaataaatacactctttaatgaaaatacaattcttacttcgaataaagttgttccaatgaggactgcatagtttccaaataaccaggccacacagaaatcccattttctagtaactcattaaatagcccttgacaaacctagaaagaaatagaaaaacttcaaatatgaaagaaataatggtagctagagtgattattctatttttgtgaagccacaaatcaccctcttcaatctctaaaatgggtatgtttctttaattatgtgatgttaatgtttataacttccatatcatatactttataaatcgtatacttcttctgaaaatgaagtaattaagcatagcaaagctgaatactaaatgccaatcttctgagaaatttgtatatcaaataagaatttttattacccttagtatcattcaaaacacaaacaaaaccaaaacagattctgtcagaaaaaaaccaggagatccaaagggctgtatgaactcagagccctcatctgagaggtgagacctgagccctaggttataccaccaagtcaggaagaggcagaagagccaggaaagaaaaaggatgagaaaaaggagagtggtattccagaagcaaaccccggaaaatgtttcaagaagagactgatcaacccatttcactggaatgctggagacaaaagcttgactggaaatacagaagtaacgatgaataaatgacacagtaaacttaactgttttctttacaagcaatagggaagcaaaacaaagcaaaatttaaaaaccccttaacagtctagcaccaacagtccagagcagggttcctcacccttgcactgctgacccagggtgtttagcagcattcctggcctccaggagaggcctgcagcaccctcccactcttaggacaaccacaaatctctccagacattactaaatggtgactgagctacagcatcctaggagcttcctagcttataagggtattagggaggctgccataccctgggagaaaatgtgggacatacgccattatcttctccttctttgagctcactatctcccatcttcccagacctctccacaaaagccagggtcagaaagctgggggactctcaaagtctttaaatctttttagtgtccgcattcaggtctgggctgggtctcaatcacccagacagaaatgacgactgctgaaggagtctctggaacgaaatgaaagccatcccccatggcctttcttaagagtatttaatcattagaacaaattagaaaaatcaaaataaaattatagatctagaatatctgaatatagtcagttaccaaaagtgttaagttcaaaggggaaaggctgcgcacggtggctcacgcctgtaatcccagcacgttgggaggccgaggtgggcggatcacttgaggtcaggagttggagaccagcctggccaacatggtgaaaccctgtctctactaaaaatactaaaaaattagccaggtgtggcggtgtgtacctgtaatcccatctactagggaggctgaggcaggagaattgcttgaacctgggaggcagaggttgcagtgagccgagatcgtgccactgcactccagcctgggtaacagagcaagactccgtctcaaaataaataaataaataaataaaaagttcaaaggggaaagaaataagtcacattcactaacatgtgtacaaatattttaattactatgtctactcactaaaaagtgaaactatgaatgggcatgaacagcaaacccaatgaactgtattcagcttctttaacacacttcaaaattatatataatcacagtacttacccacagttcattatttaattaaagctttttttttttttttttttttttctgaagcagggtcttgctctgtcacccaggctggagtgcagtgctgcgatctcggctcactgcaacctccacctcccaggttcaagtgattcttgtgccttagcctcctgaatagctggaattacaggcacataccattatgctcggctaatttttgtattttcagtagagaccaggttttgccatattggccaggcaaattaaaaacttttttttttttttttgagacggagtctctgtcgcccaggctggagtgcagtggtgctatctcagctcactgcaacctctgcctcctaggttcaagtgattctcctgccttagcctcctgagtatctgggactacaggtgcgtgccaccacgcccagctaatttttgtatttttagtagatggggtttcaccatattggccaggatggtctcgatctcttgacctcgtgatccacccgctttggcctcccaaagtgctgggattacaggcgtgagccaccacgcccgacctaaaacattttaaaaagcaaatgaatcaaaataaaattttaaatggcaagctatcaagtttacttagagtaagggttaggttgagcatccctaatcagaaaatccgaaatccaaaatgctccaaaacctgaaaccttgagttcaaaggaaatgctcatcagaacatttaagattttggatttttggattagagatgcaaatataccaaaaaaatccgagatccaaaatggtcctggtccaaagcgtttttggataatactcaatctgtaattaaaatgacatttaaactcatttaactcacctgtcttagttccaatgtggggcctcttcctacatccaaagcaaccttaataggggctaaacaagggtgaagtttaagtacctaaggcaattaaatgggggagggagaagacaggaaaggggaaaaagcatagtttgtttaaatataacacaagtttaaatataacacaagtattaacaaacagtttcttaacagttataattttctgtgtgaaaacagaagttagctgaggtcataaaaacaccatgtagtaacatattcagctgccccccagatttctccacttagatgtttggcagaaagaaattaatttggccaggcatggtggtacatgcctataattccagcactttgggaggctgaggcaggtggattccttgagctcaggagtttgagaccagcctgggcaacacggtgaaaacttctctctaccaaaaaaatacaaaaaaattagctaggtatggcgcatacctgtagtcccagctactcaggcggctgaggtgggaagaatgcttgacccgggaggtcaaggctgcagtgagccaagatcgtgccactgcactctagtctgggcgacagagtgagatcctgtctcaaaaaaaaaaaaaaacaaattaacttgagaccctcccattttctgacaactccctcagtcaaaatgcttctttcagcatcactttggaccctaccagcctgggccacgtggcttaccatttcaactttctctctcttgtcaaaacctactgttcttctctttttatatatatttttttgaatgaaaaaaatttttaaatgaaatttgctttttttttttttttaaagggtctggctctgttgcccaggctagaatgctccactcactgcctcactgcaacccccacctctgggctcaagccatcctcccacttcagcctcctaagtagcagggactacaggtgcacgccaccacgcccagctagttttagtatttttttgtagagatgaagttttgccatgttgcccagacagactggtctcgaactcctgacctgaatgatccacccaccttggcttcccaaagtgctgggattataggcgtgagccattcagcccagccttctcttctcattcattagtccatccaacaaacattttaatgcctctgataccaggaacagttccaggtgctaggggtaaaaatctccgtctctcgtggcagggagaaacagacaataaaaataagtaaataatatatgtgaaggtggtaggtgctaaaaaaggaagaagatggaacatgctggcaagaggcaggctgggggaggttttcagcaactttaaggtggtcagaaaaggttctctccctatggtgacacttgagcaaacactcgaaagaaggtggggggacgagacatggatgatgaagaaagagcactctaggcaatggggaatacaaatgacagggctctgagctggcagcatctccagcatgttctagaaatagcaaggtcagtgctgctggagcagactgagtgaggtggagaacagcagatcaaaaagagggcttcggtttttcctgagtgagatgagaagctttcctggagtgttctgagcaaaggagcaacacaacatgcaccttttaacagggccactctatcaggggaggaggagtggcggtggcttatagcagggtggtagcagtagacaggctaggaagtggtcagactcaggatacgttttgaagttagagtcaaacaggatttgctgatggtttggaagtggagtgtaagaaaaagaaaggattcctttttttgttagctacaaaccatttataaaccccattccccagaataattctataatcagacttctctatggttatagcaggctaaatgaacactgtataataaatcacttaactaagaagagtggtttcctacaaactcatggttcccaatcccagctgaacactcaacattatttgttaaaacttttgatttggggcagcttccttttatgttcaaagggtatatgactattccccactcgtgccatttaaacccccactcttccacatttaaactaatagtgcctcctaactccctgagaaaatagagggcatcagtaaaatgtccttcaaagaccaaaaagcccagtagcctttttatatctcactatcctttttcttcttccctgctgtttcaaatatctccttttcaagatacattcttctacttgggctcttgatcccatcctgacccctccggtttccttcatcttgccccattaatcatttcttttctctcctataacttcaacttctcctctcgattttctttgacccataaacatgctccaagtgcatgttcatgcactaaaatcagcctttccaggcccacatctagctcctctgatccaggaaccagccatgtggcacaagaccagaagccagacacctggggcagagaggtcaatagcacaggtctccctgatccgggtctttcttcctcctatgtaccaatgcttcagcttctgatacaaatggaagcccacagtggaaaggttcaggggctaggagtcatagagatagctgtctgttcacaattaaacagaaatgcctttgggattacttattagggatgccttgttctattctgtgagaacctgattcttattcctgtggccagattctaaaaaaactgaaaaatacttagactacatgcactaaatttattatttagagtttatgttagaaaccgagcacactaacattaagaacaaacaaacccatatttttagtttcccaagtctatctctgaaatatcaacagcacctttctatgaagatttttctttcttgtaaaggagttctctgtcagctggaaagaatcatagaggtaggccagcatgcctcggtctaggtccccatttacagagagaacacaaggaaccacattttttcgtccatctcggcccttcacagaaaaacagaagaaaaataatcatttcacagaactttttttgtttgtttgtttttgagacggagtctcactctgtcacctggccaggctggagtgcagtggcatgatctcagctccctgcaacctctgcctcccaggttcaagtgattctcctgcctcagcctcctgagtacatattttagacttacacaatcagaatacaaaagtaaagtttcattttacaaagcacccactctgtaccaggcctgtggtaggcactgggcccacgaagacgataaagatgcattctctgctctcactgagctcagtgtttcatcagcgaggcccaaatgtgaattttaaaactatggtgcttggttgggctctatcccagagattctgaacgaactcaactggagagggacttaggcatcaattttttcaatagccctacagactatttctttaatgcttccgagctcagagttagtattcagaaaggtaacactttttttttttttaatacagacagagtctcgctctgtcacccaggctggagtgcaatggcatgatctcacctcattgccaacctctgccacccgggttcaagtgattctcttgcctcagtctcctgagtagctaggactacaggcacacaccaccatgtctggctaatttttttctatttttagtagggacggggtttcaccatgttggccaggttgttctcaaactcctcacctcaggtgatcagcccacctcagcctcccaaagtgctgggattacaggcgtgagccactgcgccctacctcgaaaggtaacacttttaagtaaaaattgtttgctgattattcaaaagaggccttagggaaaaaaatggtgtgctttagggaaaggggtttggagtataattttctgaaacgtaaagttattttcataaaaaagaaatctttcaaaaacttactttttgcattaaagccataattatgaaaacaaactacacatagtacatgatatgaattaagtattgataaacagacttacttcttctctaaactgaagaggaatcatttcaaacttcttaaaaatttcaatcctagaaatttcttaagttttggataaaaacagttccactttcatctttctttttttgtaaatcattgttcacctggatattcatgtaatttttaaaaatacttaaataaccacctttagctagagtcacagaacaaaaaaaaaagagagaaaaccccacaaatttaaatcctcagcttctgttaattattcatgatcaaccacagtcttcattaatacatatatgtactgacattttaaacctatttgaattgcatatgatactttaaagattcacaagaatttgccctcaaaggcagtaaactttctgatacctgggactctattctaccagttgtatttcacacagttatcgtcgaactgatagttaataagataaactgggctgggagcagtggctcatgcctgtaatcccagcacatcgggaggccatggtggacgaatcacttgagttcaggagttcgagaccagcctggccaacatggtaaaaccccacctctactaaaaagacaaaaattagctgggcatggtggtgcatgcttgtaatcccagctactcagcaggctgaggcatgagaatcacttgaacccaggaggtggaggctgcagtgagcagacattgtgccactatactccagcctgggtgacagagtgagacaccatctcaaaaaaaaaaaaaaaaaaaaaaagacaaactcaagtactgaaagattctgtggtgcgctttgaatcaaacaaaatctaaatctgaatctttatgaagaatgctttaggctgggcacagtgactcactcctgtaatcctagcactttgggaggccagggcaggaggatcacttgagcccaggagtttgagactagcctgggcaacatggcaagatcccatccctatttaaaacaaacaaaaaagattgtttattgttttctaattttttgaaaattggatatccaacaatgtcaggatatctggtggcaactcttccaacaatatctgatttctcacactatccagaataaattcttttctatcctaactgttcttcagcctttattggtctgcttcactgttctctaaaaaatatatttggacattaaccataaaatcaactaaaaacagatacaaaatggcctaagaggctgggtgcagtggtttacgcctataatcccagcactttgggaggctaaggcaggaggattgcttgagcccaggagttcaagaccagcctgagcaacacagcgagaccccatctctattaaataattttaaaaaaagaaagaaatggcctcagaaacatttcaagaaagcatactaaatgacagaaattctacttaatattttataacatgttcaactaatgataaataattttgtgaactctggaaacagaaaaggaacaatgtcatggaagagaaaaatttctgcaataggaaaactcttcattagtgaaaatgataccaataaaagaacaaaataatctgggcatggtagttcacacctgtaatcttagcactcagaaaggcagaggcaggagaacagcttgagcccaggaattcaagaccagactgggcaacatagcgagaccccattcttcatacaaaagaaaaaaaagaacaaaataagacactaatagccacaatacaaaaatcatctttaaatccctagtcacaaggttgagctgttcgttaactatgataataaccaataagtttcatttgagagctgagtaccccaaaatgaagtgtgatggtggtggagttaaaggaaaatgttcaccagttaataagccttctagtttttcattagttattcatatttaaaaattccagcctggtcaatatggtgaaaccctgtctctactaaaaatacaaaaattaaccgggcgtggtggcgcacacctatagtcctagctactcaggaggctgaggcagaagaactgcttgaacctgggaatcgcgacactgcactccagcctgggcaacagagtgagatgctgtctcaaaaaataaaaaaataaaaattaatctactttctactcattatatataaactcctatgtttttgctatatattttttctttttctttttttttttttttgagacatggtctcatcctgttgcacaggctggagtgcagcagcacagtcttggctcactgatgatcctggaacaatatattgctacaaaaggtaaggaagtgctcgtcaagacaatgatggaaatatgtcaaaaggacactggccaagtctaggacaatttgaccatcaaaataaataatgacagtaacacactgtaaccccctgagaaagtaatctgtgaaataccaatttaaaaaaaaaatggaggagaaggaaaagctctacagtatattgctgaccagtaaatctagaaggaatgatggaatttgtttttttttaaaaaaaaaaaaaagggaaggggaaaaaaacaccattggcaaacctcatcgtagtaactgatttgagcaagaatcatcaagggatgctgcaaccagtaaggcaaaatttggtgacatggccaaacatggtgactcattcttataatccaagcattttgggaggctgaggcagggggattgtttcatcccaggagttcgagaccagcccgggcaacaaagctagaccccgtctctacaaatattaaaccatcagtcgggcatggtgatacatgcttgtagtcctagctacttgggaggctgaggcaggattgcttgagctcaagagtttgaggttgcagtgagctatcaccataccactgtgtttcagcctgagtgatagagtgagatcctgtctcaaataaagaaaaaaaaaaatcaccatttggcaaacctcacattagtaactgatctgggcaagaatcatcaatggatgctgcaaccagtaaggcaaaatttggtgacaaagaaattgtctgcatcatcttaaagtatctgcccacaacacttattaattactagttaatttttttgttttttttttttgagacagagtctcgttctgtcgccaggctgcagtgcagtggcacgatcttggctcatcgcaacctccacctcccgggttcaagcgattctcctgcctcagcctcccaagtagctgagactataagggcaagccaccacatccagctaatttttgtatttttagtagagatggggtttcaccacattggccaggatggtctcaatctcttgacctcatgatcctcccacttcggcctcacaaagtgctgggattacaggcgtgagccactgcgcctggccgttaattaataaatacaaactatttattagctttacactggagaaatctagtagaaaccatcttaactaaatgataaaagttaacatcaccagtaacactcctcatatgacacactgagaagagagcttctcagtactaccacttctgtagtactcccgacaaaaatacataaatcacgtggaaacagcagacagatcccagccaaggcatattctacagattaactagactgtactcttcaaaaatgtcaaggtcacgcaagacaagaggaattgttcatttgaaggagtgtaaaggcatatgacaactacatgaaagacaagatcttggacctataaatgccattattgagataatcagttcaatttgtagggctctgtggcaatagtggattactgttaatttcctgattttgatgactggattgtagttatgtaggtgagtgtctctgcatctgaaaaatacacaatgaagtgttaagacaccacgtttgcaccttattctcaaatggttcggaaatgattatagagaatctgggtaaaaaatacataggagctccaggtaaaacatacatgtaatttagacacattgccaggatacatgtgtaaaagttcgtgatctcctaggttccacagggtttctattaactcctttccccagggaaaattgtagtaaagtttgtttcctttccggccttcttcatcctgacagtcactgctgctgaagttagatggactcatggcaaactggaaaagaaaatttaagtttgtcttaacatatttaaataaacactaatttaactcccataattatctgtaagaatttaaattgtccgatactttttattcagcaaatgtgcgaaactagtcaagtcccgaatacaaattttaaagtttattctaatttacatttttttttgagatgtgtctcattctgttgcccaggttagagtgcagtggctagtcacaggtacaatcatagctcactgctgcctcctactgctggcctcaagcaatcctcctgcctcaggattcagagtagctgggaccacaggttgctgaaatttaatttttaaaaagtgaaaatactggccaggcacagtggctcacgcctgttatgccagctctttgggaggctgaggcagggggatcacttgagcttaggacttcgagaccagcctgggtaacagagcaagacttcatctctacaaataataaaagaagttgcagtgagctgtgattgtgcaacggcagtccagcccgggcaaaagagtgagactatgtctctaaaaaaaccaagatggagtcagttgtaccagtgaaggacaagaaacttctggaggtcaaactaggggagctgccaagctggatcttgatgtgggacttcagccctagtggccttgatggagcgtttcaaagaggttactactggtactacaacaagtacatcaacgtgaagaaggggagcatctcggggtttaccatggtgctggcagggtacatgctcttcatctactgcctttcctacaaggagctcaagcacgagcggctatgcaagtaccactgaagaagacatgctctgcactcccccagcaaccttcttggctgcaacccctccataagcaacacaatctcgattgttgctgaatcctttcatatcctaatgggaattaacctccaaataaaagatgactggtacttgtgaaaaaaaaaaaacaaaaaaaaaaccaaaaacagacaacaaaaataaaataaaataaaaagtgaaaatactgagtatattgcttaacatattgttttttagtaggaaagaactacagagaaaaaactgttgatgttatccagacttttatggccaatgaagaggggaagttaaccatgactaaagtgggataaagaagaaagtatcacatagtcctcattcttacccttctgcgaagttcttgatgactcgtgattatttcatacagtttaaatgggtatttggggatgtttgagtcgggaaatggtaacataacacatggcaagacaaaaatgcttacttcaactctttttttttcagtgagtactaaaacttgatcatcaattacagagccattttgactaatatggaaagttcatggaggtaggtagcaaaagctgaagctgtgacaatggtcaagggtcaaactctacatcagccaggaatgctaggtgagggctttgaattttaccttacacagaaaggctaattaacaaacacatctgagcccaacaaatgtttttaccaaagtaactttgtaatctagaacaatgaaaattgttacaaagagtttttgtatttgtataatatattaatagctacatacatcaaatataatttcttgtatgtcagaagaattaccactgacacattaagacaatttatgtattaactattaaattaaaggtaattattgcagtacctttctccaccactggagtcgatgacgtaaccagaaatcaagccactggtttgaagttctcggaggagtaaaccatactaacgaagcttcagtcttctcaccaatactttagatataaaacgtatcaggaagttagcttatctgaaaattatataatttatcccaagtggaaatgactggtttttgactatttaaatacaaggccaagttatttgccactttttataccttttaacaccatttcgtatctgcttagtgtcaaaaacaggatgaaaacacactccaatctgagcaaggccataaggtagcctcttgtttacca

SEQ ID NO: 15149 - DNA, 20942 bp, Human
tctaccttattcacctgagcttggcaccatgcctggcacaacacaggtgctcactaaatgcgaatgcacatggtggagcagtttataggggtagaggagctaacaagtggagactgggacgtgtggaggtcagaagtggtgagaaatacaggtctggctcccataaatgctgccttgatcctcctgctataccaggaggctatgctttggaagcagggactgcgctttgatttgatatgcaatcccaaaccaaagtcaagatgtggcttttaaagcagaacatcagttcttatggtgatgagcaagaaatagcttttgactgacaatttgttttgtttaatgatgagaataattagtatacaaataataataacagctaatattgagtgtttaattcaggcactattgttggcactttagccaatttcatcttcctaacaacgctttcattagtagggtactagtagaaggtactatgatcatccccatcagggccagcttcctgggcatgtgtgtgatctatgcagtcgcagagggccccacacttagaataaaagagtgtgtgattggcttaatgctctgctgtctcatcttgaaattctttttttttttttttgagatagggtctcatgctggagtatatgatatgatctcgactcacttcaacctctgcctcccgagctcaagcaatcctcccacctcagcctcccgagcagctgggaccacaggcatgagccaccatgcatggctaattttaatttttttttttggtagagatgaggtttcaccatgttgcccaggctggtgtcaaactcctgagctcaagctattcatctgcctcggcctcccaaagtgctgggattacaggcgccaccgcgcctagcctcatcttgaaattctttttttttgagatagggtctcgctctgtcgcccactcttgagtgcaatggcgtgatcttggttcactgcaacctccgcctcctgggttcaagcaactctcctgtctcagcctcccgagtagttgggattacaggcacatggcaccacgcctggctaattttttgtatttttagtagagatggggtttcaccatgttgcccaggctggtctcgaactcctgagctcagatgatccacccaccttggcctcccaaagtgctaggattacaggtgtgagccactgtgtctggccgaaattcttaatactgttcaaacaagggccctgcattttcattttgtacatttcacaaattatgtagctagtcttgatctccattttatttatttaattttattttatttgtgtgtgcgtgtgagatggagtcgctctctgttgcccaggctggagtgcagtggcgtgaccttggttcactgcaacctctgcttcctggattcaagcgattctcctgcctcagcctcccgaacagctgagattacaggcactcgccatcatgcccagctaatttttgtatttttgtagagacggggcttcatcatgttggccaggctggtcttgaactcctgacctcaggtgatccacccgcctcagcctcccaaggtactggggttacaggcgtgagccaccgcgcccggcctatttatttgttttttaaatcaatgaatgttttcttaattctgattccttttatcatgtgctttcttaaacaaagaactttcacataaattatcttataataagagtttctttctgattcagtttaaaaatgacaatagcattcgttgtgcccaagttagaattataccaaaattaccatatgccagcacatacaatcattccactggtggctggaaaattagcttacgggagtgtctgtcactcagatgggccatcacccctggtgggcacatggtggagataagggaaggccagactagaagaaagctgggtcttttggatcgtttctactcctttttcacttcttcaccattctccccactgagcttgaacaagggaatctgctggccatccttgggctctaggaagacctcatcaaggtgccacctctgaaaggggcacttctggatgagctgacatggagatggccctctgacttggatccagagctaggaatcttcaacttggcatcagcaatgtccacaaagttgtgcttggtgagtttgagacagtgaatgttgagaagagggcccagagctccctgtgccttgggatggctatgcacctgctccaatgccaactggtaatacaaagccctggaaaaagtcttttgtatgcggtaatacacaagggccaagcccccagtaccgaacacattgccgaaaaggaccattttttccttgaggcactggcatcctgctgcctggatacttttgccacctcacagcacaactctcttgaaaatcatcaaaggcaagttgttctgtaagcgacagaagcaccatgctgcagagagcatgaggagcccttccgggcgtgggatggtggcggtaaatcttgatctccattttaaagaaaactaaggaattactgaattaagtatgacagataagaagtggccactgcttagtaattccttagtggaaatgcccacaatggggactggatcccatgcagtctgttcccagagccactcttcccgctccaccacactgtgcttcagagcagaaaacataccacctgccgtcctgcatctgcccttcatctgtccactagactataagttccctgaggacaggaacataccatcagtgtacatacctttcatgctctacacagtgcccagcatagcataggtgcttaatgaatacttgttgaatgaataacccaatctatataaaagtaaggaatggtatagcaacaaagaaggatttccacaaacaagaaaattcacccttggccaggtgcggtggctcacgcctgtaatcacagcactttgggaggctgagacaggcggatcactttaggtcaggagtttgagaccagcctggccaatatggtgaaactccattactactaaaaatacaaaaattagccatgcgtgatggcacacgcctgtagtcccagctactcaggaggctgatgcaagagaatcgcttgaacctgggaggaggaggtcgcagtgtgccaagatcgcaccactgcactccagactggacaacagagctagactgtctcaaaagaaaaaaaaaaagaaagaaaaagaaaaaagagaattgaccctcatgacctttgatctagagtaaatcatcatacatgagacgaagaaattggataccatgttctaaaagtaagccgacttgtttttctttgattacctttcctggctcatgtatcttagagctgtcttttatgaccccaattttaaaatgctattgttatcttcgtttaggtaagggtttcaaaccaatgatcaaataaaaggtctcaaccaagaaatatagcacattactgttaaacattaccagaaaacatttttgctcattgcttttattaatcttattacagaatataaatttttcacaggtgtgttcttcatcataaaaacagctgccatttattgaagactattatatgcagttcctactctaagtgtttttcttggattattccatttaatcttcacaataaccctctgagtcaggtctagttcatgccccattttcagaggaggaaaaaagggacaaagtggtcaagtaacctgtccaagggtgacatacctagaaagtagcagtttggacaatacaagcctgtctctcaaaagcctcttgatataaagacattgatttctaatttaaaattatctttgaattaaatcaaagagaatacatgttgatgtttctgagataaaggtgacaaaaaaatatagtttacacattgctaaccgcagatcctaatcttgactaagttacacaggacccactctttataaacacatcaatctaaatttaaaaatcaaggctgggcgcggtggctcacgcctgtaatcccagcacttcaggaggccgaggcgggtggatcacttgaggccaggagtttgagaccagagtgactgacatggtgaaacctcgtctctactaaaaatataaaaattacttgagtgtagtggtggatgcctgtaatcctggcgactcaggaggctgaggcagaattgctcaaacccaggaggcagaggttgcagtgagctgagatcgcaccactgcactccagcctgggcgacagagcaaggctctgtctcaaaaaaattaaaattaaaacgttaaaaaaaaaaaaaagaacattaaggccagcatggtggctcatgcctgtaatcctagcactctgggaggccaaggcaggaggaggcaggaggactgcttgagcccaggaatttgacaccagcacgggcaacatagcaagaccctgtctctacaaaaattaattaattaattaattaataataacaattagctgggcgtggtggtacagccctgtggtgtcagcctcatcaggaggctgggaaggaaggatggcttgggctgggtaggtcaaggctgcagtgagctaggatcaaggcactacacttcagcctgggtgacggggtgagaccctgtctctaaaaaaataaataaataaaaatgtgaaaatcaagagaacagtaaagaaacgggcactggagaattcctggagcctttctcttaactttcccacatccatcagacatcacctccaataaactgtttccttcctcacctaggctggaaaaaatatgggctcccctgtaccatcaagacttaaaaccaacagaaacacctattttgtaacactcgggaactttctatgccagcatatcgaggttcaataacagctgttcccttcgggaagtgacagtgggaaccagacaaaactcgtgtcacaggaggggcggggagagcccacgctgacgcgacagccctttgcactctccaagtccctctccgacccgacgtgtcaccttagccccctgcgtcaccccaacgcctccagccagctgcgcaaagctgtaaaagttccagggagagaacagcctctggagacaaaaaaaaaaaggaaacctccatctccaaagagaaccgaggagagggaggaggctgtggtgagcctccctggccaaagcgacaaaagctggaagccaaagcgtagactactcggcaactttatcagaagagaaactgaggcaggcaccgcaaggcccgaggagccaagccggctccaacaggcggggtcgagctccagggtggcgctgggggagccgcgctttccccgcatccggcgccagcagccggggtttccgagccgggagctccctcctcgcagcgcccccgaggatgcccccgcccccgcctccgctcagagccgccggtgctcgccccccgccccaagagctcgccggggggtgtgcccgcgccgccgcccccgggaacgctccccggctcgcgtgaggacccccgcgctgcggcctcccgcccgggcctctcagctgcccggccccgcccgccccggcccggccaggctgccgcggccccacagtgcgacgtgtcacaggccgcgccggccccgcctcccaagccacgggcactggcgcccgcggggcctcccgccggttcccgcagggatgccaggcaggcccgcactcgcccgcggccgctaccttgttagtgggcaccgagcggaggcgcttgaagatggtcaagatgtcctgcttgctggggtcccccatcgtcagctgtgagccgcggcgcagctggcccagccaaccggtaagagtcgacgaaaagcggctaccgcctcagcaggagcgacgaggccgcgggggcggggctgcgcgtaacggtcaggctccgccccaatccccgcccacgaccgggcccgtccaccgccggggcgcaggcgccgctcgctttccctccccgccctcgcttcagccgcgccgctggcccgaccccaggcgctgcacgcgcgtgcgcaggaggctcgcgcgccatttgcggcgcggctccacgcccttagcgctgggcgaagccgggcccgggtgtggctgcctgccacgcgcgctgccataggatccaccaacgtttcgcctggtcgatcgccatttcgcctaacgggctgcttccatggaaaggtcagaggcaggggaaggggcgcacgcgccttccttcggcacgagacggacggagggcccgtgccttgacgccggaccttagctggtggccttccctttttttttttttttttttgagacggagcctcgctctgtcccccaggctggagtgtaatggcgcgattgcggctccttgcaacctccctggttcaagcgattctcctgcctcagcctcccgagtaggtgggattacaggcgtacatcaccacgcccggctaatttttgtatttttagtagagaccagggtttcaccatgttgcccaggctggtctcgaactcctgacttcaggtgatccacccacttcggccttccaaattgctgggattacagacgtgagccgccgcgcccgactctttttaattcttgccctcagctcacgccaggccctgggtggaaagctttctttgcccggaaactggctttctgaaaccaagggcttttgtgtcacgttcatggagagatggcagtgcgggttgaggcagaagtgctcagtcagaactgatgagtccagatgagaagcttgacttttaaccccggccctcggggctgcaccctaccctctgggaaacaattccagccagaagagtttacactcagcagaaggtgcctctgtcaccacaatgggtgtggagccactggaaagaggttgggtgatagtgaggaaggacagcaggttttggcatcaaaggcactaccttggcctcaatcccagttcagccagctgcttcctagctctgtggccttggtcaagacacttaccttctctaaagcatggtttatttgcagtctcaggggctcatgcctgtgatcccagcactttgggaggctgaggcgggaggatcacttgagctcaggagttcaagaccagactggataatatggtgaaaccccgtctctataaaaaaatgcaaaaattagccgggcatgctggcatgggcctgtagtcctagctacttgggaggctgaggtgggaggatcgctttagtccaggaggtcgaggctgcagtgagccaagatcgcaccactgcactccagcatgggcgacagaccaagaccctgtctcaaaaagtaaaataaaataaaccatggtttattcatctgtacaaagaaattaaagaatcagtgctgagtagcacaggtgagcagcttcctagggatatcctgaagagcctttggtggaggctttctactgttagaagtcaggaaatgtacactccacctatctgcttggagaccctcggtggcagttgggagcttgcagacaatgtaacttataaacccaaagctgcaacttttccaagaaagggaaattgattatcttccagaaaagtacattacttttgcaggtagctctgatggtttaaaagttcttcctgtattgagtcgaagtataacacctgtgctttgtgtccaccgggtactagtttggccttatgcagaataccgggcatgtttatgagcagttttatccttcctgatgggaatgggaatgatggtcccatttactacttggagctgaaatcttactaagttatattatcagagtagtgcagtctagcccattctccaccatagagattgaggagagggaaacaaaagcagtaaattatagacagtatctacacgaataggggaggaaggggtaggaggtaccatttatacactatggttgcttaagtgttcttcatagaacttagcatctaatactataacatataatattctatctatatgttatctggctctaattgaatacaaaaatatatatttctggccgggggcggtgcctcacacctgtaatcccagcactttgggaagctgaggtgggtggatcatgaggtcaggagttcgagaccagcctgaccaacatggtgaaaccccatctctactaaaaatacaaaaattagccaggcatggtggtgggcacctgtaatcccaactactcagaggctgaggcaggagaatcgcttgaatctgggaagcagaggttgcagtgagccgagatcacaccactgcactccagcctaggcgacagagcgggactctgtctcaaaaaaaaaaaaaaaaaatatatatatatatatatatatatatatatatatatatttcttgaaatcaaatgttttttctcctttttcttttgaggagtctcgccggagtgcagtggtgtgatcctgacgcactgcaacctctgcctcccaggttcagccgagtctcctgcctcagcctcctgagtagctgggattataggcgcccgcaaccatgcctggctaatttttttttttttttttttttttgagatggagtttcactcttgtcatccaggtggagtgccatggcgtgatctcggctcactgcaacctctgcctcccaaggttcaagcgactctcctgcctcatcctcccgagtagctgggattacaggcgcatgccaccacacgtggctaatttttatatttttagtagagacggagtttcaccatgttgtccaggctggtctcgaactcctgacctcaggtggtctgcccacctcagcctcccaaagagctgggattacaggcgtgagccacagcacccggccaatacactatggttgtcttatctgtcagttgcttaagtgtttttcatagaacttattggcatctaatattatgatatataatattctatctatctgtatctgcctctcctcaattgaatataaatctcttgaaatcagatctatttttctacttttttttttttttttttggagacagagtctcgctttgtcacccaggctggagtgcagtggcgcaacctcagctcactgcaacctctgcctcgtggattcaagcaattatcctgcctcagcctcccgagtagctgtttgtaggcagctgccgccacgcctggctaatttttgtatttttagtagagatggggttttaccatgctggccaggctggtgtcaaactccttcaagtgatccgcccgccttggcctcccagtgtgctgggattacaggtgtgagccactgtgctcagcctgttttttctactactttatccccagcacctagaataatgcctggcacatagtatgcattcaataaagatttgtggaatgggcttagaatgtagaaagctacaaaggctctccctcccaatatcataatgagaaaagctggataatctaccaaattgtaacttctgttgagcccatcagaaagctgaggttgcaaggcaaccaagtaacctcagcgccaaagagagacaacagaagcctctccaaagacagaacacaagaaccccttcacctttggcagagcgcaggagaaagaggttactgccaaactagttggcaacaggaaatcggctataattttaatgaagtcttaaaggccaagtgtaggttggcatgtgagtttggactagctgggggcctcagatacaaagggagttcacattcattcataagccctttttaataaacctccatcagaaaccgtacttcacaaggaagatggggactggcaaagagcccggagagagacctctctgtggggtgggcatccagctgctcaggaacaggcacagaccccacctgcttcctctggactcttctcttctaaaaaagcaggctgggcacagtggctcatggctgtaatcccagcactttgggaggccaaggcgggcagatcatctgaggtcaggaatttgagaccagcctggccaacatggtgaaactctgtctctactaaaaatacaaaattagctcggcgtggtggcgcacacccgtagtcccagctacttggggactgaggcacgagaattgcttgaacctgggaggggaaggctgcagtgagccaggatcaagccagtgcactccagcctgagcgacagagggagactcgtcacaaaaaaaaaaaaaaaaaaaagaaagaaaagagaaagaaaaaaagcaaaagcagtaaattctctctgtctcagggaatgggcaaagatctgttgctgccaggggaggggtagaaataaaacccagtaatccaaattcaaatgcaaaaaaggaggggaaagagaagcagaatccctctacaatccaggggtttgccatgaggatggtgggaatgttgagaaggccccaccctttgagcatcctgggctacacattttttttttttctcgaggcggagtctggctctgtcacccagtgcagtggtatgatcttgactcactgcaacctctgcttcccaggttcaagcaatgctcctgcctcagcctcccaagtagctgggattaacaggcacccgccaccacacccagctgattttcctatttttagtagagatggggtttcaccatgttgcccaggctggtctcgaactcctgacctcaagtgatccgcctgcctcggcctcccactgtgctgggattacaggggtgagccaccacccagcccagtattgtccgtcttgtagagtatttgcattctaattctctttgctgttcgtctttcatgaagagatcctggcatagctatggccaaatgaagcagcattgtgtttatttagttcatttactgtttaataggagcttgctgaaagccaaatcccaccctaaagagaaaccagacatggctacatagtcatatgatgaatcacaagtgagaatacgcacagatcctgtcccttgcccctggaagacaacacctgtggactttgcttagtgccaagcgaaaacaagtgaatgctatctctttgacatattctttctgtataggccagatacatttgaaatgaacttactggggccaggtgtggtggctcatgcctgtaatctcagcactttgggaggctgaggcagaaggatggcttttggccaggagtttgagaccaccctgggccacatagcaagatcccacttctacaaaaaattgaaaaattagcggggcatgatggcacgtgcctgtagtcccagctaatcaggaggctgaagcaggaggatcacttgagctcaggagttcaaggctgcagtgagctatgattgcatcactgcactccagcctgggtgacagaacgagacactgtcagtaaaaaaataaaaataaataaaaaaaaagaaggccaggcatagtggcttgcacctggaatcccagcactttgggagaccaaagtgggcaaatcacttgaagccaggagtttgagaccagcctggccatcatgggagaaccccgtctctactaaaaatacaaaaattagccgggggtggtggcgtgtggctgtaatttcagctactcacgtagctgaggcatgagaatcgcatgaacccgggaggcagaggttgcagtgaggagagattgcaccactgcactccaccctgggtgacagagggagaccctgtctcaaaaaaaaaaaaaaaaaaagccgggcgtggtggctcacgcctgtaatcccagcactttgggaggccgaggcgggcggatcacgaggtcaggagatcgagaccatcctggctaacacggtgaaaccccgtctgtactaaaaattcaaaaaattagctgggtgtggtggcgggcgcctgtagtcccagctactcgggaggctgaggcaggagaatggcatgaacccgggaggcggagcttgcagtgagccaagatcacgccactgcactccagcctgggcaacagagcgagactccgtttcaaaaaaaaaaaaaaaaaaaaaagaagaagaagaaagaagaaggaagaagaagaaacaaaatactgacatatgaaaccacacagatgaatgtcagatgagtcatgggaagtgaaaaaagacaaggctacatattgcacggttccattcttatggcattctggaaaaggtagaaacagaaaacatctaagtggtttctagggactgggggtgtaaggaggggttgacaacaaaaatccacgtgttggggaggtgacggaagagttctatatcttgattgtggtgatggttatgtgatacggtttggctgtgtcccactcaaatctcatcttgaattgtagttcccataatcctcatgtgtcaggaaaggaacctggtgggaggtaactgaatcatgggggcagttacccccatgctgttctcatgatagtgagtaaattctcatgagttcttatggttttataaggggttttcccccctttgctcagcatgtctctttcctgctgccatgtgaagaaggatgtgtttgctgccccttctgctatgattataagtttcctgaggcttccccagccatgcagatgtgtgagtcaattaaacctttttcctttataaattacccagtcttgagcaagttctttgtggcagcatgagaatggactagtacattacataactgtatacattcatcaaaacttcaagaactgtacactaaaaggagtgtttttggcctggcgcagtggctcacgcttgtaatcccagcattttgggaggctgaggtgggtggatcatgaggtcaggagttcgagaccagtctgaccaacatggtgaaacccccctctactaaaaatacaaaaattagctgggcatggtggtgggtgcctgtagtcccagctactcaagaggctgaggcaggagaatcgcttgaacccaggaggcagaggttgcagtgagccaagatggcatcactgtactccagcctgggcaacagagggagactccatctcaacaacaacaaaaaaagtatatacataaattataccttaagaactgagaaaaatgggaaacaaagcaaatgctcagcaacatgggacttacagcatgagtatcattcggccactaaacagtacacttcacgcatgaacaacttgagcttgaactacatgggtccacttacatgtggatttttttcttttttttttctgagatggagtcttgctctgtcacccaggctggagtgtggtagcacgatctcagctcactgcaacctctacctcccaggttcaagcaattctcctgcctcagcctcccaagtagctgggattacaggtgtgtgccaccatgcctggctaatttttgtatttttagtagagacggggtttcaccatgttggctaggctggtctccaactcctgacctcatcctcccacctcggcctcccaaagtgctgggattacaggtatgacccaccatgcccagccagatttttttcaataaaagttacacttgagtgtgccagcctttcctgttgctccttccacctcctctacttctttcacttctttttttgagacagggtcttgctctgtttcccaggcgggagtgcagtggtgcaatcatggctcacggcagccttgacctctcaggctatagtgatcctcccacctcagcctcctgagtagctggaactacaggtgtgtgctaccatgcctggctaattttttttttatttttggtagagacagggtgtccctgtgttacccaagctggattagaactcctgggctcaagtgatcctcccacctcggcctcccaaagtgctggcattacacgtatgagccactatgtctggtgtttatttttaattgaagtatatttagggacatgagaaaatgctcatgatcaaatggcaggagaacgaaactatatttacagtacgatcccaattttgtaagacacatacacacattgatgatgatgatgacgacaagaaaacagcacatgtggctgggcgtggtggctcacacctgtaatcccagctactcgggaggctgaggcaggagaattgttgaacctgagaggtggggggcacagggagccgagattgtgccattgcactccagccttgggcaacgagagtgaaattccacctcaagaaaagaaaagaaaaaaagaaaatggcacatgtgcatatatgttaggaaaaataccagaaaaaaatacaccccaatgttagcaatgtaacctctggaagtcaggatcacagataactaatgtttttctgaatacctttactaaatttccaaattttcatctgagcctttgttccttttacaatcaggaaaaaataattaagattcctattggaaaataccataaagtggcagggccacctggctgtctttgcccagaagcggccagtgactgtatgtagttcacatgccctgaggcggctgccttggtgatccgaatgctgttgagctcagggtcttttaggtcctcgtaccctaaccctaaccctaaccctaaccctaaggcgctctgggtttctgcaaccttcgggaggtctagcacctagtattcctctggcgtctgagttttggtccactggccgttggtgctggtatcctttcccctaagagtgacatcacttatttagttcatttctttcttccttccttcctttcctagccctttccacaaaggatttgtagatgcctagaacaatataatctgggtttcataggatagtcccagatttgttgcgttttcttttttctttttggtttagtgccacatacccaggctagagggaggatgagcactgtggttcctccgaccctgtgcctggtggtggtcatgcctggccagaaatgagcctcgtacctcaactgcaggcgaggccagatttagctcagtttgggcacatcctcccaggtgtggtggagccacctccatcctgaccctggttcttttcactggctggcacctggagctgactccgtcctggcctgagggcccctctgcttgctgccaccacaggggccacagagatgcagcccatttattcggaaaaccgaggcccagagagtggcctttgtcttccacaggtgtctgtggaagggctggggaggggcgcagaccttccctgcctcagaggaggcttcaggaagggtggacaagggaggggagcagagcggacagccaccactctggggagaccttggactgtgaaaaggggtgggggaaggaaagcttacagggcacccacaggctggggtgcccacctggcagggtctttggcttctgagcaccccttaagttatcctcacttcatcacccctgtttttttgttgtcattgttttgagacagagttttgctcttatttcccagactggagtgcagtggtgcaatcttgacttactgtaacccccgcctcccgggttcacacgattctcctgcctcagcctcccaagtagctgtgattacaggtgcccaccaccatgcccggctaattttttgtatttttagtagaaacagggttttaccatgttggccaggctggtctcgaactcctgatctcaggtgatccacccgcctcagcctcccaaactgctgggattacaggcatgagccactgtgcccgccagtcatccctacttttcagcaaatgaagctcaggcattttccgtttgtctgtggtccagcctcctgcccaggtggggactcagggacacttcctacaggaagttggggaacggctcaaggactgagcagtgctctgatctctgaggccttggagcctgggttgggaggcctgagacttctgaaacccagcacacacattctcagaagacaactctggccctttgtctctggctgtcccatcatggtgtcagaataacacaggtccttctctgagcctaccagagtttcccaagggcaagattggcttctcttcatgtttgtcctggcaccgctgagtctcacacacagtatgtgctcaatagatgcatggtgaatgaatgactgcacaatggatacataaggagagccagctgatccctcaccaggttgggccactcaggggtcaggccttgctcagcttcccaaaccacatggtctgtgcccacggcgaagtcactgcttcctctcacttgtcctgtttccccatgaactatgagggggttggtcaggtggtccacacaagtccttcccaacctcccccatccctatcccgatggcttgtgagcgggttccctccaggcctatccagtgcctgaggccttgacacagcccaggctgcccagtcgggccttcactacatgcttctgagtggaccaggatctggcatcagagcccagagcagaggtcagccctgttctccatctgcagggacctccgaaggcccagttttagctcaggctgcagcaaagccagatccctactccggtcacttggcagcacttgctcaccctcccgacatttctgggttgtgggaaggatggagagagatgatgaaatacccctgtcctgagctccaggtagctttggcccaggagagggctctggggctaacactccccctagtgtcaactcaggggccttggggacccgaagaggtgtggacagttggtggcagcactgatccagggtggtggctgtgggaggagcgaagggcagccatggacagcagagaaccctgggcccctgcctatggtgtcactcataatcgtgacaatgaccagctcctgagtgcctgtggcgtttttctttttttttttttttttgagatggagtcttgctctgtcacccaggctggagtgcagtggcgcgatctcggctcactgcaagctccacctcccgggttcatgccattctcctgcctcagcctcctgagtagctgggactacaggtgccaggcaccacgcccagctaattttttgtatttttagtagagacggggtttcatcgtgttagccaggattgtctcgatctcctgacctcgtgatccacccgcctcggcctcccaaagtgctgggattacaggtgtgagcgaccgtgcccggcctttttctttttttgagactgtctcgagagctctgtcgtccaggctggagtgcagtggtgcaatcatggctcactgcagcctcaaattcctgggctcaagcaatcctcctgcctcagtctcccaagtagttgggactagatgcatgcaccaccacactcgaccaatttttaaactttttgtagagacaaggtctcactatgttgcccaggccaccttttcttcttgctctaactctccaactggaaaagtatcacttctacttggggaaactgaggcctagagacaagctgaagtttccaagctggcccctgagggcagggcaggagagggaagatgggcagttagaggccctgccagatctctcacggggggggccgtgtgatccagcctcagagtggaggttgcttcatccagctcagcggggaccgtggtcttgccatggtgtttgggcagtgactgaggccactggcaccaggagcctgcttctgaccccccaccttccctcccaaccccgttctgcctgtttctctgcagcctggggctgtgggccgagccgggtgtccgccctgcgctgtagggctccaactcctcagaagctgggagcaggggacccgccacccctcagacaaggaggctgcgtgacaaggatctgtcccatacccttgctgagctgggacaaagccacactgcaggggcagctgcctgccttgctcctcccaggtgctctgtgaggccccatgcccagctggcgtgcttttctgggcagccttcccagggctcggtgagcgtggccacagccgccctcacgtcttgcttctctcctgtcttcaagccagtccaagcctcctccctcctcagtttctccagcgagggagggggtggttcctcagggatttcgctcagtgctttgggctggctgagactcctcaagaaaccctggctggctcttggagcctctgtttcctcctcggtagaatggaaatggggagacttgcccataccctgtggagatgtttggagacgcagataatgtaagtaaaaagtggagagcacacagtaggtgctcaggaaaatgtgctcataggagagttatgggtgatgtcagtcttgtcctgctgtttgggctggggcaatagagaggcgccagccgatgcccgcaccatgtggaagcccaggtcaaacagcagcaggtctcggggagaagggaaccccaaggggctcaggtgcctcaaatccccaacctccagtttggcaggggcagtgggccgtggccttttgggcaggggtcctgtgccctggatcttgcccagctccaaagctagtaagccccagggaggccacccccgccaagtgaagtgggcatgaagacagatgatggcgaagggacttccatatgcacgagatcaactgtttattgatttttttcctcaaatactacacatttaaaggaactgttaaactgaaaaagacttgacaatttttggtaaatccgtagcacagaaatgaggatttctgctggtaagttctcaggacagacacagacacaggtccactttccaagcaagacatctgctcactggaaacggagtgaatgcatagctggtgacggcggcgggcactgctgagtcacgtgaaacacaggttcccccacgttccccccacccccgccggcccgcgtggcccccgcgtaactctggctgcagcacctgctcccgggcgactccgggcagcccgagacactcgtgctgcgggtaagacccagcttctgtttgtgcacaagtaacacgacgactgaaatctgcaactactgcaaagacgcgggcacttttacagtgttctgctacggagccaggacaaaggccggtcagaagccggaccagcagtcagctggtgacgacgagcctccctccagcaggcaccacgtcagagaggccccaggcccactgagcccgggaggagacccagccggccagccagacgtgtgcctgaatgccacagacttcaagcagtttacaaacgaaactcactgttaaaagctgttaaatctcattaaaacagtagacgagtgctttagattctctgaatatcaaataatatatacagatagacactgagacatgacagtctaatctaaagcatctttacagatgcatttgcttgaaaagttagtcttctttttaactctgaatcagtgataaaattgttaatttgcaaaagagtacagttttaagcaagaatagagtgaaaataatttttaaatatggcgatttgggggagttctacctaaggttctatgtaaagcttccattcagatgcccaaaagcacaaagagcattcccaatagaaacccgaccataacccggtcccaccttcctggcataattcctttcctcaaacatctgccacctgaggctaagcctacacacggcgtggctgagtaacagggtaagggaatagggagatcgtttcctcaagactggtgcgcatcaatctgtgccataatttaagtagaaatgaacaggtgtataaaaaagtataactgtacacagcctttaaattaaaaacctcaaaatcttcactcaaaatgggatgtaagcttgttcatttaagttgcaggtgatggactcgtcagagagagtaatcagtggaacaagatcagtgtaacccaccattgactcggaaaggagagacaaagtcaagaacatagagatctatgataggccaacaggcacagtgggcggggaggggcggctatttctgttgttctgcgtcttcctgcgctcagatccctccagctgcactcggaaaggtgccgagtcccaggcgaaatgaccagctcatctgccttccaggaacaccatgaagccaagagcaatggaaccatcatctcttgcaggaaaaggagtggatgcccacgtggctggctgaggctcctgggcccgccgcctccgtccccccgctggcctgtccccgactcatcactggatcgcctccacataatttgccgggtataggccaacttgcccgttgtccaagcgtcccttgcaccagccctgctcatcctcgtcctccatcttggtcagctcatcccctgcaagacaaagagggagccgtctccatgagaggtatgacaccgacggtgggctacagagccgcattcacgagctttgagcccacagagggtggagggccaggcattctgtggcgggcaggccgagggcctggtcatttctctactaaatgcatgcattttaagttgcctctttggtcatgggcctctgacagacctagagatgacagtctcacacagtaatttggaacaagctgctctcagctgccacagtggctcccactgagactgcggcatccagctccatagggctgtgccttcctcaccaccctggccaggtggcaggaatcgtccctcggttgtgcccctccctcacgttgggcctcttctgtcccctccccagggccccggccgccttgctcccagcagctgtctctggggtctctctgcctttgctaatccctctcctctgcaacttccaggctgcgaggggaagggaccatgtctgacagtcatacctgtcattttatccccagcacctggctgatgacttgtgcacggtgccatgtgtcaacccttcctgagaccctgagaaggagcccctggcgctgttctggaatctccctgtggctctaatgtattaacgtggttccatttatctttggttgttccaacctgaaggacctcctacttctggccaggccttgggtagaagaggagatacagagatgagaggaactgatggatcctggtctcaaggaggcagactagggtggtgagggggaggtggcactagggtagggccccaggtctggcatttgccaggttagggaagcagagcagctcagagcccaggggtgggcaggggcctgtgtgcttctggttggtaactcactgcagggaaggccagttgggcctgctggctcggacctcgtcaggagcaagcaattggtgggaaagaaa

SEQ ID NO: 15150 - DNA, 12584 bp, Human
cctagccagacgcggtggctcacgcctgtaatcccagcactttgggaggctgaggcaggcagatcacgaggtcaggagatcgagaccatcctggctaacacagtgaaaccccgtctctactaaaaatacaaaaaaaaaaaaaaattacctaatgtccaatgccttgaaaatcattctcatctatagtgtcttttttttttttttagttgtttcaagcaggagattaaatctcattagttacttcatcttgaccacaagccatagatgatattggaaacacatggagagcttgttgtaagtacacatatcttagggcatattccagtcatactgatttacaagctgtatcagtcagacgagggtatggttctgcaactgtgtgccaaaactatgccaggcactagatatataaagttaaattaggcatagtacctgtttgcaaacgactttacaatccactgagaaagactgggtaaaccaaatcttacggtgcaatatattaagcataatgtctacatgcagggtgatttggagcatcttatgagaaaaggcatccaaatatagccacatgatggccaagggagggttagcaaatgagtcctggaggaaactgaggaaatttggaaagatgagctagagttagttgttttagtggaaacagggggaaaggaagccatcatgcaagaacactccaagtagagaggatactgttatgaaggctcagaggtgccaggttgcataatacctttggggaactgcaaaaagtttggaatggcgagatcagagtggatggaggaagaggtggtcttcagtgtctccatgtctaaaaggagactcctggctgggtgtggtggttcacgcctgtaatcccagcactttgggaggccaaggcgggcagatcacgaggtcaggagatctagaccatcctggctaacatggtgaaaccccgtctctactaaaaatacaaaaaaaaaattagccgggcatggtggcgggtgcctgtaatctcagctacctgggaggctgagacaggagaattgcttgaacccaggaggcggaggttgcagtgagccgagatcacgccactgcactgcagcctgggtgacagagcgagagtctgtctcaaaacaaaacaaaacaaacaaacaaacaaaaaatggagactcctctatccctaacagtgatgactttcatgtgggagaagaaaacaaaagagaataactcattttattgagatgggtaggctagtgaagcatttgataatagatagatccagttttcccttgaacctgagagtatgtctgacttactgacttgtttgttcttcaaagttttattaagcaccagttttacatcaggccatatgctgggtactacatatccagaaatttgtaagaccttataatttgatagtattttttaaattgttttgtgtcttaaacacttactattgagcatgtttctaaaaaaccttataccgaacagccgcaatctcaggaaagcaatcagtgactgcgttgacaggagaggaaattggcagcttagctgagggcagcacacattagggaccataagtgaagacttaacattaagtaccaagaagtgttctgagcattttatgtaaattaactcatttgataatcagaagacttattacttactaatcagaagacactcttttgacagtagtctttctatgtatttattttacctgctaccaatcattgtactaccacaaagaatgaggaagtcccagggaccttgggaagaagaggtgtggtccctgagaaaagggttgagggggtgttggagtaaaaattttgtaccaaatggaagtttttcaaaaaggcacagacaacagttacctctccaaacaaatggatgtagcagtaaacctaagagtttctttaggctgtttactaacgtgaatagcaacatcttcctaggtattaggccaccccaagtgtagtttaaaaataaatagtactagaaacggaagtggaaacacatgcacagtttatcttttcactcttgtgaggtcagcagacatctgtaacgcactttccctacagcagctaacaaaggcaggatgatggtatctgttctgaacgtttgaaacaacatcaccacttatctttacagatttcctcaggttctcaatggagggcctgaaaaacatcactgtcaaggatgatgctgctacattttatgagctggagacgaacgagacctctcctgatgcctctccagtcacaggaataatggttttgaaaacgtcaatgctccatctgccttgtacgttgtaatctcctgtagtccatctgaggccaacgtgcacaggaccacagtagacaaagagtattcctgatgacaaatctgatatttcagtctacttcttcatgtgatatcccaagtattttttcctagaggggaaaaataggttcttaaaattccaagttagatttactgttgaagtgaaaacatatggctgctaactctgctctatcccaggcgtgacccgaggctcaggagaccatgttagtttgggggagggtttggagaggtgactggcattcttggtatgcctgcaaggaagacatcagctaaggtcttacgttacacacccagagctaacaggctggatctttccttgaagatgggagggcttcaagggtgtatttaaaatgtaataaaagtgggtactgaaaggtcaatgactatgaaggttacaactctctcctttcaaagtgctacagaatgggtgaggttgcaggactgcagggtaactatgtgaatggtgctccacagagagcacaaagagccaaggagtaaatcagaatctcgtggtagcttgtttggcatgccttgtagatagagttgctattcattcatttgatcgattcattcaccgttctacaagtactggctgaacatctatggtgttatgtagaggaatgggagctatgggagattaaaggagccatcataaaaacatgatctcacccttacagatttgcagtttagttgggaagatgagatgtactcatatgaaatgtggaatactgagataggaaccctgagcttctggaaagcttgtgcatgggactagatttctctcctcccacactactacaaggacagcagagagagccatcgagacacttggtgccaatggaagtcccaggaggcttacttcccattgtcttctttttttcccgttaagggactctgagcacacgccccaatccacatgtccttcacacttccatagctcatatcagctcataaatattctttatcatcctcctttattttttttctaccctttggaaaaattagtcatccctctcacattctttgtctcccctctcctaatttccactgacatgctccaaattaaacttaactgtggccaagagttaagattaaggtttatgataacttggataagaaatacactttgaattgaaactacagatgttaaagaactagtgccatcaatttctaaagcctttggaaatccactttagtattcctactgaataattcatctttttttttttctaattggaactgttttttttctccagtaccagcagccaaattaaaaaaataattgcattcatttctctttcctctttttgattactagaattagaactgctagttttatgaagattgattgaaatataattatgctataaaattcactaattcagtgaattcgtatattcacttttagtatattcacagagttatgcaaacatcgcctctgattttaggacattatcatcactccaaaaataaacttcacatcccttagcaattattcccattctctcaccctcagctcctagcaacgagtctactttctgtatctatacatttgcctattctggacacttcatatacacggaatcatacagtatatggccttgttgcctgactttctctcacttagcataatgtttttaaggttcatccatgtatcaatacttgctttatttttatagtggaataatattccattgtgtggctatactacattttccttatccattcatcattcatcagttgatggacatttgggttgcttccactttttggctaatggaagctatgaacattcatgtacaaatttttgtatgaaaatatgtcttcagctttcttgggtatatatccaggagtggaactggtaactttattttttttaattttttttattttttgagacagagtctcgctctctctcccaggctggagtgcagtggcgcgatcttggctcactgcaagctccgcctcccaggtttacaccattctcctacctcagcccccctgagtagctgggactacaggcacctgccaccatgcccggctaatttttttgtatttttagtagagacggggtttcaccgtgttagccaggatggtctcgatctcctgacctcgtgatccacccgcctcggcctcccaaagtgctgggattacaggcgtgagccactgcgcccggcccctggaattggtaacttcatagttaacatttttgggaactcccaagtggttttccaaagggactgcaccattttacaatccaaccagcaacataaaaggttccaatttctccacatcctcaccgacgtcaatgcttttctttttcattttagccactgtagtggatagagctcaatgttgctttgatttgcattttcctactgttgaaatgaagatgtcaaacaagcgtcttttcatgtgcttttagccatttatatatattctttggagaaatgtctattcaaatccattgctcatttgaaaattgggttatttgacattttattgttcaattataatagttcattatgtatttagatatgtcttttattagagattttatttgcaagtatttttccccattctgtgggttgtttttttttttttttcacattcttggtggtggtgttcttggaagcacaaaacaaaatccaatgtatctattctttcttttgttgcttgtgcttttggtgtagaaccactgctttttaatagcatatttatggtattttagctacattagtgggttaaatagatttttgagagctagcctgtgaacccaattgataattataatttctctgagaaaatatattaagaggactaacaatgatttttaaaatgaatgcttgaaacatagtcaattgggaatttgatcatcttttgtatattattatggtgcaaacatgaagtgctggagattagagactgtgcagcctttgagctggaagggtcaggagaggctttggggcagatgagggctcaagggggttgttggggtgaaggaatcctggaaagaagaataggtagaactaaaataatgttgaggaacctgtcctccttttagaataagctaaggcagcttaagtttagaatacttaagaatggccttggttgttcagatcagccacttagggttatcaaacttggtgcaaaagtggaaaatagaaaggaactcaatgtacagaaactgaagaccgtggcagccactgaagaccatggcgggcacttcagacccttgggcaagatcagctgcactttccttccatcagcaaagagaccaaggctgtgtggaggtcccagggtcactccagccatgcctagagccgactcaatcctcctgctggcccctggaccattctagtggaaagagaactaaggataatgtgggatgaaggtctgtccgcctaggaatgcctaggcctgttgagagttaaagttgtggggtagtacattttgacacggtggaccttatgtagctgtttgaacatggcagtcttaaggagacctgaggaactggggatgagggatgggagagggtttgaggcaaaagggaaagaggtctgttttgactgataccaggtaattgaaaatagatgaaagtttaactgttggctttttatttggtatcaaaatgtcaccctcaaaatggctgggtcaaagcagcaatgacaaaatgccatgaaccctgagtctctgcatgaggcttagtctccgtgacctctaagtatctgcaagtgtgaggaactgtctgcctgcccttgtctccctgccagacttccgttgcctgcaaaatttgtgaaaacagaaattacgtctatctaaacatttcttatctcagcatctcctcatttcctgttccatctgaccagtccctctccatccacacataccctgcatacccttggagagctcagtaaatatttattgatgatgaagataatcactaaaaatatgttcccatcaatgggatctatctctggccactcaagtgtcctaaactcatgagaactgcttcatagatgtgttcccttcatttaaaaaaaaaaaaaaaatccatcccatctcttctgagttctgagaaaatttgtttttaaataggatacgcttacccatccaccgtgctgctggatccatggcgagaagttctctttcaggtacttggtgccaaagcccaggaccctgttcatcgggtggttgtcaatagctgtgagcttggccgtgacgtctattacaagggcagccttaaagccctgagctttgacctctgattctcccctggggtccacacccattaggacctggtctgtgatggtcttgaaaacagagtaggacagcccatcctggaagtggcccatcaaagccttatctttcttcagctgtgtacaaaagaataagcactcagtacagtagcttggctccacgaggcagacagaagttcattctttagctcaaatgcaggccatcaaaccatcctgtggaaaaccctggatgctggtgtcaaccaagggaatggggatgaaggcagtgtcctgcagaaccagaatgggcatgtactgctcggtgaattcatttcatcagcacaaatacatgtataaaatggaacagtcagttcacttgacatttaacaaatatttcctgagcacttataatgggcaggtagtatggatgactgagatgcgggtcctcactcaaagggctcacagtctagtgggaattgcagaaaaatgtgatgtcctttgctagaagtagtgtaagggacaggatctgaagcttaggaatcactgtcttggctcaaacccctgggtccacctcttacttagctatgcaatcttggggaaattaacctctcagattcagtttgtcatctctaaactaggatggtgatagtattgatactatagggtaattgttttctttctttttttttttttttaagacagggtttcactcccattgcccaggctggagtgcagtggtgtggtctcagctcactgcaacctctgcctcctgggctcaagtgattctcttgcctcagcctcccaagtagatgggactacaggtgcatgccaccacacctggctaatttttttctatttttttgtagagatagagtttcgccatgttgcccactcctgggcttaagcgatccacccacctcagcctccccaaagtgttgggattacaggcatgagtccctgcacccagtcttcattttcttttcttttctttctttctttttttttttttttctgagatggagtctcactctcttgcccagactggagtgcagaggcgcgatctcagctcactgcaacctccgcctcccaggttcaagcaactctcctgtctcagcctcccaagtagctgggattactggcacacaccaccacacccggctaatttttgtatttttagtagagacagggtttcatcatgttggtaaggctggtcttgaactcctaaccttaggtgatccacctgcctcggcctcccaaagtgctgggattacaggtgtgggccactgtgcccgtacccagccttcattttcttaagaaacttttattattattgttttttagggacaaggcttactatattgcccaggctggtctcaaactcctggcctcaagcgatcctcccacctcggcctccccaggagctgggattacaagtgtgagccactgtgcttggccctatactatagggtagttgaacactttatagtgctggacatagaagaggtgctttggaaatgcgagtcatttttcaggatgctacgggagcatggaggtcagggaagactcccttgcatgcaatgttcacttaaaaaaactccaattcattgatttctttcccattattctaccctattgattttacctcccggccttcccttgaacctggtatctctctgctttacctcctttgaactaccacgcctttaaaacaaaatcaatgctgcctcttctgcttttgaaaaatcagggctcatatcaaaaagctatatatcatcttcatttaaagcattcttgcaatgtctgttaatatgctgcttgtcatgtgaaaacggaaatttctgagtgagcagggacaaaatatttatttgaaaatcctctagttctgtcctagaggaatgataagccaagcgggttttcaacaaatattgtttctaaaagggatatctgggggatgagtcagatgcgattgggagattttggcagacctgtcttttccctgaaccacgcccacccccaccgtccaggccccgtctgggttgtgactctgcaggaggcatggccagcctcctccataacagggaacagactcctcttcatcagtttcccaatggaggaggccaggctcaaaaccctagcaggcagccaagtggggactgtgccagaacagtaaaagaatcaaacgccacaaagacagggcttccactggcacctcctcacccctcccctgcctgtccctctcgggtgcacctggctctttggcctctcctggaggtgtaggatgggccttcgggctgtgtgtgctcttgggaccagcggctctgcagatcccctgcagccacacacacggcactctgcagtgggagcttggcacccgcccagcacaaggtcacacctaccatgtgtctctagcagagctccctactggggaagcatgtaaaggaaataacaaccaaggctttgccataagcaatgtaaaatgtccaaactccttaagagagagcaccaggcaaagtgaggtttttgaaagtggtaatttgtgggggtgaaaatgaaaccatcgctcttcataacctgagatcggtggccttcgtcccacctccagcacccccactccgcctttcccacctccctgaccaatgaccacaagtccctgcttagggaagctgggaaggaggttgccgtgagagccacagaaactctgagttgtaaagagcccttgaggttgtctaaaggacccctcggagttctgtgctgaaatgctaactggtattggcacctacttgcaattcttcccgtgacaggaagatcattctctcacaaggcacccgttgactctcatgggcagcctggagtgcctattctccaggaatggaggttcattcttaccataaggagaaatcaatcaccccatactaggcataatttgtgtatccatgacactagctctggagaaatgcaggggtgcccttaaatcatgatcctgttccatctcttgcttcctctgcacccctctccaccctctacttgtggtcccaaagctcacacaccccgttctcttttctttaacctaatatccctggttttctcgctgtttctcattctgtcccatctcccaggtgcttcgccctctgggtcaccagcctctgggcacacttttgacaaagctatagacaggagctgtttgtcttcctgcagaacctcccatccccacccccagggtctgactccctccccacagattctggcaaaacaagggtctatgtctgcaagccagcccctgattgacagattctagagactactcagtcgtctgtgggttatggacccaggaggcatagagaagcccttttgactctgttgaaggtttgctcaccaactctttacctgaaggcaactctcacccgttcctgattggaaagatgggtctcaacttccaaatggcaggaaatccatacattctcccagtaacactagcgcacctccctggctgaactgctaagagagcccttaaacaggccacagtccagcaactacaggggaaaaagattccagaaagtattccagctttggagcaactgtgggacacagatatccaggctgcaaagcaaatgcgagtctaaacttcaatgaggatcagttacatggggaatgagattaataattccatccagcaaattttaatttactggtgtcttttcttgcaataacaagtttcttttttagtttccaaaaattccaaggaggctccagaaggtttacttatgttttccaaagtgactcatttttgagattctaccagcatgaagaattttgactccaagggaaataaaatttaggactaagtagaaaccaggacttagaaagggaataaggttgcaacctggaatacaattccattctcgtgtactagtgcatgggcacagaaatcaatcgcatcagttcaaggtgttccatacctttctttccaactgatctcctgaatatttcagcagctcaacaattttggctagtatttgttcttcttcatctgtcggggaaaattccagttatttcttttaagagaagcaaaaaataatcttacatttttccagggacaatgaatgcttgtggcttggtaagggctggaggaagaggcatgctaattcttttttttttttttattttttattttttagacagagttttgctcttgttgcccaagctgtagtgcaatggtgcgatcttgcctcactgcaacctctgcctcccaggttcaagagattctcatgcctcagtctcccaagtagctgggattacaggcgtgtgccaccacgcctggctaatttttttgtatttttactagaaacccaggtttcaccatgttagccaggctggtctcaaactcctgacctcaggtggtccacccacttcggcctcccaaagtgctggaattacaggcatgagccactgtgcctggcaagaagcatgttcattcttatcaagtaaatcttacctcgcctcttctgcccagacacaaaccatactagggatttctcctacagccccttcctttccttctttccccttcttcctttgctcagtcccccagctctcactgtgaaattcatcgctgtagttaccttaagcttgttgttgaagacatcggtttcacagcacaggattctgtctatgaagatatttagggggaatattcttctggtttttggatttttcctcagcagatggtgcttttatcttatggacaccataaatctcatatttgattatatttcactctttgggttagttgctagaaagtatagagccaaatttgtggcccatgtctaagagagtggatagtcttgctggcctacattttggaaattaacctaattcccaaatccgtcttattttcctgtttttgttttctttttacaaagatatctttcaaattgatggattttatctgactaaaatttattctttgtatgctgggtcttgacaataaggtgggatataaataagtaaaattaataaattcccctatggccaaggctaaaagggcagatggataggaacgtggccacggttggtgtatggtgtgtgttggggggacagggtgcagtggagtatgtgagtcttgctctgtcacccaggctggagtgcagtggcacgatcttggctcactgcaacctccacctcccaggttcaagtgattctcctgcctcagcctcccgagtagctgggactacaggtgtgtgccaccacacccggctaatttttttgtatttttagtagagatagggttttgctatgttggccaggctggtcttgaacttctggcctcaagagatccgtccgcctcggcctctcgaagtgctgggattacagacgtaagccaccgtgcccaggcttggcaaaataaaccttcttcttctacttttttttttttttattgagatggagtttcactcttgtcacccaggctggagtgcaatggcgtaatcttggctcactgcaacctcagcctccccagttgaagcgattctcctgcctcagcctccccagtagttgggatcataggcacctgccactatgcctggctaatttttttgtatttttagtagagaaggggtttcaccatgttggccaggctggtcttgaacgcctgacctcaggcgatccacctgccttggcctcccaaagtgctgggattacaggcacgagccaccgctcccggccaaaataaaagttctacactgagtaagatctgtctcgatatattgggttaacactctcttagagaaagttgctggcacagctgcctgtatttctcctgtgcacagaggatgaggtcatcttagctttagcttggtttaggggtggcattccatctcccaagcccatgtgggatagtaataaaatgtcacactgttttttttttagcagactcagaggcctcctcctctcctccagctcttcacacggtcccctgagcctctgtggcagctgtggcccctttagtgtggctac

SEQ ID NO: 15151 - DNA, 73295 bp, Human
  misc_feature (1)...(73295): n = A,T,C or G
agccagaggggcccaaggcagcagcagatggaccggggccagcttgcgtgcctggtggcctcccccaggaggaagaaggaacgggaagtggggctggcccacagagactaacggtttagttgtacaccgtgagtgggatgtggcagagcccccaccagccagaggaggcggacgcctgcttgcccaagcctcaggccatgccatgcccctgccaccctcctcactacagcctcaggaaggctgaaggggtgagcaaagaggctgcccagtgttggtggcctggatccagacgcaggcctggctgccagctggcctaagggcccttctcccagcgtgctggggctcccagccacagtgcccagtctggcagggtgtgcccaagaccccagggaaggcttccgggaaggggagttgtaacatatgggtgccctggcctcctgccctcgatgaaaggtgctggggaggggaagacgcagtgagcctggtgagggactcccacgcaggtgggaggtggggggggccctgacccaggcctggctgtagcggacaggtggcccattctggacacacagaagcggaaggaacacaggctgcaaagtggtggagtatgcccccctctccaagaagcccctggctggggccgatgtggcagcgatggcgaggtgggcagggcactcagacgccttgggaaagctgacttgggagacacagggagatggggtgtcgagcagctggtgggacttcagcaagggcaaagagggcaggatgaccacatcaagaaggagctggaactttggtagagcaggcagggcagggcaggcataaggaagtctgccccagaggccaggggtgcccacgaacactatgctctttttctactcccattaaaatacgatgctgcaacatggacaaggccactgtctgcttctttgtttgcaacagtgaaaaagtgaacagagaagttccctgagccccagcagggacacaagagcagactggttcctgccagcaggggggtgcaggacagcagggccagggctgtgtaggtgggcgtggggcagcttggaactcaatgtggacgagaagcaagttgcaggaccgcgcacagagtaggcagcatttgtgtgtgcctcgcacgtgtgtggtggcactgtatgcacttgtagatactcaaatacgtagggaaagatgagccccgcattctggggacagggagaggaggttgtatctattgcatcttagaaatttttgcagggctgggcacctgtaatctcagcagcttgggaggccaaagaggaaggactgcttgagtccaggagttcaagaccagcctgggcaacatagtgagatcccatctctacaaaaacaaaaataaacaaacaaactggtgggggtggggtgggataggggggacattctaaatcaatacagcaaaatgttaaatttgttgattccaggagggtacacaggtgttattctctgcttgcctgtgtgtttgcggttatcttatgatttaaagcatttaagacagaaaacagtcttgctgtataatatagtaaagttcactggagcttgtgtatgtgtatgttttgagacaagatctcgttctgtcgcccaggctggagtgcagtggtgtgatcatggctcactgtagcctcaacctcccgggcttgtgtgagcctcgcccttcagcctcccaagtagctgggactacaggtgctcaccaccgcgcctggtttatttttgtatttttagtagagatgagattttccacattgctcaggctggtctcaaactcctgggctcaagcgatctgcccgccttggcctcccaaagtttttgtgaggcttatctgaggtccaggaatttattagtgactggcgttcttccacctggacaccccacctcacccccactcctcctccctaagcaccaggtccttggaagagctttgcgcccttggccctgggcttgtcgtctgcccatcccagtctcagctgctcacctgcctcacctggctgctgtctgtttccaggaaggtgaggttagccacctgtagtcccagtcctgtttatgccagtgtggtgaggccgcagacccgatttactttgaggaatcccgtttgtgctaagtaaagtatgttacagaaagtcacgctgagggccaggttggttttcttttttttttttttgacagggagtctcactctctcacccaggagtgcagtagcctgatctcagctcactgcaagctccggctcccgggttcacgccattctcctccctcagcctcccgagtagctgggactacaggcgcccgccaccacgcccggctaattttttttttgtatttttagtagagatggggtttcaccgtgttagcgacgatggtctctacctcctgacctcatgatctgcccccctcggcctcccaaagtgctgggattacaggcgtgagccaccgcgcctgacctttttttttttgagacggagtctcactctctcacctaggagtgcagtggcctggtctcggctcactgcaacctctgcctcccgggttcaagcaattctcctgcctcagcctcccagttagctgggaatacaggcgtgcaccaccagatccggctaatttttgtatttttagtagtgacagggtttcaccatgttggccaggctggtctcgaactcctgacctacagtgatcctcccaccttggcctcccaaagtgctgggattacaggcctgagccacagtgcccggcctcaggttggctttcagtgcgggggtacatcaaggcaggaaacgtgctgaccactctcagactctggtctggggccctctactctccagggccagggagggaaggcgggtgtggtgcgaatggctttatctggttaccattcttatgagttcctcggttttagagacattaggaaccctctgccctgtgtctggagtgagtgaggctggcccaggagctgggtggcactcactggggtgggttggcctctgtgaagccatggtgcccgtgtcttctgcagtcccccggctttgtttccggtgactcagaggtgggagaagctgccactctgcatccactcccagctgggtgaaaggcagggagcaggtgtgccctcttctggggagaggtgaagtccctgcgtgggccaggagtgtggcctcctgcctgaagaggaagcacctggaagaggctggctgggtgaggtggggggcaggcactggagggaggcgggcactcggggaggcgggcactggggggaggccctgcttttcctttctcatcctttttacaccagggtcataaaaatcctgttgggttgggcaagcaggtggtgactgttcaggtatttccagattgtgggtagtggggacggggtaagggggcttgggcatggccaactttccacatgctctggccccggaaacctttgctcctcctggttttatcttccctggctccggatgggttacgccgtttctctgctgccagccctgttgtattgggtgggctatggggtgagaagtgtgtgcttcccttcctgggaggtgggcacctggggcacttggagtatctgaggagctctccaaacatgagatttttgagctccaattgcagcagatgaatgtttcatttcattcaacacattctaaaacatcaggagatctcaaatgtgcgtagaagagacacttacctaccgggcttgcacagccctgcccttcacccgttctcacacatggctccttcctacccgtccctccatttttcccaccccaagtgattttgaagcaagtcccagatatgataaaagataaaattaggctgggcacagtggctcacagcactttgggaggccgagttgggcagatcacctgaggtcaggagttcaagaccagcctggccaacacggtgtaatctgggctatattgaaaatacaaaaatcagctgggtgcagtgtcgggtgtctgtagtctcagctactggggaggctgaggcaggagaattgcttgaacccgggaggcaaaggttaacgtgagcctagatcgtgctactgcattccagcctaggcgacagagcaagactcaacagtctcaaaaaaaaaaaaaaaaaaaagatacaattgcatgtagcaatatgttaggatgtatcaataaaagatgggaaccctttttaaaaataaccactgcctgagtgccatggctcacacccacggtctcaactactcaggaggctgaggcaggaggattgcttgaacccagagctgcagtgagctgtgattgtgccactgcactccagcctgggcagcagagcatgactctgtctcttaaaaaacataaccacaatatcttgtaatacctaaaagataattcacagaaattccttaatgccatgaggtaacagttgttttgaatgagtctttttttaaatttaatttaattttagatttgggggtacacgtgcctgtttgttacacaggcattttgcatactggtggggttgggtttctggtgtacccagagtgccctccatgaaagggaagagagtgaacattgtacctgataggtaatttttcagcccttgccctgctgcctcccttcccttttggaatccccaatgtctgttatttccatcttttttctcttttttttttttttttttgagatggagctttgctcttgtcccccaggctggagtgcagtggcccgatctcagctcactgcaacctccgcctcccaggttcaagcgattctcctgcttcagcctcccaagtagctgggattacaggcgtctgccaccacgcctggctaatttttggtatttttagtagagatggggtttcaccatgttgtccaggctggtctcaaactcctgacctcaggtgatctgcccacctcggcctcccaaagtgctgggattacaggcgtgagccaccgcacccggcctgtcacttccatctttatgtctatgggtacccattgtttagctgccacttataggtgagaacatgcggtatttggttttctgtttctgagtgagttcacttaggataaaggcctccagttgcatccatattactgcaagggacatgatttctttctttctttctttctttcttttgagacagagttttgttcttgttgcccaggctggagtgcaatggcatgatctcagctcactgcaacctctgcctcctgggttcaagtgattctcctgccttggcctcccgagtagctgggattacaggcatgcaccaccatgcccggctaattttgtattttttaggagagatggggtttctccatgtcggtcaggctgttctcgaactcctgacctcagttgatcctcccgcctcggcctcccaaagtgctgggattacaggcgtgaaccaccgtgcccggccaatttcattcttttttatggctgctgaatgagtccttaatgtgaccagagcattatggtggacaggatatggaagaaaataataacatatccacccccaccatcatatatttgaggagagaatggttaggtgcatagacattaaatagataacacttcttcagacagtattttttggtaacagctttattgagagattcatataccataaaattcacccatctaaaatgtacacttcggtgagtttgggttttttttgagacagggtcttgctctgttgcccaggctggaatgcagtggtgcagtcacggctcactgcagcttcgaacttccaggctcaagtgatcctcccacctcagcctccttagtagctgggactacaggcacacatcaccgcacccatctaatttttgtagtttttgcagagacagggtttcgccatgttgcccaggctttcagtggtttttagtatattcacagagttgtgcaactatcaccacaatcaattttggaatgttttcatcaccctaagaagatacccccaactccttacccatgacctccctatcttcccatctgctccaagcccccggcaaccactagtgtactttctgtctctgtagatttgcttgttccagacatttagaataaatagaatcagcaatatatgaccttctgtatggcttctttcactcagcatcacgtcttcagggtccatccatgttgcagcaggtgtcggaggtccattccttttcattgctgaatactattccacagtatggatggaccacattatatttatccattcatcagcagaatgtattgccactttttggctatcatgaatgatgttgtgagtgttcgtgtgcagacttttgtatggacatgttttcagttctcttgggtatatatgtagaaatggaattgctgggtcgtatggtaagtctatttttctacaattttcttttttttttttaagacaggatctcccctgttgcccaggctggagtgcagtggtgcaatcacagctcattgcagcctccacttcctgggctcaagcgatcctcctgcctcagcctcccaagttgctagggttacagcaatgcactaccatgcctgggtaatttctttgatttttaatagagatgaggtcttgccatgttccccaggctggtctcgaactcctgagccaaagcaaccctcctgtcttggccttgcgaagtgctgggattacaggggtgagccactgcacctggcccaatttttatttttttttttatttttgtttattatacagagacaggggcttgccatgttgcgcaggctggtctggaactcctggcctaaagcagtctttctgctttggcctcccaaaatgctgggattgcaggtgtgagccacggtgccaggccagtaactctgtatttaagcttttgaggaacggacagactgtttgccaacgtggctgcaccatttgaccagccatgcatgagaattctgatttctccacatcctcaccaacacttgctatcatccatctttgtgatactagccatcctcctgagtgtgaagtggtgttttcctatggtttagatctgcactccctattggccacaggaggcagtcttacacttgcagtggtccccccttatccttggggggatacattccaagacccctggtgggtgcctgaatttgcggacagaaccaaacctatatggtcagctttgtatcctcaggctctgcttctgtggatttaaccaaccaaggattgaaaacatttggggaaaaagaaaaaacctaaataataacaaaaaataatacaaaataaaaatacagcataacaactgtttacatagcatttataaggtattcattattgtaagtaatctagagatgacttaaagtatacaggagggttgggtgcggtggctcacacctgttaatcccagcactttgggaggccgaggtgggtggatcacctaaagtcaggagtttgagaccagcctggccaacgtggggaaaccaggtctctactcaaaatacaaaaatgtaggccgggcgcggtggctcacgcctgtaatcccagcactttgggaggctgaggcgggtggatcacctgaggtcaggagttcaaggccagcctggccaacgtactgaaaccctgtctctactaaaaatacaaaaattagccagtcgtggtggtgggggcctgtaatcccagctactcaggaggctgaggcaggagaatcacttgaacccaggaggcagagggtgcagtgagccgagaccgtgccattgcactccaacctgggcaacaagagcaaaactccgtctcaaaaataaataaataaaataaaaatacaaaaattagccagacgtggtggcacatgcctgtagtcccagctactctagaggttaaggcaggagaatcacttgaacccgagattgcaccactgaactcccacctgggggacagagcgagactgtgtctcaaaaaaatatatatacaggaggatgtgtgtaggttatttgcaaatactacactattttctataagggactgcacattcatgggttttggtaagcatgggggtcctgcaactagtccccctcagattccgggggacagatgtgtatacgaggtgttttcctgtgtagtactactgtgtagtaactccctgtaggcagggagtgttgacagcatgggtagcctgggcaaaggggtgattcacgtccctggaaggagggagtgggacggtgggagttttcatcatactgctcagaatgctgcacaatcgaaaactatgattttttttcttttttgagatggagtctcactctgtaccccaggctgaagtgcagtggtgcaatctcagctcactgaaacctctgcctcccagttcaggcaattctcctgcctcagcttcccaagtagctgggattacaggcatgcaccaacatgcccagctaatttttgtatttttagtaaagacagggtttcgccatgttggccaggctggtctcgaacccctgacctcaagtgatccacccacctgggcctcccaaagtgctgggattacaggcatgagccaccgcaccaagcctggagttttccatttaatattttcagatggtggttgaccatggataactgagacttcaaaaagcaaaatcactagacatggtggctcacacctgtaatcccggtactttgggaggctgagatgggtggatcgcttgagtccaggagttcgagaccagtctgggcaaggtggtgaaacgctgtctctacaaaaaaatacataaattagctgagcatggtggtgcatgcctatagtcccagctactcaggaggctgaggtgggaggatcacctgagcttggggagtagaggctgcagtgagccatgatcgtgccactgcactccagcctgggcaatacagcgagaccctgtctcaaacaaacaaacaaacaaacaaacaaacgtgcaaactgtagctgagaggggactgctgtaggtgcggctatatcagtgtttttaagcataaggccactgatccaggccagaacccagggtgggatttgcgctcattacatttgcacagggagctcctctggcccttgttggattcactcatttctgctcatggctcaaagagggagaggctaggtcaggacagcccatctcagctcctgcagaagtagaaaaacaaattgtgcaccttaggggcatttagaactcttagggttaccctgaaccagtccaaataaacaagtccttcattaaactcagatcgctctgcgagggcgtttcactcctagaaaggacactataattacctccagtctgactcttcctatcagaggttagatttctgagcaagtgttggatacataactttggagggacttggctacagacgctatatttaatccactgccatgaataatgcctttgtgttctgtatgaagcccaggagatcttatcaatcgtgcagaggtagccagtcacgtcactttatttgccaccgtgcatgctttgcagagtcctcttctgggatgccttcctcatggttactgcgaaggctttgatggggaagggggctaagagttaaccttgaggcggggcgtggtggctcatagcagtaatcccggcactttgggaggccgaggtgggcggatcatttgagctcagcagttcgggaacagcctggccaacatggtgaaaccctgtctccactaaaaatagaaaaaattagccaggcgtggtggcaggcacttgtaagcccagctactcgggaggctgaagcatgagaatcgcttgaacccgggaggtggaagttgcagtgagctgagatggcgccgctgcactccagcctgggcgacagagtgagactccgtctcaaaaaaaaagttaaccttgagactccacgggagtcttacagctgcttagatagctttttgagaaatggttcagagctgcttgctttgatgccctcttcaacccatggcaaacatctgcttggtgatcttgctgctttcaaaaatgggatccattcctttaaaactggccaggccatgggagttggctgcgtgcctactaaataatatgtaaatactgttgttttgttgttgttgttgttgtttagatagggtctcactctgtcgccctggctggagtataatggcgtgatcatggctcactgtagcctctacctcctgagctcaagggatcctcctgcctcagcttcccaagtagctgggactacaggcccatgccaccacacctggctaattttttatttttttcagagacggggtttcgccatgttgcccaggctggtcttgagttcctggactcaagcgatcctcccacgtcagcctcccaaagtgctgggattacaggtatgagccatcatgcctggcccatacatattgtcgattgctttgcaaattgctctaagctgaagttatagctggtggaatgtagttttgccaaattactctttccgagtcattgaggcagagctggcaggttctgtgctgatacctcccgggtgtgtcgtcttgcccagctcctcccttgctctggcgatgtggggcatctccacccggatgtcctggtgacatttcacatgtggcaggtccaggcatgaattctcagcttctgccccagcctgcctccttccctccctgagactgtcccttgtcagtacctggcttcactgagtgggtggctcaagacaggagcccgagggcccatttcaccagcaagtgcagctcaaggtgcctctgcagactgtcttgtgtgggtcattgtccacactgtcactgtccctgtcactgacagagtgggccaggcccatgcaccttcctggaagacagcctcagcttcttaactggtcctgcttccccatccccatccatactccatacagcagccagagtggtctttagaaaagaaacagtggcaggttcccctttctctgggcccttggatgcttctccattgctagcacaaaaccctgccacctcccaccggctgcctctgccttcctctccaaactaggccccctgtccttgaacccagacaccctgtcgaccccagccacctgcgcttgaccctagacaccctacccttgaccccagctaccctgcctttgaccccagacacctgcttttgacccgacaccctgcccttgaccccgctggcctgctcttgaccttagctgtcccgccactgacccccccccaacagcctgtccttgacccccagccaccctgcccttgaccccagccacctgcccttgaccccagacacctgcccttgacccccagcctcctgcccttgaccccagcttcctgcccttgaccccatcctcctgcccttcctgcctccagctcttgcctgctcttcccatggttgctccttctcctggcttccctgtctcctgagaggtcccctcggcttctccccttcctgcaccagagcactgctcctgcgttgcttgttagcccggtctaagctgtgggagggcagagggaccttttctgctggtgtgcagctcttctcctcggctggcacgttggaggcagtcaacaaatatttgtaatatggacagatgtctgaagtcgggtgcctttctagggcctgccagcggatggttctgtgttttggctggtggaggactgagtcaggctgatttctgtaacaggggatctttgaaactgtgatagccactgattttgatctcaccttcagagggcatcagtgggcgaaaacaggaaaatcatcctgtggtgagaacacgcacacacacccacacacacacaccacacacacacacacagacacacacacccccacacaaccacacatcaccacacacccacacacacacaccacacacacacaaccacacacacgcacccacacacacccacccccacacaaccacacatcaccacacacccacacacacacccaccccccacacataccacacacacacccacgcacccccccacaccacacacacaccatacacaccacacacactcaccccacacacacaaccacacacaccacacacacacccacacacaccacacacacatatacacatgtacaccacacacacacaccacacacgcacacaccacacacatacaccacacacaccacacacacataccacacacacgtatacacacacacaccacacacacacacacgagtttttggatttttattatggtccttgaaagttttttcctcttagcttctcttttatccatttagtactttgtggcaggcagcttgggaggaggtggaggaggcaccgtgagaagggcaggagccaccaccccggggggtccaggaggggatgggggtgggctgtgttgtgctgagcggctgtgccaaggagcctgaaggaaggcggccggagccaggatgaagggtacaggaagaatgtagcagatccggaagcagttttctgcagccggccaggggatgctctccccaggggctgtgcttgggtctggactgcagcgccccgggatccgtttagcccgtggggccgccaaggcacgttccgtttcagccgctgcctccaaggaagaaggcccgctccgtctgtggacacccattcttgaggtgtctgcgcatatgactcatggagtcttcgtgggtctctccgaaaccctagaacagtttctcgaaagagcagccacacagacaccagaggcagaggcatttgggattgatctgcgctcgaagttcagagtctagggctgtcgtgggctccttcgtggactcctgcgtggacactctgggcctcttctaatgccagcctccaagggcctggctgcaagattgagatttgtctgtgctgtgcgagttgctgaagcgccgtgggctttacgtcagtaggtgtggcctggatgctggcttggaggcgtggttccgggggatgtccagggccagggttggggtaccacgggcctggatgctggcttggaggcatggttccgggggacgtcccagggccagggttggggtaccacgggcctggatgctggcttggaggcgtggttctgggggacgtccagggccagagttgaggtaccacgggcctggatgctggcttggaggcgtggttccagggaatgtccagggccagggttggggtaccacgggcctgactcctgatgatcatcttggggctctaagcagaggtggcgactgtctttgtagcggtggacaggcaagggggtgccagctgtggtgatggaattggtctgttgatgaaaagtattaaatctgttaagtggcgaggaagaacttaagttcagaaggaatggcacttctgtatgagggttttttagtgtctggtcacacgttccactgtgttacattttctccttctccttccaggtactctctgaagatggcagaagctcaccaagctgtggcctttcagttcacggtcactccggacgggattgacctgcggctgagccatgaagctcttagacaaatctatctctctggacttcattcctggaaaaagaagttcatcagattcaaggttttctgagatttgttgaaatctacacagtatgccttttaatatctaagaacggggctctggctgctattgaggtctacgtgtttcagactggcgactgcatatcacttacctgtttccatggtacttaaggcttggggacaccgtcacatagactttagctcactggatgcttggagcagttccattaggcaggtggagggacttggcatgcgttaaagcaggctgggaaatcgaggcttaaagggccagcgacctacttaataggaggcagagtaaagactagaattcacatcttctgctctgagtcagaatcctttacaccttgttcaaataggatttttccaggccaggtgcagtggctcacacctataatccctgcactttgggaagctgaggtgggcggattgcttgagctcaggagtttaagaccagcctgggtgacacgacaaaaccccatctctacaaaaaatagaaaaattaggcaggtatgttggcatgcacctgtagtcccagctactcaggaggctgaggtgggaggatcacttgaacctgggaggcagagactgcagtgagccatgattgagccaccacactccagcctgggcaacagagcgagactttgtctcaaaaaaacaaaaaaatattttttccaaacttcagcaagtggatgtaataactactttgtttataaaacattcacacattagaaactctctgcataaggtccgggtgcagtggctcacacctgtaatcccagcactttgggaggccgaggcgggtgaatcacgaggtcaggagatcgagaccatcctggctaacatggtgaaacccccgtctctactaaaaaatacaaaaaattagccgggcgtggtggcgggcgcctgtagtcccagctactcgggaggctgaggcaggagaatggcacgaacccgggaggcggagcttgcagtgagccgagatcgcgccactgcactccagcctgggtgagagagcgagactctgtctcaaaacaaacaaacaaaaaaaaagaaactctccacaagttcaaatacagttgagtccacatgttctcaattctgtttatctaaagaagtagaactttgttcttttttaagtaagtgtcttgtttttccatgtattttaatttattttaaacatcatagaaggaacaagtgcatgtttgaaaacatgcaaactaggtgaaagttcatcaagtcaaaagtggaaatccccccccgctgacccccctgccagccccagcggtaactcagttcagtttgtgcacttcccggtgctccttctccgagggcggcactgaagtgggccactgagaaaggcctaagctcaagagcaggtggcagcagggacagcatggcgggcaagcccctgggagccagtacagctgcacgggtgtccctggggctcagcctgtgggttcttgggcccagataaataacccaccaaggtgacatccgagatttcactgaggcactagctcggctcgccgagagctgctctttttcaccttggaatctgggaaaatagaaacttggatgcagaggcttggccatcatattcaacccagtgggaatgttgttctccctctcccctcccctcccctctttttttttttttgagacagggtcttgctctgttgctcagggtggagtgcagtggtgcgatcacggctcactgtagcctcactgggctcaggcaatcctcctgtctcatccacccaagtagttgggaccataggtgcacaccacaatgcccggctaattttttttttttttttttttttggacagagcctcactctgttgcccaggttggagtgcaatggcacaaccttggctcactgcaacctccgcctcctgggctcagtgattcttctgcttcagcctcctgagtagctgggactataggcgcccaccaccacacctggctaattttttgtatttttagtagaaacaggatttcaccatgttggtcaggctggtttcaaactccttacctcaagtgatcggcctgcctcagcctcccaaagtgctggggttacaggtgtgagccaccgcacctggcctgctttggtcatttttaatccattatcttggtgaaatcaatatcttattaggatggtttaggaagaattttttttaattggagttgtcaaacatacacaagagtgaagaggactgattaaagatccccaccattcccttccttgtttcaacaattttgccaattttgtttgatataatccttttttttttttggctggagtattttacagcaaattctcgacatggggtgaggtctcccatgaaatcttcagggttaagcagcccttctgacacaggggcggcaagaggagcagttttggaaccggggtctcggggcattctagacagtagcaggctggggacaggacgtcatggtggctcagtgacgtccttcaccagctaaactagtgcctgggctgattatcatggcccggggcgtcgactcttggggaagctttcagggtgggttttggctcggaagtagtggaagggaggaaactggaatcactgcaggctgtaaactctggggagagtcccagctagtggggtgtggtttctcagtgcacgcacgctgtccacaccctcttctcactgcctgctgtcccagcagccctgctgccaggggccatgaagcgtcattgccctgtgggttgtgggaggacaccgctcacggcccgggtgtctgtctttagaacggcatcatcactggcgtgtacccggcaagcccctccagttggcttatcgtggtggtgggcgtgatgacaacgatgtacgccaagatcgacccctcgttaggaataattgcaaaaatcaatcggactctggaaacggcgtaagtaatcctgtgaaatctccaattgtctgggaagttaccgattttattgctgtttttatgtctcttcaaatgtgatgattgtcactgttctggattccatatgaagctcctgatgctgttctcacgtcagctttcttcctgtctcctgggtgctgttaaggtccccctaggagtttgcggtcccctgcggcctttcctctgtagaccagggtgagaagagtggtagtggccctggggcaccccttggaaggtgtcagggcccgagggtttggtcaataatgacagtgcccttagcctggccaatagggctctgaaatggaatttctgctcaaagggctgattccccatgtagtcatttctttgcacttggagtctgttcattccagagttctgtgacccttgaactgactgctgtggggtcctctgcagggacctcacccacttaactctgtcagaatggtttagaaatctccagggacccccccgtccctcctacctctagggttttggattttcctggggcttatttcttgctaccaagagataagcccagagacaccttaggtaacattcagcacatgttcattttattttttttttctaaccacctgccgcctgttgatagcacatgtttattgcacacctgtgatgtctgttattccatccagttctggagatggcccagactcccatctaggaaggtcagagcctgcactgcagtgacctctcattagggtcccttttaccagtgagaaagcattcagacaggtgcaggtgtctgcccaagtcacaggaagagggagcggggaagctagagttcaaacccagctctgcgcagctctgaaatctgtgctttcttcagtgtagcactgaggtccccccaccccctgccccagaagcttctgtgagacaaatgcgagtgaacaccgctgctttaccaccatttgaacgtccagacagtggaacgcagggcaactcagcttcctcgtgcagccgtgacccttgggcttggacacacattttactttcgggtctgaaagctccacagtgtctcggaagtgtccctgctgccccgtgccagacgtttgattcgatttctgtgctgcttgtttacaccaatggcatttttgccatttggacacggtggttcacacctgtaatcccaggactttgggagaccgaggtgggtcgatcacctgaggtcaataatagccaccaactcctcataattgggctttgttttggggccaggaattgcaggtggaaggcacaatgccgggtctgggctaagctaaaaaacgaagctctggatctttatagtcacgccttccaggttgtttgcatataaatattgtttaatcagaaagaaataagaaaataaaccggcagaaaaagagacgtaaacgaaaactcactcacagttaacggctgaatttgatttttttttggaaatggagtttttgctccgttgcccaggctggagtgcgatggtgcgatctcggctcactgcaacctccgcctcccgggttcaagcaattctcctgcctcagcctcctgagtagctgggattacaggtgtccgccaccatgcctggctaatttttgtatgttttgtagagatgaggtttcaccatgttggccaggctgatctcgaactattgacctcaggtggtccactcgcctcggcctcccaaagtcctgggattacaggtgtgagccaccatgcccagccttgattctgatgactagaaataaaagattaagcagattaatggtctgagtctcctgatgacagcttgagcaagtgccctgattcctgaacctctttttgcgaagggtctgcagaggacccctccacatcctgttccttctccaggaagcccctggaccctccagagtcatcgagcgtccagctgagttgcttgcaaccttgaggtagctcaggaacgctggctcaggcctctataagagtctgcaagaaacataataaaagttcccagtcattttagcagaagcatgcctggctgggacgcctgccaggttccttgtctgcctgggtactgctgtcattgctgtcactcagaaagcagctggcagacctgggtgctcagggcaggcctggctgctctcttccttgaggtcccaggacccacaggcctgcggtgggtagctgcctccgagccttgtgtctggagctgttcctacgtacttttcattctctcatggggctaatgaatatcttcttttttttctttttgagatagagtctcactctgtcacccaggctggagtgcagtggtgcgatctcggcacactgcaagctccgcttcccaggttcaagtgattctcctgcctcagcctcttgagtacctgggactgcaggcacatgccaccatgcccaaccaatttttgtatttttgatagagatggggtttcgccgtgttggccaggctggtcttgaactcctgacctcaagtgatccacccgccttgtcctcccaaagtgctgggattacaggcgtgagccactgcacccaggccagttctttaatttactctctagtgtaggcgctctcttaaaactggattatatatagaagtgttgactgtttaaagcccttaataatctgggtctttgtaagatttgtttctttgtacctcttaaacctattttggtaaactgggccatccctggcctaaatttagaaaggccgggttaagggccaacgtcttccagcctcatgggccatttcctgtcctggaggggatctgcagtatctctgggctgctgccttcaaaagtggagtcaggctgggtgcggtggcctgtaattccagcactttgggaggccgaggcaggaggattgcttgagcccaggagttcaagatcagcctgagcaacatagtgagaccctatctcttaaaaaaaagaaagaataaaaaagtggagtcatccgtgtcatgtgaggtttgtctctgagtttgtccccgacagccttgtaaggagcatgtcctttcaaagaaagctttttgctaacgttttttatctgagtgcctctatgtctatacttttaaaaatcttgaatgtgtcatttatttgtttatgctaaaatatttttatttttgcaaatcaagtaagtatataggtctttttctttcagtaatctaaaatgtagattatctaaaagatagcttcttaaatccctaaacccaagtttgtttataggttagatgaccagaaaagagtgtataggtttaaagaagagactacagtgaaactccagtgctagatttcacgggttatagaaagatatacattttggagcaaagagtatataaccttgaagataatttgtttttgtccacttaaatattatgcagtgttaaattagtggttttctttttttatttcttattttgaagaaatatttattattttttatttttattattttttatttcttattttattttcttttttaaattttatttttgtattgatggggttttgccatgttgtccaggctggtctcgaactcctggacccaagtgatccacccatctcagcctcccaaagtgctgggattatagacttgagccactgcacctggccaaattagtgcttttcaaatattagggacacctttaggttatatatattggtgttttaatcatttgaagcatgcttaaatagttttcatttaaaaaatattttgcagttcccaaaacaaccaaaactaaaacaaaccacaaaatagctgcatttctggccaggcacagtggcacacacctataatcccagcactttgggaggccgaggcgggtggatcacctgacaggagtttgaaaccagcctgggcaacatggcaagaccccatctctacaaaaaatacaaaaattagttggatgtggtggtgcgcacctgtaatcccagctactcaggaggctgagatgggagaatcatttaaacctgggaggcggaggttgcagtgaaccaaggtcacaccattgcactccagcctgggcagcagagcgagactcttgtctcgaaaaaaaaaaaaaagctgaatttcatctcatttttaaagtcccatctttaccataatatatactaccttccttcacaaacaaaaacatttcctgtatttaagttgaatatttacatgaccgttttacacagtccgtttctttatttgtgttaaatacacctaagtcaaaaacaagctcttttgatataaatactggaggtaacagttgtaacaaataatttgagattacgattacatctaaaagtaagtttgagagaaaaaaattcatcaagagctgaagaaagtggcccagaatctcctgcgcacctgccggggacgcacaggtcggcagggcatggctctcacggtggccaggtcctggcctcacagcatcccctctgccgttggtcctgaggtcctggaggaagctgtatctttttccagaagacacaaattagccctggttggtttcgaggccacccgagcagatcgggctgaagggacctctgggaagagagcaaacaggcccgccccgggcgcctgggtctgccagctactttcggcgtgattggttttggggtgaggaggagagtgcccgtgagtgttttaagagctcagttcctgcaagtgctctccctctgactttcccggctgtacctggggcaggctgctggaccctgcagcacgtggtgtctgtggcgtcaccggtggtgttggtggcaccgtgtggcctcacgcacagcctcccttgtctgggtctgtctccacagcaactgcatgtccagccagacgaagaacgtggtcagcggcgtgctgtttggcaccggcctgtgggtggccctcatcgtcaccatgcgctactccctgaaagtgctgctctcctaccacgggtggatgttcactgagcacggcaagatgagtcgtgccaccaagatctggatggtaattgcgtgtccctctggctgtggagggggtggacagtttgggctttgggaagaaggacacccctgcggaaggacacccctgcgaccttttctccctctatgcttggttggtgacttgggcctcaaccttgaatggctggagaggtttgagtcaccatgacacaaaagcaggggccaaagagtgcttctcttttgtgacattagtgagacctgcagcattttatattgaggtctgctcggtttgtagttcaggtcattcatcaaataaaagtgctgtccatccggttctttgtagtgttcttgactcacttgttgtcaggcattaaatggttaccttagctgacccctcagacaggctcccgtgactcagacttagcttctggaatgttcctccagcttgctttggccctcagcccaagggtcccttatttaaggtaatggctttgccatatatgtggatgcttgtccaaatttcatgatttaaatgtttttcttttttatttatatttatattttttcattttagttttttttgagatggagtttcactcttgttgcccagactggagtgcagtggtgtgatctcagctcactgcaaactctgcccttccaggttcaagcaattcttttgcctcagcctcccaagtttctgggattacaggcatgcaccaccatgcctggctagttttgtatttttagtagagacggggttttaccatgttggtcaggctggtcttgaactcctgacatcaggtgatcctgccttggcctctcaaagtgctgggattacaggtgtgaaccactgtacccagcttttttttttttttttttctttttgagacagggtcttgttccattgcccaggctggagtatagtggcaccatcacgtctcactgcagcctcgacttcctaggctcaagtgattttcccacctgagcatcctgagtagctggaactataggtgtacaccaccatggctgactaatttttatatttttaatagagacggggttttgttggccaggctggtctcaaacttttgagctcaagtgatcggcccaccttgacctcccaaagtgttgggattacaggcatgagccatcacacccggtctcaatttaaatgtttttatgggggctgggcatggctactcatggctgtaatcccagcactttgggaggccaagcccagtgaaccacctgagctcaggagtttgagaccagcctggggaacatggcaaaaacacgtctctactaaaaatacaaaaattagccaggcaaattagccaggcgtggtggtgcatgcctgtaatcctagctacttgagaggctgaggtgggaggaatgcttgagcccaggaggtcaaggctgcagtgagctgtggttgtgtcactgcactcctaggggacagagccagaccctgtctcaaaaaaaaaaaaaaaaaaatttatgggcttagtttttctgaaaatcaaccctccaagatgggcatcgtctctggactttcgaggcctccgtctggggggctggggcccctgtgaccccctgcaggcgggtgtgtgccccgtgtaccatctgcccattgtagtcatggccctgggccttgggctttgctcggcacctcaagcccaacctgggtttctggggccagatgtgtgtaaagaaacatctgctttattcacccctgtcttgccaagtggcctaaatggttgtaatggaccaggtcatcatggaaacattttctgcagaatctttctcgaatggggctgatccgtgggtctgccggtgtatacgaagccgtgggtctgctttggtttcttgtctgccccgaccttggccccggtgcccttctgcttggtcgcctcgggatggcccccacagtggtgcctgcctggactgggctgctgtcccaacctctgggggagcctgcttgtgagagaagcatgggagtcactgcagtgcccaccacacaccgggactccactctttgccaaacaaatttttttttttttttgagacagcatcttgctctgtcacccaggctggagtgcagtggtgcaatctcggctcattacaacctccgcctcccgggctcaagcgattctctcacctcagcctccacagtagctgggaccacaggcacacaccaccacgcccagctaattttttgtatttttaatagagacagggtttcgccatgttggccaggtggtctcgagctcctgggctcaaacgatccaccctcctcggcctcccaaagtgctgggatcaacaggcgtgagccaccacacccagccaaaccaattttttctctcaaatcaattttctaccatttggatataaaatttctgatttctagagaagcagaatttaacacctagaagagactcaggggtggctcccacacttggcaaagcaggctaaagggcactccctccagtgggttcacagctgaggttcagctgagtcccaatgccctgcagtaccaagactccccgcctgggcccaaggactgcctttgttttggttgccattgaggtgactggttattatacaggcttgatcatccagcctaaaaccaagggccacagatgtgtcctctgggagacttggcaatgactgaaggaaagacactgcttcccctcggcttggctcagggccaggcacgttgaccctcctcactgttcctagagcctggagcccatcccgaaactaagggccttgcggaaggaggtggggtgagactcaccctaggtgcagaagcacggtcagggtcctggccagtcacgacgctggcagcgacatctcacggcctctgtcaggcttggctttgattctacctggttttttggtttgtttgtttttgttttgctttttgacatagggtctcactatgttgcccaggctggagtgcagtggtatgatcatggctcactgcagcatcaccctcccaggctcaatcaatcctttcacctcagcctcccaagtagctgagacaacaggcacatgccaccatgcctggctaattttttgtagaggtggggttttgccatgttgcccaggcttttattggcatggagggcagggttatatgcttatttgctagaacctgtaagtatggggcgggtaaaagatggaccagatgaaaaataaattgacacagaaaatcagtaagtggttggcacattgtgcgcacgggaaaagtggcttcggatctttaacatagccttgtctttgaaatggtcattctcccatccaagtactaaccaggactgaccctgcttagcttcacgagatcagacgagaacaggtgccttcagagtagtatggcagtagtctgaaaatataattctctctcttcagggtatggtcaagatcttttcaggccgaaaacccatgttgtacagcttccagacatcgctgcctcgcctgccggtcccggctgtcaaagacactgtgaacagggtaggtgtggcttaggcctcacactgaaatgccagccatctgtggattaaggcttaggtcttaattatgatgaactaggtcaccgccatttggctcaagtagccttcagcggtgtgcctggtagggttctcataggaactcttttttttttttttctccaatgcatcactgctgcatcttaggtgttttttaaaaagtgtcaggtttcatagagaaactgcttgtgaattttttaaagctttattttattttattttattttattttattttattttattttattttttgtgatggactctccctctgtcacccaggctagaatgcagtggtgcaatctcagctcactgcaacctccgcctcccaggttcaagtgattctcctgccccagcctcccgagtagctgggattacaggcacctgccaccacgcccggctaatttttgtatttttagtagagacagggtttcaccatgttggccaggctggtctcgaactcctgacctcaagtgatccacccgcctcagcctcccaaagttctgggattacaggcatgagccactgcaccaggccagtttttgctactttacataattactaaatacaacattgtattaaatgattgcagtcactccccattcttccctccccccacctagtaacttctcttctactttctgcctctggatttgccaatctgagggacctcatataagtggcatcatatcatatttgtccttttgtgactggcttctttcactcagcaaaatgtcttcaaagttcatacacatagcagcctgtgtcagaatttccctccttcttatggctgaatagtattccattgcatggctagaccatattttatttatccgttcatctgttgctgggtggcgaatgtttttgatctgattggtgagggtcaccagctgagggtggggtgatagtcagcttctagccggtctgaggacagggtgcttcttgacacagcagccgcacttcaaagccaggcccccaggggcaaggcactacctagaaagcctgtcatttcatcctcaaagctactcatttctttttcattttcttttttttttttttttttttttttgagacagggtctcaccctgttgttcaggctagagtgcagtggcgcgatcttggctcaccacagcctcaacttcctgggctcaaatgatcctcccacttcagcctcctgagtagctgggactacaggtgcatgccactacatatggcaatatttttttttttttgagacagaatctcgctctgtcacccaggctggagtgcagtggcgtgatcttggctcactgcaagctccacctcctgggttcacaccattctcctgcctcagcctcctgagtagctaagactacaggcccctgccaccacgcctggctaatattttttttttgtatttttagtggagacggggtttcactgtagccaggatggtctccatcgcctgacctcgtgatctgcctgcctcggcctccgaaagtactgggattacaggtgtgagccaccacgcctggccctattttttttttttttccagagacggagtttcactgtcttgtccaggctcgtgttgaacccctgagctcaagtgatctacctgcttcggtctttttttttctttaattgaacaaaaggagagggagcagctccatttctttgtttttaaaaaaattatggtaaaatgtacacaacatgaattgtactgttaaccattttcaagtgtacagttcaggggcactaagtacatttataatgttgcgcagccctcactgctgtctcgttccaggacctttcatcccccaaaagctcatagccactaagcagtcactccccatccttctacctccctctcccagcccctcagaaccactaatctcctgtctgtctgtatggatttgcctcttctggacatttcgcataaatggaatcacgtggccttttgtgactagcatgtctttagagttcacccgtgttgtaggatggatgaacttcatccctttttgtggctgaatagtgttccattgtatggaaggaccacagtttatccacctgttcatccgctgttggggacgtatccaggagtggaattgctggctcatgggaattccgtggtaactcattgaggaaccatgagactctcacgcagctgcaccattttgcattctaaccagcagtgcatgggtgctttagtttttccacatcctgggactccaattttaaaactataataataagcaaaaacttctcgggttaagggtttgaatccaggcttggttactgagtccctgttggccttggtaaggtcttcccatctctgctcttttttttttttttcagacagagtcttgctctgtcacccaggctagggtgcagtggcatgatctcagctcactgcagcctctatctcccaagttcaaacaattatcttgcctcagcctcctgagtagctgggattacagatgtgcaccaccacacccggctaatttttgtatttttagtagagacaggattttactatgttggccaggctggtctcgagctcctgacctcaagtgatctgcccaccttggcctcccaaagtactgggattacaggcacaagctaccatacctggcccaccccatctctcctcttctgtgcccacgcttgcaaatcagggctgatgacggcccctgttccactggcaggatggggtgagcaagagatgcttgaccttcagtgacctctgtctgtgttgcgtagctcggggttccacttcagctcattcagggcatgattttctgtctcattcacgggcattttactttgaataagcctcaagatgcttgacacctgccccctcccccttttttttggagacagagtctcactctcttgcccaggctggaatgcagtggcaccgtcctagctcactgcaaccttgaattcctgggcccgagtgatcctcctgccttagcctcccaagtagttggggccacaggtgtgcaccactatgcctgcaaatactttcttgtagagacagggtcttgccatgttgcccaggctggtcttgaactcctgggctcaagcagtcctcctgattcagcctcccaaagtgctggggttacaggcataagccaccgtgcccagctacagctggcccttttaagggagtggggtcttacttttcaatgtacagggagggactatagagagattactgttgcaccaagctttgttttttacagcagacaaacaacttgtcggattaaaatatgtcatgacaaattgtggggttagcaacagttttactttttgttgctgggggaaacagcatctcacccaggctggaatgcagtggtgtgatcatggctcactgcagctttgaactcctgggcccaagtgatcctcacacctcaaccttccaagtagctgggatcacaggcacatgccaccgcacccagctaatttttgtattttttttttttttttttgcagagatggggggtctcactctgttgcccagggtggtcttgaactggtcaagattgcttgggctcaagcactcttcatacctcagcctctcaaagtgctgggattacaggtgtgagctaccacacctgaccactgttactttctgtaagagcttgcttaggtgtgtagcagaagcttttgagtgtctttttaaacaattgctctctgtgtttccacctctgagcatttgttcaaccaaagtagcacatgtaaaaggacgaggcggggtgggggctggaaaccctgaacctggggcactggccttagcctggttccgtgacctattccagcccctcgttcccatcctgctgcctgagcacctgcccagccccagcacccagctctcagcatgactctgccccatctcatggtcaccatcgcaggtcatcaaaacttacttaggtcagaacagatcttttattaagggccaaataatagataagagacattcttgaaatttccttgttaacttttcttgtcaactctagaatttattttaaattctaaaaatttaatggtgattttctggtgatgcaggatttgggacacttttaaagctaataaaggaagaaaaagtttaattgttaaattatcattaccctatgacaccatttagcattgaagggagtttacctgtctaaggactgccaagaccaacttgggggaagagtctaaactttttcttttttttttttgagatagggtctcactctgttgcccaggctggggtgcagtggcatgatcatggctcactgcagccgcaaccttctgggctcaagcgatcctcccaacctcagccccccaggtagctgggaccacagacatgcaccaccatgtccagctaatttttgtcttgtttttttttgtagagatggggtttcaccatgttgtttaggctggtcttgaactcctgagctcaagcaatccactggccttgacctcccaaagtgctgggattacaagcatgagccaccatgcccagcctaaaaccttttcaatgtgttagaacttttcctaaggcacaagtgaggcaaacataggctttgattaatatgttttaacttgggtgattttttttttccccaataatcccagtatctacagtcggtgaggcctcttatgaaggaagaagacttcaaacggatgacagcacttgctcaagattttgctgtcggtcttggaccaagattacagtggtatttgaagttaaaatcctggtgggctacaaattacgtaagtctgtatacacagtttttcttgatgaaatagcgtccgtatgaagacgctaattttgaggggcagggataacagggctgaaatgacagtttggattagccaaaatcacaccctaggaagttccagctatagttttacctctgtgcagagtggagtgtgtgtgtgttaggactgacgtgtagttacagtgacagtttcttggtttttggatttttttgtagagacagagtctcactatgttgaccaggctggtctcaaactcctgggctcaagtgatcctcccacctcggcctcccaaagtgctgggatcataggcatgagccaccacacccagcctacagtgacagttttaccctgagtgcaggtacaccagcacgatgctgtgttttgcacgcaggaggcttctccctctccctcttccccggagagtcctcctgtgagctgtttctcctgcagcagtgccatgctgccccagagacctgctcccatcctcctctttggtttatcttgattccaagggcatccttcccgagctcgctggtggatgcagggatggtgtgggatagggcggtgctgatcgcccctccctggggttgagtgtggctcggtggtcccaggagcatctcctccaacgaagcgtcttagctggcaccctgtgtgcggggagctggctgggcttccacgtactgggagggcaagagcaggcctccggcagacaaagcaagggagggagtctagctttgaggaacaactaacacggaagagaaggtgtccaaagcgaccctgacagaaccagcaggtggcgctagacgtggcatggtgggtggatgggcagtgcctggaggggtctctctagcctcagggggccgggcatattcgctggctgcaccggtgtgctggactggtaaacgtcagctctctgcacagctctccgcacacgaggcccttgcatgggcactgttctgtaggtacgtgtgtttcagcacaaagctgaaaggaagcgatccctgggtccagcaggctgtgaagggacagcagctgtgaggtggttggggggcactgcctctgggtggcctcaggacacatgtgccagggaatagagacaacacctgcggaacaccaggttagtgccacggactgggacggtggcttcttcaggcagacctgggaagcagtctgtggagcaattttgcataacattggttttttctttgttttcttttattttctttagtttctgagacaaagtctcgctcgtcacccaggctggagtgcagtggagcgatctcggctcactgcaagctccgcctcccaggttcaagcaattctcctgcctcagcctcctgagtagctgggattacaggcgcccgccaccacacccggctaatttttgcatttttagtacagacggggtttcatcatgttggccaggcaggtccggaactcctaacctcaagtgatcagcccgcctcagtctcccaaagtgctgggatgacaggcgtgagccaccgctcctggcctttgtttctgttttcttttatttgagaaagggtcttgctctgttgcccaggtgggaatgcagtggcacgatcatagctcactgttgcctggaacccctgggctcaagtaaccctcctgtcttagcctcccaagtagctgagactacaggcgtgagccaccacacctggctaatttcttaaaattttttggagagatggaaccttgctatgttgcccaggctggcttcaaactcctggcatcaagcgatcttcctgtctcaacctcccaaagtgctgagattacaggtgtgagccaccatggccagcccatagttttggtttttaaaacatgttagcagtcagacatttatgatttactttccatttggtctcttaaacatttttaaatttttattttatttattatttttatttttaatgtagggctagagccttgctatgttgcctagcctggtctcgaactcctggtctcaagcaatcctcccacttcggctttttatttcccttttgaaccatctacaaaatgaaggtgatgtaccttctttctgcctgtctcaacttaaaaagaacacttttcatttcccacggtgtcgcattccatctagttaggactgcgttccctgttctggaatggcccctgttagacgccgaaatgtctgccaaaagcactgcctgcccttccccgcggctctgggctgctgccagggagcctgcctggcccctgctgagcctgcgggtttgtctggtgtttgcgcccactaggtgagcgactggtgggaggagtacatctacctccgaggacgagggccgctcatggtgaacagcaactattatgccatggtgagtccacccgcccgggctgctgtctgacgaggacggtggggcggcgggtctgtccacagaggtggcgtcttcacaggcctgtggacggcctgggaaaactctggggattggctcatgctcctctctgtcctgcttccaggccggagaaccctatgagtacccttcagtgttagcctagtagcccagggtgctctgctactgcagggggatttgggttgcaaaaataagtttctggcaaacaggaattcctcactgtgctgtacctgtcctgctgtttttttgttttgttttgttttgagatggagctttgctcttgtcccccaggctggagtgcaatggcacgatctcggctcactgcagcctccgcctcccaggttcaagtgattctcctgcctcagcctccaaagtagctgggattacaggtgcccaccaccacgcccagctaatttttgtattttagtagagacggggtttgaccatgttatccaggctggtctcgaactcctgacctcaggtgatccacttgcctcagcctccctaagtgctgggattacaggtgtgagccaccgtgcccggcctgtcctgctgtttttatggcttagcactggaacttggtgccacagcggccttaagatccctgcagaacccctagagctcagggacagtgggttggccaagatcctgccaccagtgcgctgcgcttcaccctactgttttctgagacgccagaggggtgtgcatcgacggtagtttctggtttcctgggctttgtctttcaaagcatggatggttagaaggcctctcagtttgggttcttgaccactgctttaataactggcaaatagaactcttctctttccttttccttccattccttcacttccttttatttttttccctcgtttattttttaatcatttactttttcttttctttttttttttgagatagagtcttgctctgtcgctgaggctggagtgcactggtgcaattcatctcactgcagcctctgcctcctgggttccagcaattctcctgcctcagcctcccgagtagctgggattacaggcacctgccacaacgcccggctaatttttgtatttttagtagaaacggggtttcaccatgttggccaggctagtctcaaactcctgacttcaggtgatccgtgcgcctcggtctcccaaagtgctggattacagacatgagcacctggcctatcatttgctttttctttctgtttttcttcgtttcaaaattgtcctttctttttctcttaactttttttttcccatctgaaataatctcaaactgaaagaaaaaccgttagtgtagtccatagaacttcttttcctgctctatttggaagtgagctatttatctgatgcccttcccgccaggagacctttgtttatttcccacaaacagaggcactttctacatcaatggggacatggtgtgtacatagactcttccaaaatgtaggttagacctgtgttccttggccttttcttccaattgtggaaaatgcagacatttggaacagggtctcaaaatttagaaagctgcaggcacagctctatataaacaactattttaacctttcattgtgtctcatccagaaaacttcctgattgtctaattgctccccgactaatttttgctttcctttctctgtgttacgtgagggtatttggtgcaaatagttatctttaatagcgcagaagttttagaggacttatgttctcataaaacatttacaaagtcaaagtggagaaaatcaaattaccatttattttgtagcattgcagatgtaaccgaatatgtatgtatattgatgcatctctagaaatattgtgacagtgtgcaggatgtgctgtgattatttaaatttgcttatctttccctatgcaaattctctccacctttgtcgcttttcaggatctgctgtatatccttccaactcacattcaggcagcaagagccggcaacgccatccatgccatcctgctttacaggcgcaaactggaccgggaggaaatcaaaccagtaggcaaacaaattgctttaaaaaaattattttcaaacagctttacagaggtataattgacatattgcacatgtttaaaatatacagtttgtggccgggcacagggtctcacgcctgtaatcttggcactttgggaggccaaagcaggcggatcatctgaggttagcagttcaagaccagcctggccaacatagtgaaaccctgtctctactaaaaatagaaaaattagctgggcgtgctggcacgcgcctgtaatcccagctactcgggaggccgatgcaggagaatcacttgaacccaggaggtggaggttgcagcgagccaagataacaccattgcactctagcctgggttataagagcaaaactccatctcaaaaaaaaaaattaaaaaataaagtgtagagtttgctaacttctgatgtgtatatattgatgcatctgagaaaccatcatcactgcagtcaggatggtgaatacatcagtcaacccgaaaacccctctgccctttgtcatctctccctcccacctggtcctggaccccctggtctactatctgtcactctagattagtttgcaatttttaaagctttgtgtaagtggaatcataacagtatgcactctttttttcggaattctagtttctttcacccagcctaattattctgagatgtaattctccttgtgtctcctaaatgaatatacatctgttgtactttaattctgtaatctgccctttggagaagcccttgatgtttttgaactaatactagctgcttagttgctcataagaaacaagacttttcttcctggaatatttctttggttgtaagtgtcagttatcaataatcaattagaatgtgttatttaggatttaactgtgcaggaagttgcaccctggcatggtttaatgagtcccccaacgaatcattccagggagccactggaaaagaggaagtcaaacgaagcaattcgcacagaaaacacattcagcatttccatgtggtcttaacttgcttgctgcttgctgcttttgttttctttttttttttttttttgagacagagtctcgctctgttgccgaggctggagtgtagtggcacgatctcagctcactgcaggctctgcctcccgggttcatgccattctcctgcctcaacctcccaagtagctgggactacaggcacccgacaccatgcccggctaatttttttgtatttttagtagagacggggtttcactgtgttagccaggatggtctccatctactgacctcgtgatccgcccgcctcagcctcccaaagtgttgggattacaggcgtgagccaccgcacccggccaacttgctgcttttcttctgtgggattttcgttgttggtttgaaatatatttttgttacagattcgtcttttgggatccacgattccactctgctccgctcagtgggagcggatgtttaatacttcccggatcccaggagaggagacaggtgagtcaagcttcttcagggccccctggagaatcggcactttccatccctatgctcagaattaggaagtgtcaaaggggccaaattgatttttgctgacccttcctgagattgtaggctggtgaacattccttctgctgaatttcctttgtctgtcttaggcctggacactgttgttgacttatttccagattttaatttctctttggttgaagactgccaactgtctcatagagtgtttgatttatttatttatttattttgacatgaggtctctctctgccacccaggctggagtgcagtgacatgatcacggctcacttcagcctccacctcctgagctcaaggaatcctcccatcttagcctccccagtagctgagaccacaggcacatgcatcatgcctggctaatttttgcattttttatagagatgaggttttgccgtgttgcccaggctgatctcaaactcctggactcaagtgatccgcccgcttcggcctcccgaagtgctgggattacaggcgtgagtcacacacagctgagtgtttttttcctgagtctggattcctcaggggcattttactccggctcacagtcagcgtttgtgatggaacgcacactgggtcgtgctcggaaaggtggatttgtgttccagccactcctttatcagctgcctgacctgggcagggtggccacgtaagccaccgtccaaaccaggacgtccttgagaatgacagggagggagaacaggcaccgtggggaacatccaggccaggcccaggcccaggctgtgctgtccatggcctccatttccccaggtgcctgtggatggggaactacccagagacacttggtgagctagagcccaagaccatcatggcaggcctgtatgacgggcgggcctcggggctgcttgggaagctggctggaaagggccagagctgacctgcaattttatttatttatttttttttagagggagtctcgctctgttgcccaggctggagtgcagtggcgcgatctcggctcactgcaacctcccacctcccgagttcacgccattctcctgcctcagcctcccgagtagctgggactataggtgcctgccaccacgcccggctaattttttatatttttagtagagacggagtttcaccgtgttagccaggatggtctcatctcctgacctcgtgatcgtcccacctcggccttccaaagtgctggaattacagatgtgagccaccatgcctggcctgacctgcagttttgagtgtcttgttgcagcccggtccttccagaccaagccctagtcaatattccagaccaagccctagtcagtagtgtgcactgtggtggtcattggggagcctttgctgtatccttgcacaaaagctggcctctgagtgggctttcctaagcagattctcccctttcctctgatcctgccttcagaggttctctaaaaacccattctggccaggcgcggtggctcacgcctgtaatcccagcattttgggaggccgaagtgggcagatcacctgaggtcaggagttcaagaccagcctactactggtctacaaaaccccatctctactaaaaatacaaaattagccaggtatggtggtgggcacccgtaatcccagctacttgggaggctaaggcaggcgaatcacttgaacatgggaggtggaggttgcagtgaactgagattgtgccactgcactccagcccgggcaacaagagtgaaacttcatctcaaaaaaacaaaaaagaacccactccatgtgtgttcacggatttcacagtgtttctggctaaacccctcctctcttcctgccacacactgtcgtccattgtactgtagctcaacatgtgaaaaacagatgtgttggccaacagcagtcctggggcagttgggcaacgaggtggaggaaagtgaagttggttctctccatcctctcacagtgtctccctgattggaggggcagttgccccttcactgaccagggcaggcagtgtccccaaagggaagtgggtcagggtgtcctggggaggctgtcacctgctgtcagtcagcaccgtggtatggggacatccttaagatcatttaagtttgagacatgcggcctacactgacagtgattccaggaggtaaatatgtatgtgtttaaaaaaataaacaagggaggccaggcacaaaggctcattcctgtaatcccagcactttgggaggccaaggcaggtggatcacctgaggtcaggagttcgacaccagcctggccaacatggtgaaaccccatctctactgaaaatacaaaaattagccaggtgtggtggtgcatacctgtaatcccggctactcaggaggcagaggtaggaggattgcttgaacctgggaggtggaggttgcagtgagccaagatcatgccactgcactccagcttgagtgacagagtgagactccatctcaaaaaaatatgtatatgaaataaaaataaaataaatcaataaacaagggaaatgctgggataaaacctagttacttagtgtacctggacagccattctgagcatgatacctgagtcagtttcttggggctgctggaataaatgaccacaaactggatgtcttaagacaaaagaagtttcttctgccacagctctggaggccagagtccgagatcaaggtgtcagcagggccgtgctcttttcaaaggctctgggggaggcctttatgcctcttccagcttctgggggggtccaggtgctccttggcttgtaggcatatcactctgatctctgcctccatgtcaccttggctctcacctctgtgtgtgtgtgtctctcttacaaggacaacagtcattggatttggggtccaccctagtccagtatgacctcatcttaatattgaattatatcagcaaagaccctatttccaggccagatgtggtggctcatgcctgtaatcccagcacattgggaggctgaggtgggtggatcacctgagcccaggagtttgagagcagcctgggcaacatggcaaaaccccatctctacaaaaaatacaaaaattagtcggacatagtggtgtgtacctgtggtcccagctactcaggaggctgaggagggaggatcacttgagcctgggaggtggagactgtagtgagctgagctgtgatcacaccactgcacttagcctgggtgacagaatgagaccctgtctcaaaaaaagaaaaaaaagaccctacttccgattaagaaataaggttttcacaggtaccagggctagaacatggacatatcttttgggtagaaacagctcaactcattacaacaacggaaaaatccaaatattgtcatgtaaagattttagttttctatatttcaaaaatacttcaaactgttttaaaaggtagataacaaattgagggtaagtgctcacaacagagaacagggttaatatgtaaagagttcttataaatctgccagaaaaccatgaagatcctaattggaaaggaaatgatgggcacccctggaaggagaaatgtttaaggagttatagaaaagcattcaacatcactgggaatgaaagaaatgtaaatacaaagcctgggagtggtggctcacgcctgtaatcccagcactttgggaggccgaggcgggtggatcacttgaggtcaggagttcgagaccatcctggccaacatggtgaaaccccacctctactaaaagaaacccacaaaaattaaccaggcgtgatagcagatgtctgtaatccctgctactcaggaggctgaggcaggagaatcacttgaacctgggaggaggagcttgcagtaagctgagatcgcaccactgcactccagcctgggtgacagagcaagaccctgtcaaaaaaaaaaaataaagaaaggtaaatgtatatgagcacgtgcaatgccattcgttggtgatcatcgggcaaagccccacccactttctcagacatccccaccggaggatcccatcagtcacaatcctcactaattagaccattcaaattccccaaaataaaaaaagggaaagaggtatagacttatcttaagggtcttaagttctggcatttttctatttaataatatatattgctataaaatggaattactaccaaaatttagaaaatcttttagcagaagatacagccctaatcttaccactccagtacaatcattattgacatttatgatgtacttcgttatagtatcaaaacaattccagtatgtgaacgcttttctttctttcctgttttcctttctaagtgacgctcagtgaattctgtgtatgtttctcccctgcatgcattggtcaaacagtctgtagagcaggcacctagaattggcttgccggctgccctggtggacatttccagtcttactggcatggacaaattaccctcaaagtgattttaccaactttcacgtccccagcaatctataaaatacccttttcccttcatttttgccaaaagggttagcaacttttaaaatgttaactggacatttgggtttcttctgttgagaatattgttcttatattttgtatatttttaaaaaatggatgtgtatcttttccttattgatttgtagaaagtatttatatattccagacattctgcttttttttttttttttttttttttttacttttgtttgtttgtttgtttttgtttttttgaaactgagtctcactctgttgccgaggctggagtgcagtggtgcaatcttggctcactgcaaaccgcaccttccagtttcaagcgattgtcctgcctcagcctccctagtagctgggattacaggcatgcaccaccacacccagcttacttttgtatttttaatagagacggggttttgccatgttggccaggctgatctcaaactcttggcctcaagtgatccgcctgcctcggcctcccaaagtgctgggattacaggcatgagccactgtgcctggccccttttttgttttttaggcgattttaataaaatgtcatacttttctccatgaagtccttgcagcacatcatttgttcgagctgtttctaagcacttttattgttttgttccttttcaagaatattttcaaggtgttggttatgcagcgtgtaagtttgcccaggccaccataacaaataccacagactgcacggcttaagcaagacagcgattttctcacaattctgcaggctggaactccaacatcaaggtgttggcagaggtggttccttctgtaggcccctctccttggataaccatctcttccctgtgtccttacgtggtcatccctctgtgcgtgtcctaaagtctcccttttttttttttttttttttgagactgagtctcattctgtcacccaggctggaatgcagtgcacaatctcggctcactgcaacctccacctcctgggttcaagtgattctcctgctccagactcccaagtagctgggactacaggtgtccgccaccacgcctggctaatttttgtaattttttagtagagacgagttttcaccatgtaggccaggctggcctcgaactcctgacctcaggcgatctgcccacctcggcctcccaaagtgctgggattatagacgtgagccaccgcacccaaccctaaactcctcttcttaaaaggacacagtcacataggattagggcccaccctaatgacctcattaaagaccccatctccaaatgaggccacattctgaggtgctgggggttaggatttcaatatatgaatggggggacacagttcagcctgtgccctggggtataggaacatgaaaggtttttataaactgtgtttctacccagctgtattcttttttttttttttttgagacagagtcttgctgtcgcccaggctggagtgcagtggcaggatctcagcttactgcaacctctgcctcccgggttcaagcttctcctgcctcagcatcctgagtagctgggactacaggcacatgccaccatgcccggctaattttttgtatttttagtagagatggggtttcaccatattagctaggatggtcttgatctcctgaccttgtgatccgccttcctcggcctcccaaagtgctgggtttacaggtgtgagtcactgcacccagccactacccagctgtattcttattggcttaaacagctgataggttttcttggattttccacatgctaatcatagctgcaaatgacacctttgatatttccctttcaatcctttatcttttatttgtttcttattttattgcccggccagcatcctgagtgtaatgtggaatatacatagtcatggtgtgcattcttgtcttgtttgtgactttaaagcgaaggcttcaaatgccgtttggtccaagtttctggtaggaacccttcagcaaaccaaagcaggtctcctgcatccttggtttggtaaacattttaaaaatcagagcaggaggccaggtgcagtgtctcatgcctgtaatcccagcactttgggaggccgaggcgggtggatcacctgaggtcaggagtttgagaccagcctggccaacacggtgaaaccccatctctactaaaagtacaaaaattagccaggtgtggtggcaggtgcctgtaatgccacctacttaggaagctgaggcaggagaagcttgaacccgggaggcggaggttgcagtgagccgagatcgcgccactgcactccagcctgggcaataagagcgagactccgtctcaaaaaaaacatgagatcgggcataatattgattaattctgttcttcatctggccgggttcttcttaaacatcacttccttagtgggggtggaagggctttctcacatctccaggctaggttggtcctagtcctacactttctagccttttgtgacacttgtcctattttgtttttgtttgtttgtttgagataggatcttgctctgtcacccaggctggagtgcagtggtgcaatttcagttcactgcagcctctgctccccaggctcaagtgatcctcccatctcagctccagaataactgggactacaggtgcacaccaccacacccagctaatttttgtattttttgtagagatagggttttgccatgttgcccaggctgatcccaaactcctgggctcaagcaatcctccctccttggcctcctgaagtgctgggaatacagggtgagccactgctcctggtagcttgtcctatttttaatcatgcatttatttgtcttcctcactagacgatctgccttgatcagctgtcactgtgcatccccactgagcagtgcttaagaggacttgataaatattcgtggagtgaacgtacttcatcacatttctgtgatgtttaagcttactgaggagcttaaattactctgttttagtagtttttacggaatggcttggtttcgtaattttccactttctttctcagaacatttctcgggttctcagaaacaattatcggaatgtttctcagcatattttctaagttgccctattgtcattaattaataaaaagttactatacggatcgaatgcctatttacatgggctttacggatatcgtctcttaattcttgcacagtgcatgtggggaacatatgacctccattttactgaggagaggcttagggagggttgggtaatttgttttttttttttttaatgataatattccattttgctaagcatgctttttttttttttttttcctgagatggagtatcactctgttacccaggctggagtgcagtggtgtgatctcggctcactgcaacctccacctcctggtttcaagcgattctcctgcctcagcctcccgagtagctgggactagaggtgcatgtcaccacacctggctaatttttgtatttttagtagaggcaagatttcaccatgttgaccaggctggtctcgaactcctgacctcaaacgatcctctcacctcacccaatgtgctgggattacaggcgtgagccaccactcccagcctcccactgcgcctggcctcgggtaatttgtttgaggtcataatctaatgagtgactaagctgagctcagaagtcaggcctctccgatccagagctttaactccaagctgtccttaatcatttaaaacgtcttgaggaataggttcctgaggctgcctggagagacgcagagcagggactcccatgccctttgcagagtcagggtacggtcgtctcagcacgtgctgaacttgggactcttggttttgtgtctccaacctgcggccggctcagacaccatccagcacatgagagacagcaagcacatcgtcgtgtaccatcgaggacgctacttcaaggtctggctctaccatgatgggcggctgctgaagccccgggagatggagcagcagatgcagaggatcctggacaatacctcggagcctcagcccggggaggccaggctggcagccctcaccgcaggagacaggtgcgcagcctaggtcccttgtcctgttttggggggtggtggaggcgctcttcctcactggggcccatccccaccagggcctgtgggaatcctggcacgggactccccacctcggctctgtttttctctggggtctcccggcttggcaggtctcaagagcaatggggacatggtggggggtccctggccacccctgtgtgtgtgtcaggcaaatgtgtgtggaaacactccagagtccaggacagggagaagtgaggattagaattaggctttttttttttgagacgaagtctcgctctgtcacccaggctggaatgcaatggcactgtctcagctcacagcaacctccgcctcccaggttcaagcagttctcctgcctcaacctctccagtagctgggagtgcgccaccatgcctagtagagacagggtttcaccatgttggccaggctggtctcaaactcctgacctcaagtgatccacccaccttggcctcccaaagttctgggattacaggcatgaaccatatgcctggccaggattagcctttcttacggggctgtgggcatatttattaatttaggaaacagaacaaatggaaaccaaggcccctgtgttagggttacatttccttgcctcagtgaaaaagaatcaggccgggcgcagtggctcacgcctataattccattgctttaggagaccaaggcaggagggtcacttgagcctaggggtttgagatgtgcctgggcaacagagtgagaccccatctctaccaaaaaattagccaggcttggtggtgcgtgcctgtagtccaagctattcaggaggctaaggcaggaggattgcttgagcccaggaagttgaggttgcagtaagccatgatcaaggcactgcactccagcctgggtgacagagtgagactgtgtctcaaaacataaaaaagaaagcgaatcagcccgagcttggttttctcgcaggtgtggtgtgtattgtataggagggtttctcacctcagagctgtgcacactcagggccgggtacctctttgtggggggcactgccctgtgtagcgttggatgctgagcagcagccctggcctctgcccaccgactgccagcagcaacctgtgtgacaaccagaagtgtcgcagacattgcccagcatcagggggacactgttgtccccagctgagagctgctgcgttccagcagtgtgacaactgctacgctatcgctgggagtaaggcgggaggggcaggtgttggggccccttctgcaaagatcaggagaggttctgtgctgcgtggaggggccgcaggtgggctgtgtcttgcagagggtgggagcagaccaggaggacagtgggtgtccagggggtggagccgcatgccccggggtagcagagcaggcaggagccgtggagtgggctgggcagctgggccacggtgccaagctggggagggtcccaggcacccaatcatatttgagcttgattctgcaactgggtgccgcttcaggtggtgtagggtggggtggggccgggggtgcatgagtaggttaatgtgggagattcttctggttgggcagggaggaggggccctggacacagggatgcttttcggtggcccaagtagtgagggcctgaaagagggccaggcctgggagcaggagcaggatggaggaggatgtgtgcgggcaagccggcgttgttcggtatctgctgtggtgttgacaaggctggaaagagcggcggcaggagatgcatctcgggtgaagatgcgctcatccgatgccctcctctcagagcctggaatccccagtggaggagacatggggagcctgagccggcgccgcggggcctgggctccctgtgggtctgtaggcgcctcggtcccgatgccccctctggatagggccagatcagcatcttacccatgggagtcattcacaggaagggctccgtacgtgccggccaccgtcaccgtcacctttgttccccgagcggggtgcactgaggcctagcgtgtttctaggcttattcgccctgcgggccgccatagccaagcactcctagagagaagaaggtggggagagagccagatggccccgatctggaagggtgggcagtggcagagggccctggaggagctggagtgagagggacccgggagcactcgaggaagcccagctggtgggtcttccaagaaggaagtgggcatcacaccagttctgtgtattcaaataagacgggcacggagacctccttgtggaggggtcacatgggcatctgtggaatgcacctgggggctgatggcctgggttccgactctgcctcaaaatagctgtgacctaatctttccgtgcttcagttttctcatctgaaaaataggtacagtagcattgagaagatcagtaagttggtacacagaaaaggtttggagcagagcctggcatgagggacgcactcttacgcacttactgtgacctgggctgccggaacttacctagggtggttcctgtagaggggagggagggtgtgtcagggagcgtggaacagggtgatctgggtctgctgcttcctggcggctttgcccacggggccagcctgcaatctggccgttcatttagtcagcatttattgaacaaaaaatacccaccgctccccatgctgtggtctggagaccaggagcaggtgagagtccttccagcaaacagtctcagatggggaacatcatcaacatggagttttccttcgagaaattctgaaaaactgcaaaggtttgattgtgtcatttcaaacatcacgctccatcgctgcaggtcgggctgcctttaatcgtatttcatcttcactgcagagttccctgggccaggtgtcgtcaggcctattttggacgtgggaaaaataagcagtctcttgatgctgtggagaaagcagcgttcttcgtgacgttagatgaaactgaagaaggatacagaagtgaagacccggatacgtcaatggacagctacgccaaatctctactacacggccgatgttacgacaggtaccgtccttaccttctgagagacaggagtttgcccatgagcttggaagaaataccctgtgtgcctgacactcacccctaagtatctataatgctaagaaagaaggtggcataaaaatataaccttcagttttattttattttattttttgaaatggagtcttgctctgtcacccaggctggagtgcagtggcttgatctcggctcactgcaacctccgcctcccaggttcaagcgattctcctccttcagcctcccaagtagctgggattacaggcgtgtgccaccacgcctggctaatttttgtatttttagtagagacaggatttcaccatgttggccaggctggttatgaactcctgatctcaagtgatccacccacctcagcctctcaaagtgctgagattacagatgtgagccactgcgcctggccaaccttcagttttcttccctctgccaaaactatcacacatacacagcctgagctgcaaatctgagattcttccctcctctgtacatgaccacctttgtttggagatgctcatgagatgcagggctgccaggtccctggactcaggcaggggagagtggcaaacagggctaggcacagggttaggccagggtgttggcatgtggctatctcaagtcctctttttcttatctgtaaagtgttggccagccccgccccctgcagggtggagccaaggattggctgatgaaggggtcatgtgcccacgggaagagcctcccacctctccccagttgccttgcgataacaacaggtcctgacttcaggctgccaggatataagcgctcatctttgtgtctgggacagggaagaaatgagtgattcagtgtcctgtttgtactttcaccctcactccacagagactgagtgtctgctcactgttagagggacaggtgcaaagtgaattagtccatccaggatgaagcagagaggtgcaatgtctcctcatttttgcctctttaaacacttaagttccacacatgtgtgtttcacgtaggtggtttgacaagtcgttcacgtttgttgtcttcaaaaacgggaagatgggcctcaacgctgaacactcctgggcagatgcgccgatcgtggcccacctttgggaggtgagttttcacacttttcacttgaatgtggaagttgcttttgaaaatccaaacctggccaggcgcagtggcgcacacctgtaatcccagcactttgggaggccgaggcgggcagatcacctgaggtcaggagttcaagaccagcctggccaacatggtgaaaccccgtctctactaaaaatacaaaaattagccgggcatggtggtgcatgcctgtagccccagctacttgggaggctgaggcagaagaaatcgattgaacccgggagacagaggttgcagtgagccgagatcgtgccactgcactccggcctgggcgacagagcgagactctgtctcaaaaagaaaaaacaaaaaagataatccaaaccccacagtcaatttagttttgtaatatttgcgtgattatagaatatgaatttttcacttgtactagtaatgcacatgaagttaaatcactagattaaaggcatccctgtcttcctttcccataacttaggtcccttgaacagcagtgcatctcctgccatctccttagggaacaaaagagtgaaatggcagttgactctcaggccgcagcttcacagcagaagtgaagctcggtttttcctggaataaactatcccttatgtgctggatttcctagtgtttcctacctaccgcattttttaggccaaatagaagcaagcatgtgaaaatctgggtttataaacatgcagcgtgtcttttacctaagacatcattttaattcttaaaattaccaggttatttgaaaaccacaaacccctgtccccctgcctgcacctgtggattggcctctaccattgttttttttttttttttttgagacagggtcttactctgtcacccagactggagtgcagtggcacaatcatagctcactgtagccttgaccgcccaggctcaagacattctcccaccccagcctcccaagtagctgggactacaggtgtgtgccaccatgcccagctaatttttgtattttttgtagaaacaaggtttccccatgttgcccaggctggtcttgaactcctgggcacaggggatctgcctgcctgggcctcccaaagtgctgggattacagatgggagccaccacactcagcctttttttttttttttttttttttaataattcgttactctgaactgtttgacctgttccgtgtttggcatgagaaattaaatgaaagttttgtttccttaactcaccggtcaggttcttgtttaaagttgctaaattctaggatcatcatccgtagacttgacacagaaaatactgtggtcacttgttgtgatgagacttgagatctttttcttttaaagcaacaagcccctttgagattcacattgactataaagaccatctttttgcagtgttttaaattttcctgctggcctaataaatgaagtggaataaaatgacctgaaagtcacggcgtgtgtgggagacagggcccagctgcaggctgagcacctcgctgttcttgatagggcatggagccgggtttgtgtgtctgaaattagaaattagtagtggccaggcgcggtggctcacgcctgtaatcccagccctttgggaggccgaggcaggcggatcacgaggtcaggagaacgagaccatcctggctaacacggtgaaaccccgtctctactaaaaatacaaaaattagccgggcgtggtggctggcacctgtagtcccagctactcaggaggctgaggcaggagaatggcgtgaacccgggaggcagagcttgcagtgagccgagatcacgccactgnnnnnnnnnnnnnnnnnnnnnnnnnnnnnnnntagtaaacttgtgaagacatcataatgtatgaccttcttttttctttaaacttctgtgaatgttttgaattttgacttttttttttgagatggcgtcttgttctgtcacccaggctggtgtgcagtggtgcgatttcagctcactgccacctctgcctccccggttcaagtgattctcctgcctcagcctcccgagtagctgggattataggcacatgccaccatgcccggataatttttatatatatataaacctgacctcaagtgatccacccgccttggcctctcaaagtgctgggattatggcatgagccaccacgcctggccttgacgtttctttttataatattgtgtctgtctattttttcccctagagataaacaaattctggtgccagttttttcttgcaaagtcttcgcactcactctcctctctgcctggaaggcttttccccctggcttcccctggctcctggccccgtcaggtcttccttaggtctcagctgacctcacttcccctaggaatggcactgccctgctaccctctcccaagactaggttaggggctcctgtctcatcttcctctacctcttttaattgtcttacttctggttggagtcttggcaaaacctccagccactccttcagccaagggaggttttctatgtaggaaaaaggataaaaaggaaaaaaaaaaacatagtgctctaggctttaagacaccagtatgaccctaggacattaatacctgataaaaagcagccaatattaaaagggcttttcaccaccaccagggttctttggcgatgtcgacaaaagctgagagagccttttagctacagagcgcattgaagatcaagctgccttcagtgtctctggacgtagcaagaaggcacgctttaataaatctctgcacagcataatagcccgggcttgttataccccaggccaaggacttcccgagtcctatatgcctaagagctgttgtttggcaaaagaaaaagagtcgggaccataggcagctggatcacacagggtacatttatcaagtagagaaatctactggatatttacaagatcaggcttgttttttaaagttctctggataaggataaagggattttatcttagaccagggtgggcacgtagaagtagtggtgtttagttgttagcgtccagcagacaggatggcctgactccagggacccctggctgggggcttatgtgatccatacacagatggggactgacctagtctcacatggaggcccagtgcagtcccttaaagacagatctagtcaaacttgagtctgtttgttcttgttcttgttctatttttattttttattttttgagacagggtcttgctctgccacccaggctggagggcagtggtgcaatctcagctcactgcaacctccaactcctgggttcaagtaattttcccacctcagcctcccgagtagctgggaccacaggtgtgcgccaccacgcccagctgatttttgtattttttgtagagacggggttttgccacattgcccaggctggtctcgaactcctggcttcaaacaatctgcctgcctcagcctcccaacatgctgggattactaacatgagccaccacacccggtcttgctcttgatttatttctgatgtttctgtgtcaggctcttctggagctctgacccagagcaggtggaacctgatcaagtctgttcgttcgctggctcaggtcagcctggattgtgacccccacgtattagcggcaccttccacccgccccgccgcctcgccagccgacagtcaccctgaccttgtgttgttgtttttacctccctcactagaatgtaagcttcctgagcacagggattcctcttttaaaaaaacttaatttttttagttgagatataagtcacataccttaaaatccaccctttaaaagtgtacaattcagtggtttttagtatattcacgaggtgcttgtgcaacagtcactgcttagcctcccgagtagctgggattacaggcgtgcatcgccacacccacctaatttttgtatttttggtagaggcggggtttccccttgttggccagcttggtctcgaactcctgacctaaagtgatctacccgccttggcctcccaacgtgctaggattacagtcgtgagtcacagagcccagcctaattctgtactatttttatcacctccaaaagaaatccctcattcctttctcccccaggttcctgatgaccactaatctttctgtgtgtatgtatgtgcctattttggacatcttatatagatagaatcatacaatatgtggtcttctatgtctggcttcttttttcttttctttcgctttcttttctttcttttctagagacagggtcttgctctgtcgctcaggctggagtgcagtggcacagtcatgactcattgaaaccatgacctcctgggctcaggtgatcttcccacctcagcctcctcagtaactgggactacagccatgtgccaccacacctggctaatttttaaaatttcttgtagagataagatctcactatgttgcccagctggtttggaactcctggcctccagcaatcctcccaccttggcctcccaaagtgctgggattactgaagtgaggcagcgcgcctgcctgcttcttttcactcagcataatgttttcaaggttcagtacgttgtaacacatacctggaattcattcctttctagggctggataatatctcattgtatggattgaccacactttgtttatctcttcatcagttgatgggcatttgtgttgtttccactctttggctattatgaataatgctgctctgaacattctgtacaagtttttgtgtgagcatctattcatttcatttcagtgagtatgtacctaggagtggaactgctgggtcatacaggtatatttcactttttaaggaagggcaagaattcttgtctgttttgttcacaaaacacagttcttgtctgcgctgtcaccagggcttggatgccgctgatgctacagtggttccaacccatagtaggtgcccaataaacaccgttgaataaattggcttaggtttacttgccagtgaaaggagagcgtcacaaacttgagcaagcccttagccctcgtctgtcctctctctgtcacatctgacatggagatcagatccacctcattaggtgctgagcatactggaagccttaacagctgtgattcaaactttgtaacatctctgcaaagaacaaccctctcttcatgttggaggttaatgtgttttatgtaccactgttagttttaataattttgttctatttttgacagtacgtcatgtccattgacagcctccagctgggctatgcggaggatgggcactgcaaaggcgacatcaatccgaacattccgtaccccaccaggctgcagtgggacatcccgggggaagtaagtccggattatccaaccattgttacttacctgggatgggaaacacatttgaagtcttacagatgaattttccaaccgtagttcctgccctatcatgagctcagttgaagaccactgaggctgaaagttgtttgctcagggagttccgtgggtctgcggggctgtcacagctcctgttgcctcggaagcctcggtaaatatttcttcttctgtttgaagctcctggctaagactgtcagcgctatttccagcttaaacttaactagacatctacagaatgctcataatcaaaaactaaaagccaaaatcacataggttagagctgaaagcctctaaattgctcatttatacttctcaaagtttaattcattttggcacctcttaaacatgctcagaggcagcccattcacaggagcccttttgggaaggaattttagggttgcaaataccaaatcctagttcacttaatccaaggagaaattccctggagtccaagataccattttctttttcttttttttttttttttttgagatgtagtctcgcactgtcacccaggctggagtgcaatggcgcgatctcagctcactgcaacctctgcctcccaggttcaaacgattatcctgcttcagcctcccaagtagctaggattacaggtgcctgccaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacaccctatctcaaataaataaaaattaataataaaaagtaaaaaaatgtgtttcttgattgccactgtgtgatgacgtcatcataagatgacgtgtgactatttgaaacaccctttggggtctcactggaagccagggtgcccccgtcccctacccatgttcctgttagcgtcagaacatatctgtacgggtctgcagcaacctcaattcttgccttctcagaacgaatttgactgtggggcagaaggcaggagagaccaagtttaaaagcgggaaagtttattttaaaaactttaggaacgaaaggaaggaaagtacatttggaagagggccaagcggccaacttgggagattaagtgcgaggtttgacctcttgacttgaggttttatacattggcatgcgtccagggtcttgtgttacttctcccaattcctcccttgttgtgggctgtccgcatgcacagtggctccagcgcttgggaagggagcatgcgcagtatgtttactggagttgtgcgcatgctcacttgaggtgttctgcccttgcctgtctagcactgctggaggaagctcatagtccagttagacgccgccattttgcctctcagtgcgcatgcttcagcccactcgcccaacgcttgagatcttatcgggaagctgctggtcaccagctccatttctatctactgagagactgcctttccctggcaccggctgtgacctattattattttagagagacagttcacaaccacctgaccatcactgatggtcgcgtgatattcccagtgtgtgtcggaggaagccctctcctggcctgctcatgtcagacccgctacctgctataacattgcagctgctcctccggggtcagggagccatgcccctaacttactagggcttctgggtcaggaaaacgtttgtgtacttcccagtaccgagtttatagctgcactaaaaaccagcctccaatttccttctgggtgtgcgtcagtacttttctcccctcgttccgtaaaacctttttcttctttctctcaagtgtcaagaggttatagagacctccctgaacaccgcaaatcttctggcaaacgacgtggatttccattccttcccattcgtagcctttggtaaaggaatcatcaagaaatgtcgcacgagcccagacgcctttgtgcagctggccctccagctggcgcactacaaggtaagaactgaccgcctagggttttgtcgtgagcactttgggggttcctacacctgcccaagactgttcacccagtggggagggaaggcccgaaacccggcataggagaagcacagctccccccgaccccggtctccgggggccgggtggcgttgggtgtttcaccacgcacgcgggcaaagttcgcaaatccccctccagcaggcgtagattcccagctgacacgggagagggagagtctgggggatgaggacaaagtgagatctcatcactctacagagggagagttaagccccataataagccccgaatcctagcatttgctaaagtggaaatagtgtgggcaggtaggggaatagtcagttacgtattcgtctggcgctcggtaaatctgcacttcacacaggtcaggtgaatatggtccacgtttcatctgtcgctctctgcttgggaacaaaataaaaagcttcttgcatgacttagctttcagcttaatcctttccttttggcagagtaaatcttcctttcaccatactaaattaaattttggtattttcatacagtggaatattatatagctattaagtgatgtctttgggcaaattacttaacgtctctggcctttgacatctccttccataaaaggagaaactccagccacttggaggtgccatgggctggatcccctgtatacacatggcatttccatctcccttttctgagcactggccatattttggcttgcacctggccaaccccttttggaggagcagcctgcacccctagcagggacataaatgggtcttcttgtccattggagggagcattccatcccagacagggggcccttggtttctgggggcaacacaagtcatcgtggcattggcttgagatattcccaactttttttttgagacagaatctcactcttgttacccaggctggagtgtaatggcatgatctcggctcactgcaacctccacctcccgggttcaagcagttctcctgcctcagcctcccgagtagctgggattacaggtgtgcgcccccatgcccagctaattttttgtatttttagtagagatggggtttcaccatgttgagcaggctggtctcgagctcctggcttcaggtgatccacccgccttggcctcccaaagtgctgggattataggcgtgagccaccgtgcccagccttgtattaaaacttgagtgctgtacacatatgcagcgtgtggcactgcccccccaaccttggtaacgattgtgccattgttgaattttgcttggtgcatcatgtacctcatgcttcactgtctctgcacctgggaggcactcttgttatcccatttttaaaaatttacaagtccccattatgcctcagaaaatcttgttttcccattttacaggtgaggaaacaggtgcagagaggccaggtgcttgccagggtggcactaggcagggataaagcgggccagcggctccagagtctatgctctctccacctaaagttaagaaaacagttacagagaagtaagaggcagtgttaatatcagatgaactggaatgaatgggccaaaatcgtatttaaaatgcatgctaatacagtctgtaaagactgtcacagttatgaagccttgctttcccaagtaacatgctcactatgcgtaaaccagaagcagctgggcagagtaccaggagcacagtgacaagctcctgtctgtgacagatcattgactaaagatcatgtgattaaaaggtgacatggaatagaggcatcgcatctcagaatcaatgagctggattttgagaattgatgagcagattttgcccgtaaacgtgcagtatgagggcatgcaagcagttgataccttacctacagaaaggatgttattttatctttttaaatttttttcttttttaaaagaattccctgcaagtaagcgcaggacttaggagtttagtaaggaaatgccacgctccagtttagtacattttgaaacatgctgaaatgactattctgcaagcagtacaaattggtgacgttgactcaaggtagaaaacctgaaaaggtctctggtccagggaccaaagtgagaggttgtcagggagccacccttgtgactccaaagagcttgcagctcagagactccacaaaggaagccaccccatctgctccccagaacccacgtggcccaggtgtgggaatgagctgcaaggggcaccagccactgtgccatgtacttggcaggagcgagcgaaacttcaggacggccccgaggaaggcatctcttcatctctgccctccacactcggaggtgaagcatcttgcctgagggctccagctcgtacgcagcaggactgagatcggaagcaggcaggcttgttcgagaacctgtggctctcatcactgtgctgcagctaaacgcagaaaaaggaagcacagaccagcttcccgcatgaatggaagtgcagagaccctccataaaatcttagcaactagaatccagcactgtaggaaaagaatagtcacccacagtggcgtacaccagcggtgagaggctggttttgtgtcagtaaatccagtcatacactaaaccatactgttgggtcagagaagagcctagatagtgagtttcacagatcctaagaagacgtttcacgtttaacatccattcctgataagagctcttggtcaaggggcttagtaatagggctctttccttaacaggataagtggcatcgtgtattaatagctagctactgcttcaaagtaaaagtgtgggaggcagtccccttaaaacaagaaagatgaggatgcctctagcagatgacagggtaattgggcaggaagaacatttatgtctgttcaggagatggaacagcagaaaggctttgacgattaagaggcacacccagtgagccggcccagcgcagagttgcacaaagaccaccagctttcttgcacaaggatgatggccaagtgggaaatataataagagaatgtaatagaaacgagaatctggggccccaccttccaggcatacgtgtataaagcagactggactctgggaagaaggccgaggagcactcgccccccaactcctccccagggagagggagaaaaagccatgattttggatgaaaaaaaacttcagaaccatagaggaagggatgttcccagttcacactgttttttttttttttgagacggagccttactctgttgcccaggctggagtgcagtggcacgatctcggctcactgcagcctcggctgctcactcggctcccaggttcaagtgattctcctgcctcagcccctcgagtagctgaaactacaggtgcctgccaccacacctggctaatttttgtatctttagtagagacggagtttcaccacgttggccaggctggtctcgagctcctgacctcaagtgatccgcctgcctcagcctcccaaagtgctgggattacaagcctgagccaccatgcctggcttagttcacacatttaatatgaacacagtgagaggtcaggcaggggcttcaggagaggagcttgcccagttgatcttgaggcttgaaaaggctaacatttgagagtcacctgtaacatttttgaaaagaaaagcaatcaggcggaggcaggacacggggaggtggacatgtactttttcaaatcctaaaacttaaagtgtaggagttagaagactgttgtgattaaagtggtctcagtcctataatcctagcactttgggtggctgaggcaggtggatcacttgagtccaggagtttgagaccagactgggcaatatggggagactctatctgtacaaaaaatacaaaaaaaaaaaaaaaaaaattagcccagcatggtggcgcatgcctgtagtccaaggtactccggaggctaaggtgggaggatcacttgagccccggaggtggaggctgcagtgagccgtgatcgtgccactgcactacagcctggatgacagtgagaccctatctttaaaaaaattgtttttaataaaaataaaatgctgcagtcctcgtacaaaagcaggcctgggaaataacgtgtaatggagggagcatttgacatcagtaggggacggggagctggtgagtaaatggagctgggaaatctggctaagtggttgcctttggaaaaaaataatccaagagaaataaggagtcagaccagaaactgtggttcacaagagaggaaaaatacggtcaatgagtgtaggtaataagcttaatcttaccaagaatctaacaagtacaacttaaacaagactagatttttgcctacggggttggtaaaggctttttttcatgttggtgagggtggactgaggcagggatgttcatagagcagctgggaatagttttaataaatttaggggccccatggcaggactgggagcagcacagaccacacagttggaaacatgcatcggggaagaataactttgaccctgcacatgatccatgaaaaagggtaggtacacaaaaaacacgtgtgagcaagcttactgtaaaaatgtgaggaaatctggccaggcgcagtggctcgtgcctgtaaacccagcactttgggaggcctaggcaggtggatcacttgaggtcaggagttcgagaccagcctggacaacatggtaaaaccccatctctgctaaaaatacaagattagctgggtggtggtgcacacctgtaatcccagctacttgagaggctgaggcgggagaatcacttgaacgtgggaggtggaggttgcagtgagccgccaagaccacgccactgcactccaacctgagcaataagaacaaaactccgtctcaaaaaataaaaaaagaagaagaagaaatcttaaaagttaatgctggcaggccgggcacagtgggtcatgcctgtaatcccagcactttgggaggctgaggtgggcggatcatgaggtcagaagatcgagaccatcctggctaacacgatgaaaccccgtctctactaaaaatacaaaaaattagccgggcgcggtggggggcgcctgtactcccagctactcgggaggctgaggcaggagaatggcgtgaacccgggaggcggagcttccagtgagccgagatcgcaccactgcactccagcctgggtgacagagcgagactccctctcaaaaaaaaaaaaaaaaaaaaaaaaaaaaagactggaaactagaaagtgtctgagacaggtctcaatttatttagaagttgattttgccaaggttaaagatgcgtgcctgggagacaggcctgtgccttcctccaaaggtggttttgagggcttcagtatttaaaaggaaaagcaggcaggaggggaaggaagggagggcgtggccacgttacggaattcccatgatgcaagagaaaaggggcggtaggggaatcgtcagttacatatttgttacacaaaacccggtgaacccagagtggagacatttcgccttttatccgtcactctgtgcttgggaacaaaagaaaaaggcagcttcttgcacgaagctttcagtgtaatcctttcctttcggcagagtgaatcttcctttcatgatactaaattaaaatagggtattttcacacagcggaatattatatagctattaagtgatgtctaaggcatatatatgtgtatatatatttttgagacagggtcttactcttgcccaggctggaatgcagtagcacaatcacggcttactgcatcctcgacctccctgggtgctggcgatcctcccacctcagtctcccaggtagctgggactataggcatttaccaccaggcccgtctaatttttatgttttttgtagagatggggtttcaccttgtttcccaggctggtctcaaactcctaggctcaagcaatccttggcctcccaaagtgctgggattacaggtgtgagccaccacgcccagccatctatggcatattatacggaaaaatatttagtcataaaacagtttgtgaaagtcaggtgtttcttacaatgatctgcagactgtggctcataggccaaacctggcccttcaatgtttttgttttcatttttgttttcatggcttagaaagctaagaatggcttcacatatttagtagttgaaaagcagtcaacaggcgaccaatactttgtgacatgtgaaaattacgtgaagtctcagtgttcatcagtgaagcgttctgggcacggccatgcccggctttcacatgttgtctgtgctgttctcactccagtgggagagcggagtagtcgccacagagagcacctggcccgcacagcctgttctgcattttacagaagtttcccaactcttgctttgttacatgcaaagtctagaaaggataaatgcaaaatattagcaggtgatgttgtgaagtttcctttttcttttctttttttttttttttcctccttgatagagtgtcactctgtcacccaggctggagtgccgggcgtggtagttgacgcctgtaatcccagcagtttgggaggccgaggaggatggatcacctgaggtcagaagttcgaaaccagcctggccatcatggtgaaaccctgcctctaccaaaaaatgcaaaaaattagctgggcgtggtggcaggtacctgtaatcccagctgcttgggaggctgaggcaggagaatcccttgaacctgggaggcggaggttatagtgagctgagatcgcaccactgcactccggcatgggcgatagagtgagactctgtctcaaaaaaataaaaaataaaataaaaatgacagatccattaaagtgatctattaaaagtatacatcagatttattcattcaaaaattaacattcagaccgatctcaacccagctgggagctgcagagcctccctgtggttttacataaatccagaaccttgctgtggccctgtgggtctcttctaagcttctgaaccttttttctgccctggaccccttgggcagcctaggagagcctggggaccccttctcaggggtccttcaaggttatacacaatataaccttgtgttatattgaccccttgaaggggtccttcaaggttatgcacaataaccttgtgtatttcattttataaagcataaccccagcactttgggaggctgagacaggtggatcacttgaggtcaggagtttgtgaccagcctggccaacatggggaaacgcgtctctactaaaaatacaaaaattatccaggtatggcagcacgcatctctaatcccagctactcaggaggctgaggcatgagaattgcttgaacccggtaggcagaggttgcagtaagccaagatcacaccactgcactccagcctgggcgacagagtgagactgtctccaaaaaaaaaaaaaggtagcccctcccgcattgttctgttccctagttccctgttcctgtgttatttctattcagtggcctgacttgatgtgatagaatttttttgttcatccctgtctcctgctagaatgtttgctcattgagggcaaaggcatgatctgtcttacaacagtattgcctgtgccgggagcatcagtaaatcagtattgaatattgaatatggattgaatgctgacactagacagtggtattaattctagtctgcagcagttatttgcctcctgctttggaagccctaccaacctgaatcattagccccatagtaacagtgctagtgtgtgatgccatatatgtcagtatatctatagactgtctttgaatcctgcttcttagaaactggagatgttttggtggcagcgaagggccatcctcctgatggcggctggtcacagtgggtcaagggtgctgcagttgtaacctggtttggctctttgatggcgtctgagctccagtggggcttgcacactaatattcaatgcatttgccaagaagttttttagatggctgtcttttaaactgtgggcacaaggcatgactgttctcataacttacacaattaaagtttgatattggaacattgatttcaaatgaatcattgcatcatatagttcaagtttacctttattaaataactaaaatgccacatttccgctttcccttttatctgcttctctccctctccccacttcttcatcgtgagcgcctatgaagtgctctgtagtgaggagatgcgggaagggctctgaaaggcgcgtttgctatcagcatgggaagcaggaggccccgtggcctcatggcaggccccaggcctgtgacccccgctcccaagggaatcttgagtgtcgtgtcatgccaccagggttggtggcatctgtgggttggggaagagagctccccaaggcggccagctatgttggggggatcctgggggctcagccaggtcctcactgcaagtgctgcttagcgctggtgtccagcgtgctcccacggtctctagacgcttccctctgcaaagccgctgctcttgtcgacgccttcagtttcctttttctgctggctgatgcactctcatttcactggttctggacgcttccttctgcctttcaggggccctggtcctggacgctaccttctgcctttcaggggcctcctctcctccagagatcttggctgcactgtgaggagcctgacttcagctgggcctgtgtgcaggtgccaggccttccccggctgagcgggtcctgtgctctgtctgactctccgttccccagctgagtgggtcctgtgctctgtccggctccccgttccccagctgagtgggtcctgtgctctgtccggcttccccttccccaggctgagcaggccctgtgctcagcccagccttgcctctggcaccctcttctgggttcatttgacagtatcagcctgccacatggtgtcctttgcagatgggtgggtctgccaccctggggccaccagggcctgtgccagggtgcacactaatgtgcagggatgtgtctggtcaggaatcatttgggtccataaactgctgcttatcaccttctcgtccccacttggaacctggtcctctttgagctggcctggtggccccgggccccttcttggggcagcacgcagatgctgttcctcccacagccgcgtgctgccttggactcagtctctgtccttatccaccatctgctattcccagcaggggcccttgctgcactatcccgtcatctccaccaaggctcagcctcaggggcatcagcccctcctgccgtgctgtcctctctaggcccagatgcccacgttccttgaccccatccccttgtccctccctgccctcccttttctattctctgggtgtgggttccatggttctttgggatcatcccttaccttgactccctggtccccctgaacttacctggggagcctgcagaggctcccgggttcagcccagctctccagctgctgtgattctgttcccaaggcaccagcctagctggaaaaaaagcattcaacagctggctcgtctcccctccccacgagtgagcgctgaccgcagtgggccaggcaccatgtttccatgcccctgaatgccacatcacacccctctcccgctgccagcacctcctctccagcctggccctcagcaggcccgctttcttctgcttcacccagaaaacaggagcttttggaagagaccttccctgtgcatctgccagcccacccgaggcttcctgtctaatggggcagtggctgtgcttcaggctccggccccacccacttcccgccctcctgctagacattcttcctgcaccccagcacagtctctcccagatcattctcaccatcttccagacgcagtggaattgctccaggcaatacgttgtgtctttaaatcatttcaaacacagatcccctgctgtgcacggcattccttctgtacactgctgcaggctgcaccttagcctgaagggaatgcagcagaggtgtgttggactcgggggtggggggggtgtcatagtatcagttgcatcttgaaacagaaacctggttaacctagaaactgacccacctccaccaggcccttcctgaagccagtgacacctgtctgctgccacgtcactacccacatgtaaaagcggccagagactgaaaatatgattcgacaataggctgggcacagtggctcacacctgtaatcccagcactttgggaagccaaggcgggtggatcgcttgagccaggagtttaagaccagcctgggcaatgtggtgaaaccctgtctctacaaaaaaaattttaaaaaaattagcatgcacctgtagtcccagctactcaggaggctgaggtggggggatcaccggagcagggggaggttgaagctgcagtgagctgtgatcatgctactgcatgccagcctgggcaacagcaagaccccgtctcaaaaaaatgttgacaatgaagtccacttctccttgccaatcttacccaatccttccttacgttttagacatatcagcatgccctgccgtgcactgaagtacttctctttccccaggacatgggcaagttttgcctcacatacgaggcctccatgacccggctcttccgagaggggaggacggagaccgtgcgctcctgcaccactgagtcatgcgacttcgtgcgggccatggtggacccggcccagacggtaatgtgccatcaggctgaggacacaacgtgcttgtcacacttccctaaaaggcttctggaggccatcactccagcttctctgatctcatcattcctgtaccttcttctttaggggtgctcaattcagcttctttcctctgcccctttcaagggtacagaaggtattaaaatattaaaaggtaaaggtagggacaaggacagagacgcatgttacaaatgatacttctccaaatcatattctacttcctgagagtctttaaattaggccaggacacacaatgaggaaaggcatagcaggtggctgctttggaactgaacaggtggttggtgtcagggtaggtgagctgtgactgtcgcacgggaccttccattggttattagagccattgccacgctgggccccaagtgccaggctggggcctgggggttttctgtacattgtcctttaaattttcttagcagtggtcctgagaagtgtcatcagttcatttccatagataaagaaacagaggcctagatgaattcagcagctgctgggccattctgctcactaatggccgaggtcagacccaggccactgggtccgcctgactccagcgtgcaggtgctttctgctgatccccagagcgtgcaggtgctttccgctgatccccagaggagacactggccagggctctttttttccgagacaaacttcattctggaaaggctgtcacaccgggcgcggtgactcacacctgtaatcccagtactttgggaggatgaggtgggcggattgcctgagctcaggagttcgaaaccaccctgggcaacatgttgaaaccccgtctctactaaaaataacaaaaaatattagccgggtgcggtggctaacttagatccgtaactgctcaacttgagacatgcaacatatgtccttcccaccttttgtcactcaggtggaacagaggctgaagttgttcaagttggcgtctgagaagcatcagcatatgtatcgcctcgccatgaccggctctgggatcgatcgtcacctcttctgcctttacgtggtgtctaaatatctcgctgtggagtcccctttccttaaggaagtaagtctcttccacttcttccgtcagttgtattggctagaccaaaacttagtaaattactacagccttgcatgaacatattttaatgtcagaatgggcatttgaaaaaaacgggtctgtgggtgtagctgtcataaaatggaaaatgtgagcagcgcgtttagtactgcatttcttcaaaaacttcgctgtcacatgtagcccctgacttaatagacccgaagacctcgagagcttacgtcacagtaagacgcacggaagtaactagggagtgatgagctgtgagcgcgtaccacctttgttttaaaaatcctttattttattgtaagtttatgaaatatattattattgttttttgagacagggtcttacagtgttgcccaggctgggctcaaactcctagacacaagcaattcttcgtccttagcctgctgagtagctgatgtgcaccactgtgcccagctcaaatttaatttaagttttatttatttatttatttattttttattttttggagatggagtctcgctctgtcacccaggctggagtgcagtggcgccatcttggctcactgaaacctccgcctcccgggttcaagctattctcctgcctcagcctcccaagtagctgggattacaggcacacgctgccatgcctggctaattttttttgttgttgtattttagtagagacggggtttcaccgtgttgcccaggctggtctcgaactcctgagctcaggcaatccacccgcgtcgggttcccaaagtgctgagattacagacatgaaccattgcgcctggcaaatttaatttttaatagtggctgtatttaacagccagcttgaaaattctctgaaaatatggcagctggctcgtgggagttggtacaagtctgacacctctgtccccgttccgaatcttactccatatatctgttaccttcactgtctgagatgctatttgctggtatgcccccacccccaccctgcactccctgccccagtctgggggccccacccaccccgcatgctctctgcagatacgctgcccaagccagtgaggcctttggagacatagacttgtggtgtgtggaacaatcaaaagaccaagccaggcttttctcgtcttcccaaagcgactcctgagggacggtagaggaggggattaggaaacatttccctgtttcactcaataggttttatctgagccttggagattatcaacaagccagacccctcagcagcaagtggagctgtttgacttggagaataacccagagtacgtgtccagcggagggggctttggaccggtgagtgcggcggggctgggcgaggcgcagtggggcgtggtgatgggatgggtaatggggtgtgatgggcccatctccgtgctgggtgcccctgttaccttgcggttctaccgccgtaaaggaattactgctgatcattgctatggatgtccttggcagtcttgcacttattttttatttttttgagacaaggtctcgctctgtcacccaggctggagtgcagtaagcatgatcatggctcatggcagcctgaatctcccccatctcaggtgatcctcccacctccacctcctgagtagctgggactacagatgcatgccaccatgcccagctaatttgtgtgtgtgtgtgtatttttttgtagagacagggtttcaccatgttgtccgggctggtctcgaacccctgggctcaagtgacccgcctgcctcagcctcccaaaatgctgggattacaaggagaagccaccgagccccgccagtgttgcatttagaacattagaaagtccctttttcacgttgtctcatttcccagcaacaaattcaaattcccttgtcctccaggttgctgatgacggctatggtgtgtcgtacatccttgtgggagagaacctcatcaatttccacatttcttccaagttctcttgccctgagacggtatgtatgaaaagaagttcctttttctgaagatggggtatttttgctttattctttttaaggaaacacatctttaatttgacagaaaaagtcaattcaactgcctgcttttacttgatttcgggaattttcacataaatggactgcttttaaaaaaaaatttttttttttttggagacacagtctcactctgtcgcccaggctggagtgcaggggcgagatcttggctcactgtaacctctgcctcccgggctcaagtgattctcctgcctcagcctcccaagtagctgggactacaggcacccgccactaccccggctaatttttttgtatttttagtagagacagggtttcaccatgttgggcaggctggtctcaaactcctgacctcagatgatccacctgcctcgacctcccaaagtgctgagattacaggcatgagccaccgcgcctggcctaaatttttttaattaaaaaattgtttgtacagacagggtctccccacatttcccaggcaagtcttgaactcctgggctcacgcgatcctcttacctcagcctcccagtgttgggattacaggcttcagccactgtgcccagccataagtgaatttcaaaattctctttacctagttttaaacaaatgtatctcagccaggcacggtggctcacacctataatctcagcactttgggaggctgaggctggccaatcacttgaggtgaggagtttgaaaccatcctggccaacatggtgaaaccccgcctctactaaaaatacaaaacttagctggtgtggtggcacacgcctgtaatcccagctactcaggaggctgaggtaggagaatcgcttgaacccgggaggtggaggttgtagtgagccaggatcatgccactgcactccagcctgggtgatggagtgagactccgtctcagaaaaaaaaaaaaaaaaaaggaaatgtatctaatttggtttaacatgtttacctctgttggcagcaatggttttgaagcttaacgttggagtgctgctgtaactttcagactctttagcacttggaagatgaactaaaaataatgggtacacactaagaaatctgcatacagagcaggggacccccggcttcctctgtggatggaacaagggacctcctccctagcatggcacattgcccttatttatattctgctttccttgtcgtacatagcctggcaacccatgccactgtcgctgttaacagaggaagttggggtttatttgttcactgtggttttcttttgttgtttgtttgtttgtttgttttagacagggtctcactctgccacccaggctagagtgcagtggtgtgatctcggctcactgcagcttcagcctcctgggctcaggggatcctcctacttcagcctcctgagtagctgggactataggggagtgccaccacacctggctgatttttgtattttttgtagaaatgtggtttcaccatgtttcccaggctggtcttgaactcctgggctcaagcgattccaaagtgctgggattacaggcatgagccaccatgctcaggatggtcattgtgttttccgtgggataaacgcattggcattaggggaaggcttagatcgacaacacacccgcacaaacacatcagctgtcatctctttaccctcagcatttctctggaatgtctaagttaagctttaagacgttggtcagatcttagagaactggcagaaaggaatttcaatgaaacattgggtcagattgcaaatgaaaaagcttgaaatgtggggatggccacgttttaataggtttttggtttttgtttttacatgaaaggattctcatcgctttggaaggcacctgaaagaagcaatgactgacatcatcactttgtttggtctcagttctaattccaaaaagtaattccactggagctgctgggaaggaaaacgagctcttctgatgcaaaccaaatgaaaaataggcattaatcctgaccttagctcgggatgaaacactgctcttaaaaaaactcagttttccttccagaaaatgtgggtgtttttttttcctagaacagtatctctcccctgtgaagcataaccccactacttccagacttgccctcccttgggggacatctgataaagtctcccctgatgtctccgcatcggcttggatttattaagggatgcaaatcttgttgagttaatgaaggaattagtagggttgtggcttcacacacagtggaatggaaatggtgtgctttctcagtggcaaccgaaggcctagtgcttaagggcatttagcatcatccaagcagggtaaacttttgttttgttaaaagaaaaatgtgttattcaagttggtgtccccagttgtagctaacacatctggaatgcactaaccaaaatgctgtgctttggagacctgcttttgtcaccgtgggtaaccgttcccgtctggtccagtagcctgtgtttgcctctccacatttgaagcaagcaggatgcaaggtcttcagttttactgaccttgtatgtcttcaagtcttcacaacccagtgccttaaaaatgaaaggccctaaatgtaagggagatggagagaaagatttattttgtagagtctttgggtggaattgtgggtatactgttcccttcacaattgactgagtatggataaccgtacataagcatttgctacaccccaccagccccctccccctcagaaacaccagttccttcccaagggcagctgtgccagactcccctcccgggactgccttcttgtcatcataagcaacaaaagaaataacaggcacatgtcataaaaggggagcaagggccgtgatggtcagataattcactcaagaataaaacatgacacgtgcctcaggaggatctctttcccaaagtgacagcaaggagggcagggcatcggccaccaagcggggactagcaagtgaggaaggggagggcagcccaccgtggtgaggagagagtggctccacgaccccaagggatggccttctcctcccacccggtgaggggaaagactcaccagagggtgatggagacagtatgccggctcaccttggtgaccagccaagatgtctcaagtgacagtgctaggtgttcacccagcctgtccttcagataggagtgccttcacgaaagcgtctcatggaccacaaagcaattatgcactgagtcatcttcagtatttaatgcaaaaatgaagcatcatggaatgaaattcccactgtctgtcatgacaagcttagctgtccattgttttaaattgtgtatttatttttttgaccacttggttctagttgggcctgactccttcagagtgctgcaccccgatagtacaacagcgatggctgaactgttggagtcgatggaaggtgcttgccggagaacacgtgccttttttttttttttttttttttgagatggagtttcactcttgttgcccaggctggagtgcagtggtgcaatctcggctcactgcagcatctgccttgcaggttcaagcgattctcctgtctcagcctcccaagtagctgggattacacgcccaacaccatgccctgctaatttttgtatttttagtagagacggggtttcatcatattggtcaggctggtctcgaactcctgacctcaggtgatccacctgcctcagcctcccaaagtgctgggattacaggcatgagccaccatgcgcggcccacatgcatgttttatgtatgtatacttcatgatgtaaaaatcccacctttatgggccaaagattttttttctcctgaaagcaagaaaaaatgaaaacaaaagacaaaaaaaaaaaaaaaaaagcgtccaggcgcggtggctcatgcgtgtaatcccagcactttgggaggccaaggcgggcggatcacgaggtcaggagatggagannnnnnnnnnn

SEQ ID NO: 15152 - DNA, 16225 bp, Human
tgacatttgttactgagttttaagagttatttatatgttctggatattacttccttatcaaatatatgatttacaaatatttcctctcattctgtgggttgccttttcactctgttgatagtgtcatttgatgcacaaaatttgcttttaattgatgaaatataatttttttcttgtcttgcctgggcttttagagtcacatccaataaatcatagccagatcaaatgtcaagaagcatttcctctgttttcttctgagagttttatagttttacctcttatgtttaggtctctgatctattttgagtttgtgtttgtatatgataagggtccagcttcactttttttgcatgtggatatccagttttaccagcaccatttgtagaagagactccctttccccatttgactgttccttgtcacgcttgttgaaaaccgtttgaccatatatgcaggggtttatttccgaggtctctgttctattccattggtctgtatgtctgcctttttgtcattaccattgttttgattattatagttttggaatcagaaagtgtgagccttctcaactttgctctttgtttctaggattgttttggctatttgtggtcccttgagatttcatatgtattttggaatggatttttctatttcagaaaaaaaaaaccaaaaaataccatcatcaggattttcataggggttgcactgaatctgaagattgctttgtatagtattgacagtttaaaaatactaaatttttccaatccataaacacaagtgtctttccatttattttatatctttaattttttttagcagttttgtagttttcagtgtacaagtctttcacctccttagtttattcctaagtattttattctttttgatgctattacaaatgatattgttttcttaatttccttttcagattattcattgttagtgtatagaaatacaactgagttttgtatgttgattttgtaacctgccacttaactgaattcatttattagttctaagagatttttgcatgtgtgtgtatatgtgggatccttagggttttctaaataaaagatcatgtcatctgcaaacagagcgaattttatttcttcctttctaatttgaatttctttttcttacctaattgctctgattagaactttcagtcctatgtcagatagaagtggcaaacatggacaccctgtcttgttcctgatcttagggaaaaagccttcattcatttaacattgagtatgatgttagctgtgggtttttaatatatggcctttattatgttgaggaagtttccttccatttcaggtcaactctaaagcatttatttttattaatccctcttttttttttttttttttttttttttgagacagagtctcgctgtgttgccagactggagtgcagtggctgtgtctcggctcactgcaacctccgcctcccgggttcaagcgattctcctgcctcagcctcccaagtagctgggattacaggcacgcactaccacacccagctaatttttgttttttttttttttagtagagacggggtgtcaccatgttggccaggatggtctcgaactcctgacctcgtgatccgcctgcctcggcctcccaaagtgctgggattacaggcgtgagccactgtgcccggctaatccctctatcttttaattttaattagaatcacattggatttatagactaattttgagaaaatagtacagataaatttgcatgttgaaccacagaatgttgtcacagaaaatgtgagtggggaggaagaagaaagattatgacattaaatgtaagtttataaatttttatgatactactttgagaaacattaatatagtttataaggaaaattatattttaagggattttctacaaaggtgaaaaaaaatcaccctatgagtttaaaggattttaagctttatatttaattctttccttcttttattaatttaatctatatttcttcttttttcctaggatatcctaaacctgaggaaggaatacttgacagtttgggttggtatagctatcatgacaaatataagtggtagtatgtgtagaaacgtgtaggtaattagtttttatgaggtgcccaaacataggatccttggtagggtaagataactttcttaaatgctgtgtttgtatgtaggttaaaatatataaaacacaattttctttccacattatattgttattttgtgatggtaatctgtcgataaattttctttctattcatatcttatatacatgaaccttaaagcaatctaagttgggtttattttttctgtaacacgctgatttaacacacttgatgtaggcttacgcagtttacacaatgcatgttaaaaaaaaagatgaagtgcagttgtgatataggccaatgaaaaataaagatttcttaataagtaaaaacaaaaatctattacctttcatttcttagactagtttggtaatggttaatcattttatataatgcaccttaggcttgttttttagtatttgccttacctccaaaatctgtggtccaagtaaatctgttgccatcttaaactgttaaacacttgataactgtttatgagatgagaagagcagagttgaacatagcactttatgctttgacttatagcaatttaataaaagtaatggcagtttagaagcaaaggtactagggacagaaacagttctaaaaattaagattttataggattattttgtgttctctagatagtcaaaaatgtattctcaaatttctctgtatattttttatccatgtgccctggtgtttcatttattatgggaatcctattggtatttaggactatgtcttaattttggggcagggcagagtatggaagtagagaggatgggaaggggattgataagataaagtattgtttgtgaagactttgtaaataccatctgggcaatagaataatagaaatttatttatgactcactctacagatcacttttggaggaaaaaatacaaattaaatgtctaccaaaataagaaatgacagaatgactgttgaactaaaccaactctcatgggataatacttttcaaaaatcattttcctttactatagtgaattctaattactctaataactttaccgctaaataacctgatgtggtagctatagagaaaaacagtgaaaaatgaggttcccattaagagtttcacaagtggaacccttaacctggaaactggttagaagggttctatgatcaaaatgacctggatgccctagcagtcatgctaaaactatataaaaaatttttttttcctctgtagtcttgtattagtccattctcaatgctgttgtaaggaacagtctgagaccgggtaatttataaaggaaagagatttaactgactcagttctgcagggctgaggaggccccaggaaacttataatcatggaggaaggggaagcaaacacattcttcttcacatgatggcaggaaggagaagtatgagaaccaagtgaaggaggaagccgcttataaaaccatcagatctcgtgagaacttactatcatgagaatagcatgggggaaactgcctccatgattcaattacctctcatggggtccctcccacaacacgtggggattatgggaattgcgattcaagatgagatttgggtggggacacagccaaaccatatcaagtgtttagatgatctgattgaaataaatgctatctggagatccatgtgttcaacatcttggaactgttttctttctcagatgtttgggtcattgctgtgattgttattgccataggtaagtatcacaaattttgacaccacttaagtcaaaaaattattgtgaagacatgcattttaaaaatagtttttcagtttctatagttttttcagcttgtaaattggttaaaccgatttaggaaaacctgactttttatttgatatacttaactacctaccttgtgttagtgattttatactctgttatattctgtatatctacttagtaacaaagcctaagtaatacatattttctcaagatgatcagtaatattagttggcttcccaaatgtgcttttgatagttttctaaattaagcaaggacttttctctgacttactatggactgtgtaagtgattatggggagttggatttagatagcaaagagtctggatggaatataaatgtgtaggtgcttaaataacatttgaccactgaaatgtaaccaacatttatttcttctgctagatgttgaatcttggtgattagttttcagaattatatgtcatttgtttcctggtttcttatagttgttggagttgcagtaatttgtgttgtcccgtacagatatcttcaaaggaggaagaagaaagggtaaattaaagcatgtttcttttaacttcttggtccttcttatacttaacatgcttttgtgcagcttcagtttgtaatctgtattgcatgctatctttttttttttaaaaaaaaatgcctgcattagtttgtcctaccaattgcatttctttgctaaaaatattttcagctacttctaacatcactgcaacataaaaacatctgtgcagagttcctacagctattatgactttaagaaaaatttcttttggatttgaggtttaagttatttagcaaatcatggaccactcactatgaggccttctctaccctattccctatttccaaaattgcactaatggccaaaattaaatttaaagtatttcactgtggagactttgacagttgtattcactggaatttttataatgaaagtttccacttgtctatatagcttagctagttgcaagaagctatgtaggcatatcatttaaatacccaatttggtgtcttttcatttaaagttgttatttatacatgttaaactgggggattcaaaacaacactatccgatttccctcttatgttctctgaatttaccagattgcagtaaaactgatagggttaaagttaaaattgctgagaggggttagatctgtaaggtacctcaattaactgtgtcttttaatatataaaaatgtaaaaagtgagtgggtttagaatagaagaaaaatgtacaagtacatatcttctaaagaaaatagggttttaaaacatcaaactcaaattttagttaaagagcttacagtttaacaaaagacttagaatgaatcctggaacacagactaagattaggtgctttgaaatttctgaaagataatatacattcatttttactgatttttaaaaactgttttcccctatagttttagaaatagctttgaaatcaaacctaataattttaagacttttggtactcatggttttatgatatatattccttttatactgatcatcaggtttgggctaagtcataaaagtacaagctttactcataaggaactcaaacttttttcatattacttggttatcttttgaaatacccataatcccttcacttgaatcttaaatcttgtattaatggaacacgatatgcatatttgatttatctatcagttgtatattctaaaagttacatatctacaacgtgagtacaaaatattatcaatggaatatttttacaaatccataaggtttgcgtagaaacaagttctaaagaaaacaaaacaaagtcgcattctgcttattttccttctttgtttaaaatatcactgcatcagaatttttaaaggttcattaacaagtattaatcaaactctctctagctagcagttaatggtttttctgttgttgttttttgcttttttgtgatggagtcttgctctgtcacccaggctggagtgcaatggcgcaatcttggctcgctgcaaccttggcctcctgggttcaagggattctctgcctcagcctcacgagtagctgggattacagtcgtgcaccaccaccaccggctaatttgttgtacctgtactagagatggggtttcaccatgttggtcaggctggtcttgaactcctgacctcaggtaatccgcccacctcggcctcccaaggtgctaggattacaggcatgagccaccgcgcccggccttaatgggtcttttaaagctcaacagttatctgactgttacactcccaaatgaaaggttcaatagcagtagtgaactgagattccaaaattaatttgtccagtgatttttttttaaagcccatattttacagcatagggtccaactgacagttgccattattaaaattttaaaatattttgggaaggtatgatatctttagccaatgcaacataattaatcctgcaaatagtagcacaacttgaggaaaaatagtccagaaaatggtgtgagagacgaaactcctaattgcctttgaactttaaaatataaactgcgtgggaatcttttagaatagatgttaccctttttatgacaggaacatactcgattggaaattcagcatatgtaatggctgaatccaaagctaggctctctttatggatctattattttgtagttccatgttattttgatagctgaactgaatgtgagggtggtttatctttcttcttcagagtctagaggaatgtttctctgactttaatgtgcacattagtcacctggaaatctgttaaagtacagattctgattcattgggtttggggtggagcctgagaccctgcctgtctagtgagctcccagtgctgatgctgctgctgtgcctgggctacactgaccagggtgttgcccactactgatgtgcctatattgttgaagtctgaagaaacactatgaagcttattggcaaatttttctaatatttaagataattgaagtttttaagattcctcatccatgtgtatccttaaaaaaaggctatggggtaataaatagtacttggcttttcttaccttctttaactcttaaaaaacaaagatttccagccgggcctggtggctcacgcctgtaatcccagcactttgggaggccgaggcgggcagatcacgaggtcaggagatcaagaccatcctggctaacacggtgaaaccccgtctctactaaaaatacaaaaaaaaaaaaaaaaaaatagtggcgggcgcctgtagtcccagctactctgggaggctgaggcaggagaatggcgtgaaccccggaggcggagcttgcagtgagcgagattgcgccactgcactccagcctgggtgacggagtgagactccatctcaaaaacaaaaaacacaaaaaaaccccaaagatttccattattttctttgcactgtttaatgtccataatcttgtccccccagattggctgttgtggccttagaaacttcttataaagactataaaatgtctggaggcacttctccacttccgggggtaactggaagcaggctagcaggcacaaataatctcaaattgttgttaaagcctggcacaaaatgtatttcttgtaaactggtatttatggtgatttgggaacgtaattactcttctgcagccttcatctcaaaatacaaaaatagtgtaaggagtcattttaagatcatccaacatcatttacattacttgataaaaagtgggcaaaaggttaaagtattctgccacttttctgtttcatagctctcagctgagaacagtataggataccagtgggtccgaaacaggtcccatccacatgctccctccttttcccttcccatttcctttctttactaattcttctaccatactttttagtcttggaagccacagccctgtctttgctactgcttcagtcctgtattgcatggcatgactgtgcttctgaacaacagatgccttttgtttacataaatatttaagtaatggttttttttaaatgcatgattattttttaactctagttaagcatccctggataagtgacagtttggctaagttagtgaaagttatttacataatttatatatttattacctgtgacaaatagtttttccttttttccattaatggtatttattattttgtataacctaaactgacttttaatgttacattaatattgactgacccaattactttattaaaaatagtggtcagttcaggtaattggggcatatagtgacatggggcaaaaaaaggatcaaattaacttaaatgtttttctagttggcccttaaattcttgagcatttaacccttcaaaaatttttgagcaactacaaaaatgttttgtaattagtttagaaagcatccttacaaaattagatccatctcagaaatatgagacgccatgtaatacaaagttttgcaacgatgtctcctcaggttgaaaacagatgtgccacaggaagacacttcttaatgtaaaagtccagagacatctgaaaatacatgatgtcataaagttgatttctagataatattacatggatttgatacatactcaatgtattccctcaaaattgagggtgttaggccgggtttggtggctcacgcctgtaatcccagcaactttgtgaggccgaggcaggccgatggcttgagctcaggagtttgagatcagcctgggcaacatagtgagatgctgtgtcttgaaaaaaaaaaaaaaaaaaaaaaaaaaaatcaagagtgctagagaccggtaccatttctccccaacaatctgttattccttgaaaacattttgacatgaatcacttcatgcaaaatggcttcaaagataaacatattaaacaggaatttccagtctgtttatctgctggatgatctatatgacttcaaagttcaagtagcttctagcacaaaattcatgtttccagtccttcagtgagaatgagaaagtcttaagttatgaacctaattctcagctttcctgctactctcttacactggattttatcccacttgttatgctactcgtttctttttggtttgaagtcactattttattcagccgttttctcttcctctgttcagcacatacctaactgatgagacccacagagaagtaaaatttacttctctctgagaaggagagatgagagaaaggtttgcttttatcattaaaaggtatctgttttctgttgtttattttcagatgtcctttcttttgaaaaatattcagtggatatatagatatcaataacctgagcaaagagatattggcagtaaatatcaaagaggaaatttacattcctgttccctttgctaaattattgatgtgttcttataccattccctttgaaaacataatgtgtactgacaggctttgacgtaggctttaaatagagttatgttcccctagtccttttatcagacgatctcacttctaccttgtaaaacagctgtgaatccaaaagtaagaatttgtgagccaactgggaaataaccacagaatcaactcattttaagtgcaaggaggaaaaatgcccttttatagaaaccaaaatatattttacttagttttgtaaatttattcaattccaacgtataaataactctgtaaagacattttatcagtttccctgggctgggatatttttagcatatcaaaggaaaacaaaaaagtcctcagattttgaaaagtaatggattgcattgccttaaacccttggaccctgtccaccttctgtctttgaactgaactggaattattcctctgtttgtgctagaatgtgtgtccgcagagctgggaagagatggagatacatatcccacctcttataatgtgaggccctaacctaggttataattaaaagtttgggagcaggatctacaaaggccagctggaaggacaatttcttagtaaaagcaaagtgatgtctttggttacaggaggaaagggaaagacaaaacataccaaccagaattggcggtctgggcctacccagtcctatatacagtagttccttcttatccacgggggatacattccaaaacctctagtggttgcctgaaacctgggagagtactaaaccttatatatactgttttctcttaagcatgtatacctatgatcattcaatttataaattaggcacagtaggagattaacagcaataactaataactaataatatcaattataaaaatatgccagcatcactactcttgtgctctgaggccactaagtaaaataagggttacctaaccacaggtactgtgataccgtgacagtcaatctgataaccaagacagctattgagtaacaggcacatagtgtccacagcatgggtatgctggacgaagggatgatttatatcccgggagggatggagtgggacagtgtgagatttcatcatgatactcagaatggcacacaatctaaaacgtagttctgtaattttccatttaatatttttgaccgtatttgactatgggtaactgaaaccgtgcaaagtgaaaccgtggataagggaagcctactatatcttcttagtctcttaggacacttttgagactaaagccaactaggaaaatagtttttagactctctctgagcttcagggtatctgtaaacatttgaagataatttaatgaatgctgtagttaatattttgccatcttcaaaatagcttcattgttatatccaataaatgtttctttaaatttatgttaatgccttttatctttggcatagattggatttttatttaaaactttatttaaagaaagagattctactactatgggaaaaaaatatttacttagaaaaatatagtggtggccagtcctggtggctcacacctataatcccagcactttgggaggccgaggcgggcggatcacttaaggtttgagaccaggttggccaaaatggtgaaaccctgtttctactaaaaatacaaacattagctgggcatggtggtgcacacctgtaatcctagctactcaggaggctgaggcacaagaattgcttgaacctgggaggaggaggttgcaagtgagccaagatcacaccacactgcactccagcctgggtgacagagcaagactctgtctcaaaggaaaaaaaataaagaaaagaaaagaaaaatatagtggtcttggagaattcagtgacaggccaaaccattaagtctgtcatcacaacagtccttagggaactgcaatattataagtatagtaatgacgcagtagagaaccataatgatggcctccccggcaaagaagaaccaacccgtttacgcctgaggttgcaattttttgaatttttgcagtcagaccctggcgatgaccttgagcagtaggagataaattccacatgcttagcgttccagtaatggaacactaggcataaatgggttattaaagtatccagaattaacatgcttagctgtgacattggaaaggcaatgtgtttgctgtggcacacatactagtaaataatgactggtccgaatttggttttcgtttgtctattaaagtcaatttactaaggcagggagggcccagagctgtgctgtccagttcaatagccatgcgtgactgctaaggacttccaaagtggctagtccaatgtcaggtatgctgcaagtgtcaaacacacactggatttcaaagactaagccaaaaaaatgtaaaatacatctcaatattttggttatactcggttaaagaaaataaaattatttttgcctttttatgtttttaaaagtggcttctggaaaattttaaattacatgtatgactggcatcatctgtctttggccagcactagactagaataataggttttataaagatgtctattgttatactaaaagtgtgacgtaaactttagttatttaggagactcttagtggaatacatgattttcttgacagtgaggggtagatgaggcatcacatacttgaacagttagaaccactatctttttaaaggttctgtgccagagctacagctttaaaatggagggatcaggaaagcatgcgtttgtctccagtctttcccattggccctacatcaaaatgaggacatagttactaagtactttgtgtgctactgctctatttcttgttttggaggggatcaaaaatataagacagggataaaggaaggttttttttacagtgagaccagttgaacatttgaaattattttaaaagaataatttatttcccaggttggtggctcattactatatttttttaattgttcattttctgaataggcttctggaatttaatttctgtacttaattatatttatctttgacatgatctttataccttggtttgcaggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttcatgatgatgtgtttatttctagtgggttttgtctcaaattgaagtatgtttctaattgggcccatcttctaaccattccactcccacagccattcctcctgtccctcctagctcagacccttaagtatccccaggcttctccactcccaacccatcacatagatactgcacagatatccagtgacatcacattacctactggatgaagtccacatttcttagcctgatacttgaagaccttttacaattaaatcccaactttcttccccaagcattttctattgcacttcttcaaataacctactctcagtcaagcctgaccatttcccctgtgctttctgctgtattcctagttcattgttgcttgaaacacctactgtcctgttgagatcctatgcatcttccaaggcccagctcagatattacccttcatgaaactgtgcctgatttctgcccagctcttatagtctttattattacctaaccttgggatagccacatttaagcatctatatatacgtgtccagtagaagatatatcttctgcatcctatgatcgcatatgtagagctaaataaaaacccaagtcctaacaaagtataaaatttatgtaactagtaggatttggttgtttctgcaaaaatcattgttgctctctctgcagatttgaattaagtcggattgctaaatttctcagagcaggcttcagtgtttctcaaccatggctgcacattgcaatcaccgggggatatttacagacacctgggtcccacccctagagatttctagtgtaattgatctgggatgtggtttgggtgtagggatttccaagcgtcctaaatgattccaaagtgcagctaaggttgaaaacccatgcattagtaaatctcaagccccacagtaaatttttctatataaacttgtaaagatagaagttaaaggcttatatttatagaagaaaattatggctttcttaattcagcctattaaatcagaaaatttcattgaagacttgaattaaggttttgttgtttggctaactgaacaaggctagctgttgtttagaaatacagaagcattgtctcaaataaacataaaaatacagaagcattctgtttaataaaacactaggtgaaaattatatatatatgtgtgtgtgtgtatatatatatatatatatatacacacacacacacacacacacacacacacacacacatattttgagatggagtttcgatcttgttgcccaggctggagtgcaatggcactatctcggctcaccacagcttccaccttctgggttcaagcgattctcctgactcagcctcctgagtagctgggattacaggcatgcaccaccgcgtctggctaattttgtatttttagtagagacggggtttctccatgttggtcaggctggtctcgaactcccaacctcaggtgatccgcccaccttggcctcccaaagtgctgggattacaggcatgagccaccgcacccggcctgaaaattatattgactatgaatagagcattttggaaaatcttatgtgaccttgagactgtaatgtattttttaaattgggataaaatacatggggacagttagttactttgtaaggtaactaacaataaatctgtaagaatgctgaagggacttgggattagaaggaatatgaatttgtggtgttcaagtagattttagggtttgtgggaaatagtcaactctatggtattctaaaacttagtaatgtctttcagctaacattttaaccaagaatgagcttttctgcatatttttaaattttgcatacttgtacttaagtaggatttaacatggagtctaataacttccagaaatgattcaaaattgagtgattgtacatacagattttttttttttttttcctggactacactgttttcatcagaatttctaggctcactcagaaaaggttacactagtatgactaatcctttgtaaatcggagcactgct

SEQ ID NO: 15153 - DNA, 6587 bp, Human
ttacatatgtatacatgtgccatgctggtgtgctgcacccagtgtaagagattgttagaattcaaatatattgaaatgatctccctttttctttttgagaattttacaataatctttgaataatatgaagcaatttggtatgtcccaaacttgaaatgagaaacattgccactactattgcactggaattttctattatatacaacagaaactaaacttgatacagcctaaacccaaattcatttgaatccattaatgaagtaacatgtcttttctttcaaacaaaagtactgttaagtgtaatgaaaatgcataactctacttctacactgacttaatgaggtttcctaaaattaagagatttaagtggtcggtaaattgaccctcagtcacatctttagaagtgcagcagtgtatatatgagcttaaatagaactctaaatgtcaatgcattccctatttccacaatattgctgaatgtagtatttttaacacattattttaagcactatgattgatggctggtttcctaaatccacagtaagaatccaattgagagttcaactgaaccctcaaagtaaagtggcaataaagcacccaatcaacaataaacttctatgttgcggactcttaaaatgcagatacttttcgaggaacattagttttatacaaaaggtggctcctagagtatagtttctcttgtaagaaaataaacttcaaattttaatacaacaaattctatttgtggtataatctaaataatgctaatataatttagagaaaaacaaacgatttagtaacaaggcataaagagactttccttacacataacatgctaaatattactcgtttttaaatggtgccacttggtaacgaaaataccgtaactttatttgctttctttaaacttgccattctggaaatcagatttgtgttttaacagatttacacaagcagtccactgaagagtggagcaaaatttatcataaatctgatctcactttataaaactcatgatgaaaaattttccttttatatcatttcatgtaattttaaaactataaactactttcccagaaagatgaaatgtgcaacactctgaaatcacctaaattgatactgctattcttaaaacataaaatcaaataaatggtcattcatacagcaccaaaaatgtctttggaaaaaacaatactcatatccacttaccacccaaggttgcataaagaaaaaaaactttaactccaaatatataaaataaaacatgtttattttacataggaactgataatctgaagtataagatgctaatttccaaatgtatcctggcttgtgtgtagccttggtcaaatgatcattgtatcagaaagataaagaaaaaataatcgtatttcagtacttctatacatcctaaaagggaagacggaacacttaagtggttgataaatttgaaaagctgattaaacataataatcaccatgttgggggaagacataaaagtcataaaacagattttttataatattaaaaaagtgacatgaaaattatacaattttagaaaggaatataaaaaggcaggagttaaaaaatagtgggactaatatcatagaaaactatccatgaggaaggtcaaatttattttcaacatgtaaaaaggataaagagtagaggtattttaaaaattcacagattcttaatgaggcaaatgttaaaatatggaacccaatctcagacaaatacatagaaaggagtaagggccaactctcatgcataaggtatcccatcctatagcaaatcagatatataggtacgcttgatgccacaaattttttaaaaaattgtccattttgttgcgtgtgcacctcttgccataaatttgagtcagcaccagcgacagctctgcagtcctcctatgtggtactgatcaggtggttgcagagcttcagctcacagcaacacaatgcagctgagcaggcaagcacagcccacagccagaaacagttccgactctacagaacaagacgacctttaagtttcccagagaaaatgagatgctgatgttgaagacgacaccacggtaagatgttatttaaatcagtaaaaggctgactttggaatctttttcctttttcttttaagaaaaagtcaacgttaggattaaatatatattcaatagcaagtgcatgcaccagaaatttgctgcagtgtcagttgagggatattttttatacattcagtcactctgtaaatatacatattgttttcctttaaaatgggcactgaaatatacagaaaaaaatcactttataaaatgtgaggtttataggtactgtgttggtctggatttttcaagtgctttttacaaagatatatttatcctaaaaacatacagataaaatttcgaagaactgctttaatatctaaataaaatctaccctatatacacacattgaattacattactgcagagattaaaaaaaaaagacacgacagccattttttctcatctgagtaagaaagcatatcatcaaaaatagtaatagcctacaactgcaactatttatttgcaaagaatgctattttatcatattaaggctctagaaagataaataagaaagaatatggttagaaaaggggggagggagagagaaaataaaggagaaaatgcaggagagagtagggagagagtctctctctaccacatagcccaattgaaggattaagcatttggactataaatgaaggggagctttgttagtttaatcactggaacaattataaaaggactcgacaacaacgaggtttattgaaaattttgcctaatgctaactgacccatgcagatgcctaaactgtatttgcatattaaaagaagggtgtatctgtttgtttctaggctttgatggaatatcagatattgaaaatgtctctctgcctgttcatccttctgtttctcacacctggtattttatgcatttgtcctctccaatgtatatgcacagagaggcacaggcatgtggactgttcaggcagaaacttgtctacattaccatctggactgcaagagaatattatacatttaaacctgtcttataaccactttactgatctgcataaccagttaacccaatataccaatctgaggaccctggacatttcaaacaacaggcttgaaagcctgcctgctcacttacctcggtctctgtggaacatgtctgctgctaacaacaacattaaacttcttgacaaatctgatactgcttatcagtggaatcttaaatatctggatgtttctaagaacatgctggaaaaggttgtcctcattaaaaatacactaagaagtctcgaggttctcaacctcagtagtaacaaactttggacagttccaaccaacatgccctccaaactacatatcgtggacctgtctaataattctttgacacaaattcttccaggtacattaataaacctgacaaatctcacacatctttacctgcacaacaataagttcacattcattccagaccaatcttttgaccaactctttcagttgcaagagataaccctttacaataacaggtggtcatgtgaccacaaacaaaacattacttacttactgaagtggatgatggaaacaaaagcccatgtgatagggactccatgttctacccaaatatcatctttaaaggaacataacatgtatcccacaccttctggatttacctcaagcttattcactgtaagtgggatgcagacagtggacaccattaactctctgagtgtggtaactcaacccaaagtgaccaaaatacccaaacaatatcgaacaaaggaaacaacgtttggtgccactctaagcaaagacaccacctttactagcactgataaggcttttgtgccctatccagaagatacatccacagagactatcaattcacatgaagcagcagctgcaactctaactattcatctccaagatggaatggtcacaaacacaagcctcactagctcaacaaaatcatccccaacacccatgaccctaagtatcactagtggcatgccaaataatttctctgaaatgcctcaacaaagcacaacccttaacttatggagggaagagacaaccacaaatgtaaagactccattaccttctgtggcaaatgcttggaaagtaaatgcttcatttctcttattgctcaatgttgtggtcatgctggctgtctgagggtctgcattttctgaaactaatgaaagcactcctccctgatgtacagttgggaaaatatgtccatatctaaccagtgattcgagctatatttaagtattcaagaaagccagtcttaacatttctaactctgatgtaaatgaagtaacttgtcttaaataaaagaaatgcacaatgtcttggtacttgctgctattttactgtcttaattaagtaaactaatgagtttcttttataaaaaaaatgaaatgttttaaggcttcaatttattgcacaaaatataaagcatctaaactttaatatgtattttatgtatgtttacactgtcaaacatctggaaaataaaaggtctatgctcataactgtgtcatttggctttccagtcataccaactttagcagaatcaaaatgacctcaccatttttgttctagggtaccttggtaaaatctttaaggtaaataaaatggcggtagtatccaaggatattttactgaagtaaaatcgtagctgccatcccatgaatggttatgctacaacattattttacagacaagccataattgttttaaatctaaatgatgtcctgcttctgaggaactcttggctacttgacagattatataatggacaaaagctcttcaaaaagctagaagacactaggctttgcattttaataagaaaagtttaacggttgtgttttttgcatgtaagaaaagtgttaaaaacataatgaaaaaatttaaaaacatgtaaagaagcagttttagtgcagatttaacacaccattaatggagaatttaaatatttacaaaattaaaatcctactacatgaaggagaagaaaatttatcttttacaaatcagaaatcagaattacctaaattaaaaataagattagcttaagaataaaatcattgggtctgacgaacttgggcagtactgaggaagtgaggaaggagagagggaaagggaaaagggcatttggtactacaaccaggtggtgaacccagtaaaacagactgaggactaaggctaggcatgggacagagatcttgacactccaaatcaaaccacactggaactccaactagaagaaaatcactgagaaattctctacaaatataaaagttagccaacttatgaattagtgacaaacataagaaacagccacaaggcagcaaaagaagtcctgaaacaggattgattaaaatgcaagacagcataactgagatgggtgagacacaaatgtggtatttaatttgtgagacgtaaggcagaatctcatttcaagcatttctagaggtgggaaaagatagagaaaggaatttttatgttccttcgtaaaaacttttaaaaattcagatagcctcctttgctggtttaggaacatttctattgagagagagaaaagtaacaacactctaatgtgttcttttttttgctttttaaggaccaggattatggaaaaattaccattaagcttcaacaaaacagtcatctttcatgctgtctagtacagtggctctcgaacattttctgccttagcaaacctgattggctcactgtgtcagggaatctcaccatgaagaaacaggattatttgaaaaagtcccctaaatgattttaaaatgcattacctctctatatacggaagctatctccactccctcccaaacactgattagtaccttcaccatccatgatagggactaattgcttagataatccctactctaccacatacttgtgtcttatttaaaaaaacatatacaccgactttcacagaaagtaggtttctttttttttttttttttttttttttttttttttttttttgagacgaagtctcgctcttatcccccaggctggagtgcaatggcgtgatctcggctgactgcaatctccccctcccaggttcaagcaattctctcacctcagcctcccaagtagctgggattacaggcgcctgccaccacgctcgactaatttttgtattttcagtagagacggggcttcatcatgttggccaggctggtctcaaactcctgacctcaggtgattcgcctgctttggcctcccaaagtgctaggattacaggcatgagccaccacgcctgccctgaaagtaggtatcttagaggtaactgtcttttcctctgaggataccaaaaactcaatgctgtcttagaatttttaaggggaaaagtaataagaaagtcaaattatagactactgcattaggagcacctatggattatgtcaatcctacagacatgtctgcaaaatgcagagtcaaacttggtaaacttacaagtacaatatacgtcaactactcagactctaagttcttagacagaagaatta

SEQ ID NO: 15154 - DNA, 9600 bp, Human
ttttttttttttttttgtactttttgtttttgtacatagtaacgcgatacacacagctatctacacacacacgtttgcacgcgcacgcacacacacacacgcacagagacacatacacacagagatttaaaaatatatatatatttatattttaaaaagcaggaacccagcctcccgggcgctcgctagctcgctggatcgtcgctgtgggcttccaccagctgtgcttatcagaaacgccgagacagctccccacgagcccacacacagacagcggtatatacatggggggagaggtggtacgcggatggaccagaatccctgtgacctttgccaatcatttcattgccgttctgcactgagcagagaatgcctatcccccactccctcgccacccctccccaagggtttcttactcagagggggcggtgaactggaggtgaaccgaaatgggaggcgctggcccagtcgccagcgtctccgggtcgtgatctccagtgaaagtaatcgcgtgtgaaggcaaagtctttcctctaggagggccgaagtgaggtcgcgcggaaggtcgccctagcgaggctgggggcctggatttctgcgcgcaggaatcctggagtccggtgagtgcggagccctcccagactgtcaggccacctctttggcccagagttgccgccgaatccttctcagatacctcgatctatgctgcggtagcctgcgcgggctccacacttccaggagggagggcagaaagctgcgaaatcgccgctgctacttcgcactagtttgcaaacctaataggcttccctattctgcccttcctaggcactccaccccggaaaaaaaatataaccaatatcatcatcaataactctcttcgttgtatcctctcctcctcatagagatttgggaagggggggggggtgagtagataggcatctctctccccgcctattcccattcatctcctcccttttctaagcaattaaaaagccatcagctcaacgaagtagtaataataatagcaataataacatggagtggtcgattagatacaaattatctcacaaatattgtgtacagattgtagtaaaacaccgcagacatttagaaacgctatagaagtttttaaaaatgcaaaactagtctattgtaaaacaaatttcacctgaaatacagctgctataaccaaggcgctgaaaggttattcagaggcacacatctgtcttcccaatccctcccccgccccaccccgcccccacgttatcccactccttgttcttcctagagaggagcgaccaaacaaaccttactctgagtaaacaatatgtattgatcagcagaaaaggctaaagggaactgttgcccggggagccaggaatatgagatcccagcttggactgcttaatgtaactgtgtatcagcattgagaagcctgaatgagagagtatgtgtttcctttgtcaacagaagttagaacctcttatgaaaaggaaagaaaagggaaaaaaaggaaaggaaagcaaaagaaaagaaaggaaaggaaaggaagagatggaagggaagggaagggaaggggaaaggaaagaaaatgaaaggaaaggaaagggaaaaagaagggaaagaaaaaggggaaaggaaagaaaaaggaaaggagggaaaagagagagagtacgagagagcgagcgaacgagagagagagaaaaataataaagaatactagaatgaaaggaagagagtgagagagaaagagaaatccgcgctgctcccagtgcggccggccgcctcctcgcttcctccagtcagagatcatggcaagatgtgtctgttttcacggtgtgcgaataaacctcatgcggctgctgatcccctggcggagtcattcttttctctttttgtcttcgattacagaaccagacacgcaccacttccttctccaactggaggctgtctgccagcgaggagatctcctgcgcggcaggcttgggacacttgaggaaatgcgtctccagtacgcccttgacactcacctcgatggaggtccgcttcttgcgcttgcggccctgtgcagcgatcttgtcaatgctggtcgggctccctgtggacgaatccgcctcctccagccacttgttcagcaggggcttcagcttgcacatatttttgaagctcagctgcaaggcctcgaacctgcagatggtggtctgcgagaacacgttaccatacagtgtgcccagcgccaaccccacgtcggcctgcgtgaagcccaacttgattcttctttgtttgaattgtttggcgaactgttccaactcatcagaggttggcgtctcctcgtcggagtgatcctggcaatggtgcgagcccagttcgccgtgatccgggggctctcggagcaccgggtgcaggctctgtgcagaggcggcagctggaggtggggtgagtcccccgtgttccagcatgccgctcacggtgaagccaggctgcgagtacacgttgaggggttggccgcttgacgtgatagacgggttcggtgccgggctggccccccaggcgttggggtggttagtgtgcggtgagtggtgggctacgtgtggcgagcggtgatggatgatcgcacccagttgcaggtcttcgcgcccgggcttcacgtcctgctggtccagggggctggtggccagtgtggaggaccatgggcccccgtcgctcagactggtcacccagtgatgcccgaggggatgcccattgctgggaactccctgcaagtaatcactttggagaagtttctgagggttgcggaaaggactcccctgctgcatgcccgcagagtccgcatggactagggaggtggaactgagaatgctgtagggattcgaggcagctgtggccatggtcggtgaggatcccctactagttataatgtggcaaagggagcagcttcagcctttgacatctacggtgcggggagccaaagacgctagcacgggttaccggcacccaccacggccaatcgcagcgcgtctccgcctggccaggagtaagcccggccaatagcggtgcgggaggtcgggctcgctttccaaattaggctggtgaagctccggagtttcaatgagacccaagcaggaagtgaatcaatctttcagctccattggctgcctagcgcagagtggcggccgtacatttgattactaccccccccaccgcggggtttatgttgatggggaaaagatgtgagggatgtgttgttggggggcagtcagggagtgaggtggaaaattaaggttgtagaactcctttttgattatttagattaatctaaataaagaaaaagtaaagcaagtttaaatgtcattttgatctcagtgaatagggatttttcagactcactcggctgtctgggcgggctagttgtgtgcctaggactgcaaaacaaaacgtcgctacaaactttgagcaaagtaacgtcttcgattggaccctaaaccaataaagttgaaaccaatgattccaataagaacatttcagtttatttcattgtattaagaacctcgatatcaaggtctgaaagcttctaagagatatcctgttctttcaatttttctgaaaaattttttaggtcacgaagaactgaattattctgggaaagtaaaatctaatgtgatactgacaatattcagttatttcgaagtttgcttcccaatctagctggtcaattggaaaccttgctttctcactgctccatatcagttcccatcacagatcccacaacttctgtcaaaggttctgcttgctgaagcgggcagccctcacactcacccaaaacactctgcagacccactacgaataggtatacaggaaaacgttcgtgaccccgcgccccgatgccatcccctaggaaaattgtttttaaccttcaccgctcccccaccctcctcacccgccctgcatttaatgtgcccaggaaattcagagagagagaaatggcgggatgtttggcatcaagtaccgcccccacttccccagtccccatcaagcttgaatttgctttcagcttgaaaagataggactgcttttacattttggatagaataaaagaggtgaaacacttgtgctccttctaagcttttataagttaggaaaggacaagtccgtgtgctccacagcccggcgcaaaggcagtgcttggaagcagagtggggagaaaggcaaagatttgatttgttctagctgagaaaaggcaacaccagatacccaacatggtctttgaagttaaaaaaatgacctttcgttgaataattttggaggtaacctagctgcctaattatatttgcacttacagaagacggcatcagagttcccttattggtttgaaattccattaaatatattgcaagagcgcctaggttaagcttgatttaaatttgcatacattttcatatatttagcagaaataaaagaaggcttgctgctaccagaaagtcattaaggcattagtttctctaagaagacagatctgaagaatgtgcaagaaaatgagaaaaaaataaaaacaaggtgagcttattctgccattcctttatatagctaaagagcatctatttcctgtgaaatgagtaatttcttatgagagcacagagcaataggagctgatattggtaagtgtaaacgtgtttattaggcatgaaaacctggcatctgattcagatctatttctttttttcactctttttttttaaggtaaacacttagtaattattggcagagaggatcatttgccatctcaccccctcttcctgctctctcattgaaactgtagcttcatttgcccacgtcttattgtagaggcttatctgcttttagaaattgagttttcctttctctctctctctttctctctctcccgccccccccaactccccaccttttctgctaaggaactcattctttactgctaactgtttgcatcttcctttgcaagaatgcaatctcatttgtgcctgaaattccgcttctggaagaaacaagaacttgtcaaaatcaaacaaaagtaaagtttttaggtgctctgttaagctggcctttggaagatccatttgtgagtctgtgtcggctcaatttagaggtcagagggaaacgcgttgaagaaaccttacgtgtaaaacgatcatgatcattgccatgctgtttttgttgttgtaggttccccacccccaccttgcagctgcctttgggcgagagttgctaatcttaagccattcagggggttaaggtaattatgaaatgataagacttttgcatcaagaaggggatcttttttcaatcttgacttgcctgagttcttacaatcaaccttcctcttgcccatggcctctgctcctggtaccctattttgccagccgcatcaagtggttcagaccatttgccagaggcttggagggggagaggtaaggagggagatctgatcccagggacaggttttttacacccttactttgcagttttttaatgtaaaaactctctttttaatggaaataatagctttcgtcaggagcacaaactgtcgttatcgcctttatttttcttttctctctcctctttttctttctttctttttttctttctttccatctttctttcttcctttctttctttctctttccttctttcttttatttaaaaaaaatgtttccatgaatatagatactgcctattgaattcaggtccaatcacatcctctagtaactgtgatagaatcttctcttgcatgtaaggtgttttgttttttgaataaaatatctgcatatagtcaaatcttcttgctgttctaactaatctgctggagaggtttccttcgccctctcctgtcagtttaacttcccaagtgtaacagatgccgctctcaagcgctcctttctgcagcttctctttattcagcttcacatatttctccccatgatctgggtttccatagagagaggaataaaaggggggaccatggtcacaaatcccctgccccatgcaaaataaaagagccacattcaatagacgacccgtctggacatgggagaaaaataagttgatacgaagctactgttgcaaagagctggtaactaatttttcatagactgcattttgccttaaactcgaagttaccactggcaagcttgctctctcatgcagctgggctacatacacacttgatgtgctccacatcctgatcttgaagcccaaacccggtcctcagatctgcttctccccaccccctctagagctttggtttgaataatataacaatagctgtggaacctaccgggtaggggcagttaaaagtcgccctagagaggagcccagctttgaagtagacaaactgtaattgtagcgaatccccacctatcttcagcaaagcagcacaggtttcaattcctgtgccaggcaagaacctggcacaatttttattccttgttaagttgccctcacactccaattacacaccccaccttaccctttccccttgctttgtttctaagagggcaattcagatcatttttaaaagaaagtcagattggctttatttatatatgttcatttatttgtaacttcagagtttgcagtggattttcttcctcacaagatttagggataccagctcctgaacgtcttcacagatacccactcccctttctttctaagcaaggaaagattcacaaaagaaattaagcagattaatgtggttcaggttgtgttcctgtggaaacatctgagcacggccgcagctgggtagcctgcgtcctggctcctttggaaagtaccccagccatggggattgtgtctcttgcagatttcatatgtgagtgtagattatgaagcattctcattatgtgtacaaattgagggtggggagaggaaggtggtttggggctgaagctggcagggggtcaggacagggagtagcggtggggggtggagggggttcaggaaataagttcaaaaggccagatttgattgtgtgcaatatagcatgaagctccaaatggcaggacatggaacataggcattatctcaagatgaaaacttcaccttcaacccaagttcactttggaaacagaacaagttagattgagcttggtagggacaaatgtacattttctttttaacaccgggagctcataagggaaggaaacaattgaacagacttctcaaagcagcagggaaaaaaagctgttttcctggtttctgcatattgatctcataagactgttctcggtgtgagactcagctgtccttcagagcactagcccactgcagctcctcttatagtcgccttctttcttcttctccttttttctttttcaaaagctgtatgggatgggggggaggtaaggggctcctaatattctggggaaaatttttaaaaaagaatttagatgacattaggagacattgccaatactgatggtaggacatggcaaaatagttcataggcatgaaccaattgagctcaagctcaattagttcattttttttttcaggtctctattggctttcctgaacgtaagaaaaagaatcttcagagaaaaaggaaagaggaagaggggagggggtgagtacacacagtgaatgctgcagcagaaacagggaaacttaaaatactcctcatgtaaaatctaatacaaataccccaatctgtgagaaccactagtcatttgctagcaaaattgaatgctcgggagaagtgctgaggcattgtgtggcaggggcctctgacaggatggttagaggacaggctgggacaatagagaccctcactaccaagggaaaggatgcttgctcctataactgcgttggccaggtcgtgtccgtccagtctcagtttctctttagggatcacatttttgccgttgcaatgtcggtgggtgaaccctaattttacagtatcccagagaaaagagctttacagagacagagctattgtgtcatactcagcatagctatcattttcctggcaccaggatttggggtgtttaggaatcattgtgcagttttgcactgcagaccaagcctagagtcgaggaacccagcggatggttttacaaaatatataacacacgtggaattacacttttatcaaaaaaaaaaataagccgcagaatgcttccaaatttaaaatgcaatggtacttttgattttcattttaattatttttttgaaagtaagaagtggtagaggtatttaaaaacgaaaaaaaaaatagtcatagctgcgcgattgatcagagggcgggtagaaatctcttactttaaaccctgcgcgcatcggtattccagtcatcaataagtcttctggctgaacattagaagcttttcttaagtcactatagtagttaatagagcctccccaaattgcaaatcacttccttcttcatggatggattaaggttttaatgtgcaaaattgtaagaatgcttaggcttcattcctaactgaggtcctgtgttccctgccaccctgtctccccgccccttagtaaatggtatttatttgtctgaaacggcgtgcgttccacgtccctttgtggttatgggacaacaggaagcttgattatagattgattatgggatccttctggaaatgacttttagtaagtaatctgctcagtgtctggagctcacattaccatttcagggctccacaaagaacaagaatgtaagtttatcactttgaaaatgagcaaccgaccagatttaacctgctgtcatttttcagaaatttcaattactattatcattattttccaggaggaaagagtagagaaggggctgctgatgattatgaaaataatgtgtagtgtgtgtgtatgtgtgtgtatgtatggggggattgtggccccccacccaacaaaatgtatacacacacacacacacacacacacacacacacacacacacagagagagagagagagagagtttggggaaaagtccaatttgcaaggacatttggggaacgcatttttaacaagaatattaatgcttcctctgttgtgattgctgttgtgttagttcttctgggggaggggtgtgagtttcctgagtggtcttaaaatttcccttttctgtaacttttctttggaccgacatctcttgcactttgcctcactatggatttgaggaatcgatttagctcccctgccccgagaagagttcccttcggtcgggtattccggtttccagctgcctgtgaatacatcagtcaggccatcgtgggtgttgtgcgtgcacacacacatttaatatccaataactttttggaatctcttttccaagtacaagagctcaggtagacagcagaacctagcccctgaccagtgctttgcccttggtgattctgctcccggctcaggtggttgtgactcccccagccagctcgctcccgttctggtgttgccgctaacccaagtcagctagctccattctgccgagatgcaaagccataaagaatcaaggagcttccccaaaacatcagacaaggcatcggcaggagggggcgcgatttgggcagcaacaggatccctcgccttctggagagcttggctaaaatgtcca

SEQ ID NO: 15155 - DNA, 6975 bp, Human
aatgagattctctattccgtactgtatatgccttacttttgcgttaccagtttaatgtaatataatatgaaataccttgttgcctcttgaaccttaccacgaaagtgttcctttgagccttaagaataaaccagctggctgggcgcggtggctcacgccagtaatcccagcactttgggagactgaggtgggcagatcacctgaggttgggagtttgagactagcctgaccaacatggagaaaccccatctctacttaaaatacaaaaaattagccaggtgtggtggcacatgcctgtaatcacagctactcaggagggtgaggcaggagaattgcttgaacctgggaggtggaggttgtggtgagccaagatcatgccattgcactccagcctgggcaacaaaagcgaaactctgtctcaaaaaataaaataaaataaaataaaccagctctggccaggcacagtggctcagacctgtaatcctagcactttgggaggctgaggtgggcagatcacctgaggttaggagttcaagaccagcctggccaacatgtgaaaccttgtctctactaaaaacacaaaaaagtagccgggcgtagtggcgggcgcctgtagtcccagctacttgggaggctgaggcaggagaatggcgtgaacccgggaggtggagcttgcagtgagccgaggtcccgccactgcactccagcctgggcgacagagcgagactccatctcaaaaaaaaaaaaaaaaaaaaaaaaataataataataataataataataattgccctctcagagtggttttgtaactactactactaccatttactatccattaaagcaggatagttttaattccacagaaaagccaataagcagaaatgtgtcacgctccctttgtttctcttaagatttctgaccctaccagccctgaaggagattacctcaaagtaagaacttgacacattcgaggccaggcacggtggctcacgcctgtaatcccagcactttgggaggctgaggcgggtggatcacgaggtcaggagatcgagaccatcctggctaacatggtgaaaccctgtgtctactgaaaatacaaaaaattagctgggtgtggtggcgggtgcctatagtcccagctactcgggaggctgaggcaggagaatggcttgaacctgggaggcagagcttgcagtgagtggagatcgtgccactgcactctagcctgggcaacagagagagactccgtctcaaaaaaaaagaaaaaaaagaacttgacatgttcaagaaaattatgactacagggaagattctgcagtaaatgctagtggaatgggacaggaaaaagatgagacccagatcaagcacttcctcttgagaaatacagatacctctttcaggtgtaaattgcaggcattctgctagccattcaatgtctttgatatctcaggcccgtcaaggaccaatcttttgttttttgagacagagtctcactctgttgcccaggctggagtgcagtggcacgatcttggctcactgcaacctccacctcccgggttcaagcctctacacccagctataggagtgcgccaccacacccaactaatttttgtatttttagtagagacaggatttcatcatgttggcccggctgatctccaactcctgacctcaggtgatctgccagcctcagcctcccaaagtgctgggattacaggcatgagccaccgcacctgaccaaggactaatcttgatgcttaattagcaccactccacttggtccctttatccacatcaggcacaataaaccaagaggggctgttataaacacttattcaatgggctgaattggacctgtaacactaaacagcagcctagaccttcactgtggaaacagaaataactaatgccaatttcttttcaacttggacactgacttgaagctcaaatgctaatttctgcgaaaaaacacaaccaaagaaagtaactctcagctcatgaccaatctaaatttaagttatttatttaagccatctcctgccacaagcaaagggatgggagaccagtataccagtcatcatttgatacaagtaaagaaggtgagcttaaggtcccatatactttttctggtccatgtgcagagtaacggtccaaaccagtgctgtggtccctggtgcccgggtagtggtccagattctctttattcatcttcgtagccagttggaagtggattcacatgagggttatggaatagagtatggttaccatctccccagggaaacggctgtggagtgaagatgtcagttagataattccagaaaataatttagaaagaacaccgtcatgaactgcttataacggggtgacagatcatatataaaaacaaaatggaaattagtcctttatctactggtgtagttcaaccttcccattatttaaggagctcttataactaccaggggagcccttaaagttatcctggctacaggacagttttaattccagaaacaaatatggatggcagaaaatgcaagctcaagttagttactcatcatcctctccctagtaactagtatatccagtgctgtgtttatgaaagtgtaatcctcaaatcacctatatcaaaatggtggcagtattaggggagggagatgcttaattaaatgcagatttctggcaccatcccagacttcaaacaatatctgggctgggaaactgcagcccaccctgaattatcttgcctattacctttgaaaagcattactttagggcaacggtctccaacccagggtgattttgccccttcagggcacactgggtagtatcgggagacactgtgatgggggcgggggagggggaagcgggagtggggttgcgcaggtactactgccacctagtgggtacaggccaaggatatggctaaacatttcacaatgcacaagatagccccccaacaagaattacccagccccaaatgtcaacagtgctgaggctgagaaacctttactgtttggcttctaattgcattgtacaaggatgggagtgccgctcaaagactcaacaaattcaagagtctaggttaagtttctacaaggccagtcctatatgggctaggtgatgtaataataataataataataataacttttttcatcacttctcggccttttggctaagatcaagtatattattactatttttttttgagacggagtttcactcctgttgcccaggctgcagtgcaatggctggatcttggctcactgcaacctcctcctcctgggttcaacctcctagattctcccaccgcagcctcccgagtagctgggattacaggcgcccgccaccacgcccggctactttttgtacttttagtagagatagtgtttcgccatgttgacgaggctggtcttgaactcctgacctccggcgatccacccaccttggcctcccaaagtgctgggattacaggcgtgagccaccgcgcatggccagtattgaagaatcagaataagcccttgttaaagatacagcaaacaacagaggacacaacattgtaatatatctacatcaacaaccaatgataaaacagtcgagaaaaggtattggtggggaatagagaaagctgtcagtctcttcattatgcaactagtagctgccagatgcccatgttttgttgttgctgttttgttttgttttgagaccagagtctcgctctgttgcccaggccggagtgcagtggcacgatctcagctccctgcaaactccgcctcctaggttcaagggattctcctgcttcagcctcccatgtagctgctgggttcgcttacgcgaaccaccttcagactttgccactctaattggatttcccaaacctccaggctttacacaacggacacctgtttcagaactgtctcagaagtaaaaaaaaaaaaaaaaaaaaaaaaaagaactgtctcagaaggcaggaggtaggatgaatcggagaaaagggaaactgaagagcacttattgtatgaccttgaagaagagaattgagacgtaatcccaagtgtcagctgtccatccacaaaatggaagaaaatacattttctgtttgtgaggataaacaagctgtacacgcctggcacccatgccttcagagaatgaagaacttgcactaaggcacacataacgaaaagagaacggacgcttgaagagatgtacaagggcgtaccttggtcctgatgcggagatgggggtaggcgatgaactcgggtctctcgtgctctccgtggtgcgacttcaggtacacattcagcatgctgactgccaccccggggagcgcgacgaagaaggtgagagtcttccacatgcgagctgcggagaagccacaaacgttcagcgccggtatggggcgggcccgggtctcactttccctcccgcaaggcctcgggccaaggtcacagtccctccctgtctcgcccgagtggggctgaggctcgacccgtcgaccccggccccagtacctgagccctcttcgccatgggcgccactcgacataggccgccccagctgtgggcgggaccgacccagcagccgagaaaccgaggacacaccaactaccgccatttttgatctggactgccgcagcgccggaagcggaagtggaaaattggctctgggggcggtactacaacctccaaaggaagttactattgggcgccgccctcccactggcattaacctgagcactatcatccgggacgacggagtccttgtcaaaatcctcggcatctcgggcaagagagagcatgcgctctgcacctcccttcaggctttaccgtttccttcgtgcgcatgcgtgtgccctccggtctccctaccgtccccacctgggcgaggcggaagctcaagagaggtttgtgcagggtgccctggtacctggaatcgctcccttcgttggagtccatggacgggcatctggaggttctgatcccagaccgccctatctaaaattccgttccccttcctcgccatcctccgactgcgttttctcatagcacataacattgcaccttcgtcgttatattattattttgtctgtctcccccactagaatataaagtctgtgataccaagagtttggcactgcagcattctcagaataatctgggaatggtgtaatttggaatcatacctggcacataccagatacttgatataaatttgctgaatgaatggatgaatgaatgaatagcaacagaaagtataaagagcactgaaattggtgccagcagacctggatcctaatcctgactcaacagtctcatcttttttttttttttttttttttttttttttgagacggagtttgactcttgttgcttaggctggagtgcagcggtgcaatcttggctcactgcaacctctgcatcccaggttcaagcagttctactgcctcagcctcctgaatagctgggattacaggcacggcaccaccatgcctggctaatttttttttttgtactttggtagagacagggtttcaccatattggccaggatggtctccatctcctgaccttgtgatccgccttcctcggcctcccaaagtgctgggattacaggcgtgagccactgtgcccggccttttttttttttttttttttttttttcaataggcccctttgagaatgtaatgaggaccagcgtggtggctcatggctgtaatcccaacactttgagaggccgaggcggacagattgcttgagcttgagagtttgagaccagcctgggcaacaaagcttttttctttattagaaaaaaaaagaatctaatgaaagctttgaaccctttcctctaaagacacacctatgtgtaaacacacagtatagcacacattgttgggagaataggtgaccataaaatatatttggaaaccctctaagcatctttatgcctcagatcaagagctcctgggggctgcatgtagtggctcatgcctgtaatcctagcactttgggagtccgaggtgagtggatcacctgagttcaggagttcgagaccagcctgaccaacatagtgaaaccccatctctactaaaaatacaaaatgagccgggcatggtggtacatgcctgtaatcccagctacttgggaggctgaggcaggagaatcgcttgaacccaggaggcagaggttgcagtgagctgagattgcaccattgcactccaatctgggcaacaagagttgaactcccatctcaaaacaaaacaaaaaaaaggccggcactgtggctcacgcctgtaatcccagcactttgggaggcggagacaggtgggtcacttgaggtcaggagttcgagaccagcctggccaacatggtgaaacgccgtctccactaaaaatacaaaaattattcggcgtcgtggcgcaagcctgtagtcccagctacatgggaggctgaagcaagagaatctcttgaacctaggaggtggagtttgcagtgaactgagatcatgccactgcactccagcctgggcgacacagcgagactctggtctcaaaacaacaacagcaacaaaaaagtccgggtaggagaacaaacagggactctagtgtgagaaggctgggctcacatcttgttcccttacagcctgtgtggccttgggcaggttagctgaaaccgatgccttaaggtcatgcagtttcatgaagacaaaaccttaggatcatattactagagctttactacctgatttagcatgaaatctttctcgagtagcctaagtttttatacttcagggtgcaatcaagatcatcaaatctgtcaaacacgtcctcaaacacagccaaagggtatatgaggccccacactggggccatacaaagggtctaagctagccgggcttgcttgtagtcctagctacttgagaggctgaggccagaggatccgttaagcccaggagttcaagtccagcttgggcaacatagcaa

SEQ ID NO: 15156 - DNA, 20662 bp, Human
tgaagagtgagacagaaaacaaaatgctggctgtttgtcaaatcctgagagtagagggggcaaaaatcattctggaaggtggatgtcattcaagagaccttggaaatcttagggtgtcctctgcccagagggggaggggaatgaggttaaattatgggttgggtgacaatggttacactacttcacttctctgcctcagttttaaaaatctgtaaaaatggggatggtggcactcaggatgttttgtgaggactgtagctagctggaaagctcttaggatagtgcctggtgcatagtgagtgctgcattagtgtgagctattataattatgggaataggcaaaggtgccaccctggccatccagcgtgggcggtattttccagccagagtcctggcagtccacctggagatgaagatggttaagaaggaagtttaacttccaggagtggaaggactggggaggagtaactcatgctcaacattctgtgaaaatacatttatccaacagcaggaatacgtggagtgaatgtggcttctgtggtaattatcgtctcctgtttggggagcgtctaagagtgtgttgtaggctcaaatggtttttccaaaagccaagcctaaaaacaggcttcaggggtgccttgcaaattagcattccttttgccaaaaaaaaagcattgattttttttaatggaaagcattcgtcttgctaaaaaaaaaatcccctcttgtggcctgggtcattagttttgtctctgtgctatcctagattataaggtataaagagaaagactaaagaagaatgaataaggaagtgcacatataaattaacagggcagaattgggatgggtatgtgtaagttaaggggacataggtataaatttttttttttttttgagacagaatttcgctctttgttgcccaggcttgagtgcagtggcgtgatcttggctcactgcaacctctgcctcctgggctcaagcaattctcctgtctcagcctcccgagtagctgggattacaggcacccaccactacgcccggctaatttttgtatttttagtggagacggggttttactatgttgaccaggctgttctcgacctcctgacctcaggtgatctgcccgcctcggcctctcagagtgctgggattacaggcgtgagccattgcacccggccatatgtacacattttatgcgaacataaaaaggacctcttgttctaaacagacctctccatataaataatgtgggctttcttgagtagatagcaggctctatcacaagaacattccagcagaatcaagagagaatgggtagctggcttctttgctaactggtagggtagactgtgtaagttgctgaagagaaagaagatgaaagggcagatgggtgagggtgaaagaaacaggatgttgaaaggaagagactgaaaggaatgtttaccgagggctcatcaggtaccacgctctgtgtttagtatcttaatttactcttgcactgtcattttctgatgcagtaagtgtcatccttgtgctgcaaatgagaagagactgtgggaggtgaagtgagtggtccaggatcatccaggcagttcacagcagagctggtgtgtttcaccttgaagtttgtgctctggcctgtgattcaggcagaaaggtgagacacagaaggaaggcaaagcaaatttttgttgtgggtgatgtttatgaaagttacttgtgttaggcagaataatgacctcctaaaaatgtccacatcctaatccctggaacatgtgcatgttacattatttggcaaaaatactttgcaaataagtaaagttaaggatcttgagatgggaggttattctggataatctgggcgagctcagtgtattcagaagggcccttgtaagtgaaagaggaaggcaggagggtcggagtgagaatgacgccgcctgagagactccactggccgtggctggctgtgaacccacatcaagagacagaattacaacaaatttagttatagagctaattggcttttatttgtgatttatgaattaaagcagcaccactctacaagtacagtgatagctccccctgggcaatacaatacaagaacagtgggttttgtcaaattggaacaaggaaacagaaccacagaaataaatacattggttaacatcagattagttcaggttacttttttgtaaaagttaaagtagaggggacttctgtattatgctaactcaagtagactggaatctcctgtgttctttttttttttaaattggttttaattttttttaattggatctatcttcttccttaacatttcagttggagtatgtagcatttagcaccactggctcaatgcgctcacctaggtgagagtgtgaccaaatcttaaagcattagtgctattatcagttaccaccatttggggcttttatccttcatgggttatgatgttctcctgatgacacatttctctgagttttgtaattccagccaaagagagaccattcactatttgatggctggctgcatgcagacatttaaagcttttagagaatacactacaccagggagtatgactactagtatgactattaggagggtaataccaagagttggactacgcaccttaggcaagatacaaaccaactaaaatagaataaagaatgagtcagatgagtgtagccattttaaccaagcagcacatttgttaatttctacaacttagtctcagcgatacccattgtatttagccatgttcaacaacaagtgtcagaaactgcacagactcctccctgttcagctggtagggagcaattctattatttggcattgcatggctgggttgaattaaaacagggagtgagaacaggtgagtctagaagtccaactctgaaaaggaccactgtacatttgaacacacggctgtgttaaagatgctgctaatgtcagtcactgggtgcactaaaggatctcttattttatgtaaaacgttgggattgacaagatagatctgatactctgttaagttaccctctgaagctacttcttgtgaaatactaatgacagcatcatcctgccaagcgaaagaggcaggcataagcaaggacaaattaaaagggggtaagagccttatcatgatgaggagtcttgttttgacatcttgggaaaagctgtccatagtgtgaagtcgtcaatttctcaccatggtttgcagtttgcctgtctctagttaggtgaagtctctgagtggcacacacctcaggcctgagggttttccctttaaattttcattgagttgtccatctccagcatatagggcttcaggagcagagcagaccttgtttttagtggttccatgggataaaatgggattggaggagctagaagaattcagggtctggtccaatctataggtggataatgaaaataaaaaacaataagcagagctgtgatgtcataacaggtgtactatagtttttttcaacataatttttctcttcataggcatctttatttctaccaaagataatcccagtaagacatatttgttttccaaataagtttagtctcatcgaacttggcctcattctttatataagtgcaacaagagtagcaggtgaccacatagtcttttttttttccttttgagacagagtcttgccctgttgcccaggttggagtgcagctcactgcaacctccacctcccaagttcaagcgattctccttgaataggagtataggcctatgtatagccctatgtatgcacatgaatagtataggcccatgtacgcacatgaatagtataggcctatgtatgcactcccaggctggagcgcagctcactgcagcctctacctcccaggtttaagtgattctcctgcctcagcctcccgagtaactgggattacaggagcccgccaccacacctagctttttttttttttttttttttggatttttagcagagacgaggttttgccatgttggccaggctggtcttgaactcctgatctcatgattcacccacctcggcctcccaaagtgctgggattatcgacgtgagctactgtgcccagcctggggtcttttcaagtttgttttacaggaagtttttataaggaatctcagattaaacttttagaaacctcttgacatgaggaagccaaaccaaggccgacttcagactttgccagcagtgcctatgggttcatctatgtatattcccaaatataacatcccaatcaaagcctgggtaatataaccagtgttttcaaatgtatcctgttataaagggagcagatttttattgagcaaataactatactattatatttattatataatattaatattaattaacaattacaattagtcgttaaataataattattaatttattaataaatattaataaattattaaataatgatcatcaaataattgtttatcaataataattattttataacaatattaataactatattttttgtgcaaataacgatattattataaacatataaatattcatgaataatttccgaattctggagcagtcaggtagggagaaaatatagatgtttcaatttttgttcgcaaaattgttgaagctctagatagcttgaaagaaaaaatgtttcctgaaatctgggaaacaaaacaaagaatccacaaaatttcaaataaaaaatcataaaaatattattttcattattatcttttagtctcatgaaatgaattctctgcttgctcttggttggcagtttcatgaagctatcagtttgttaaaattttggaaattcttaaatagtctaatggtatgattttaatgttatcagaaacttgtattcaagagtacatgtcggagtattttctgtaaatatcctcaatgaagaagcaattttggatggtagctgattgcaaatgctttaaggaaggaagaatcaaaataattgtcggggctgggcgcggtggttcatgcctgtaatccgagcactttgggaggctgaggcgggtggatcacctgaagtcaggagttcgagaccagccttatcaccatggagaaaccccgtctctactaaaaatacaaaattagccgggcatggtgacgcatgcctgtaatcccagctgtgcagggggctgaggcaggagaatcgcttgaacccaggaggcagaggttgcggtgagccgaaatcacgccattgcacttcagcctgggcaactagtgaaactccatctcaaaacaaaaacaaaaacaaaaaacaacccccccaccaaacaaaacaaaacaaaaaacaattgtcagtgaatgacaaagattgaaaatgagtatggttaaacatctgatgagagttcattatgataagaatgcatctcccaggtgaggggcgcctctgcccggccgcccctactgggaagtgaggagcccctctgcccggccagccgccccgtccgggagggaggtgggggggtcagccccccgcccggccagccgccccgtccgggaggtgaggggcgcctctgcccagccgcccctactgggaagtgaggagcccctctgcctggccaccaccccgtctgggaggtgtacccaacagctcattgagaacgggccatgatgacaatggcagttttgtggaatagaaaagggggaaaggtggggaaaagattgagaaatcggatggttgccgtgtctgtgtagaaagaagtagacatgggagacttttcattttgttctgtactaagaaaaattcttctgccttgggatcctgttgaactgtgaccttacccccaaacttgtgctctctgaaacatgtgctgtgtccactcagggttaaatggattaagggcggtacaagatgtgctttgttaaacagatccttgaaggcagcatgctcgttaagagtcatcaccactccctaatctcaagtacccagggacacaaacactgcggaaggccgcagggtcctctgcctaggaaaaccagagacctttgttcacttgtttctttgttcacttgtttatctgctgaccttccctccactattgtcctatgaccctgccaaatccccctctgcgagaaacacccaagaatgatcaataaaaaaaaataaaaataaataaaaataaaaataaaaaaagaatgcatctcccatagacatttagttacttctgtggcatatgacattatggcttataatctgttagatttctgggaatctcttataatttttggaacactcacatcaataacataaccataaatataacttagagaaggtttagcatcacttatcatttgacagtgcttcccatataatgtaacatatcaaataaggcggcttttccttttagtttctgtttctcagttagattactgagttcttggtggagcccattaatgaattaggccaacaaagtataggcccatgtatgttgaaaaagctccagaggtaattctaatcctcctagctaaaaaccatgggtttagccccaagtcctacctattagaacagggatcctccatcgtggctacacattagtagcgtctggagaggcttaaaaattaccaatgcctgggtcccactccagatcagtagatcagaatttatggttggggcttgagcatccgtttttaaaaatgtttcggagtgattccaatgtgtagctatatttcccatcagatttatctgaatttttgtggcattcgctcctttctactttggtatcatgattatttttcaggtcttatctcctgtcttgggctttatgttccctgggggtagggaccttgccttcttcatttctgtatctgttatgaacacatgaattgattgtcaggaaaaggttctcagccacatgcaggatgtgtccaaagttcacatattaatactacacagtctgtgttctccatgaaataagaggttgcttgtgatgaagggtgtgagtaagtccacagggcaggtagtggaggggagatcaccctgtttttaggtgtaacattgaaactaagaattctatgtgcatccggggtaaaggggcagggatgtgtagagagtcagattctaattaagatggaggaattatactgggaagtagagggaaaggaagtaagaagaattagtaaagagaagaaatttgaacttaactagtaggccagagcaggttcctttggcttctttttttttttttttttttttgagacggagtcttgcactgtcgcccaggctggagtgcagtggcacgatctcggctcactgcaagctccacctcccaggttcacgccattctcctgcctcagcctcccgagtagctgggactacaggtgctcgccaccatgcctgaataattttttgtatttttactagagacggggtttcactgtgttatccaggatggtctgtatctcctgacctcatgatccgcccacctcggcctcccaaggggctgggattacaggcataagccactgtgcctggccccctttggctccttaagtaggtgagtgaactagattttaggaagataatgaggcagtcatatgcaagaaggattccaaccttacaacaaggggtcaagcaggatgttgaacaattattgaggttgatgggaatggagagactgacaaaagtgagagatgttgaaaaaggacgaagaggctttgacaatgtattgactctaggaaacaaatgagcagaggctggggataattatatctaggagacagtggggtacagggagcatgaagaccagggaagaagagacctgcaggaattagtgctgagaagcaggagtttagcggtagaaggagatccagtcccagatacaggtgaagaagtttttttcctttcccaagcatggtggtcagccctgcaggaaacatggcaagaggaaaggcgatcatacctgccagtcttcctgaaatatcgaaaatacaccagggctgctatatcagagccaccctggccagcactccaatcgtgatgccgacggtggccacagctgagaggacaggagcacttccttgtgggaagaagagagaaggaatgaaggtgatgttattctacagtggggtccccaagaactagctgtcaacatgaagtaggcttgacttgttccttcaaggaatacactagttttgtgggaaagttgcaattttttttctctcttaccacgtttctaggttggtgatcagtcttctgtcaatttcatcctgttctttctgcactcagacatttttgaaggctttgaaaatttgagaaagtctgattgctatttttgcatgtcattagaactttctatatttttatgtttgcatctttttctcagtgtctcaattgtggcagccatgaataagagcctgttggagctctatggcagggacttgatggacagaaggcccaggctagtgcattctgaatttactatgttctttgcacagagaactcacttcccatgggctcccaccaggggaaagaaagcaagcccaggtctgtgagaccctgcttcactctcatgggtgaggggttcaaggactccccatcggtcttggggaaactcagaactgcactgctatgtaaaacttccctccttctctttctccttctcaggaatgagatctgcatcgtggtctgagggctctcttaggctctcctgtcactgctgctccaccttccctcatggctgttttacccagtgaattatcttgtacctctaatcccatcttggctgcatctcagtggatgaaagctaacataccaggcttgattctttgcactgtttttcctctctcccatgtttagccagtaaccatgtcctagtgagtttccatttggtgcttagccctcaccagtcatctcagtgcgatggttaatgctaggttagctactgttgaggggcatgtcctagataccaggccctgtgctaaatactttacctgtatctcatttgatttatacagtaactctcttgggtagacattatttccattttacagatgaaaagacagaggcttagggtgatgagaaaacttatccaaagtcacatggttagtgacaagtggatttagaatttgactctaggactacctgactttaaggttaatggtaacagtagtaataataatagctaatatttgtgaagcttttctttgtgtgtggcattttgctgaaggcttaatcaaatgttacattaaatcttcaaaacgatactatgaaacaggcattgttatttcaattttcattttttccacccatttcttagtgatgagaattattgcaattttcagttgaagaattgaaggctcagagaagttaagaatcttgtgcaagaaattgatagtggtaaatacttacattaaagagagacctcaaatcaacaacctaactttacaaattcaggatatagaaaaagaacaaaatcaacccaaagatagtgaatgaaggaaacaataagaattataactgaaataaataaaatggaggctataaaaacaataaagggagtcaatgaaaccaaaagttggttcttcaaaacagatcaacaaaattgacaatcatttactaggttgactgagaaaaaaagagaagattcagattactaaaatcagaaatgaaaatgggggcatggtggctcacacctttaattccagcaccctggtaggtcagaggatgagggttgcttgaggccagaaagtcatgaccagcctatgcaacatagggcgacacagtctccacatttttttttttttaaactagccaggcatgatggcatatgcctgtagtcccagctactcaggaggctgaggtaggaggatcacttgagcccagggggttcagcctgcaagtaagctatgatcaagccactgcactccagcttgggttgggttacagagtgagacctactctcaaaaaaattgatgacattgctaccaattctacagaaataataaagattaaaagagtgcggtaaataattgtatgccaacaaattggataacctagatgaaacggacaaattcctggaacacacaaaaaaatctgaatagacctataattagtaataagatttagccaataaaagcatttgacaaaattcaacattcttttataaataaaaacactctgtgaatggaaggaaaccacctcaacataatagagggatactcaatggagaaagactgaaagctttccctgtaagaccaggagcaagacaaggatgcctgcttgccccacttctcttcaacatagtattttaagtcctagctggagaaattaggcagcaaacaaacaaataaacagacatccaaatcggaaagaagtaaaattatctctgttcacagataacttaaacttatatgtagaaaactctacagggttggagttgttgctagtgaccgagggcttgggcagctccgctgtgcagaaaacagagagaagattgccctgtgtggcacctttgattcctctgcaggcatcgttcaatcagagttggcatctcccacccctcagtccacccaagtccttaagagcccagggcaggtgtgtgtgtcagaagacggatgcacaacgatctgagggctcggagatcgaggccacctgctttgtgtgggagaagtacagactttctcaaatgtgaatagggcagaagcattgagtcttgggcagatacaggactgacagccacagcctctggcacctctcctgtttcttccctgactggctgactgcctggtcttttggggtactcacctggaacatgcaggtgctgtttctttcagctgcacagtcccacaccacccagccaaggtgtgttttttctgaggctttgctatttaaggacatcctggagatgggtgatgatggggatgggggtttgagcgggagaccagaagcaagtctagaggtgagttcaggggtcaggctgtgggtcacaggtgggcagctctgcccaggagtttgatgggaacagagtttcattttgggaggaagaagagagttctgtgggtgggtggtggtgatggtagcagaacaacgggaatgtgtttaatactacggacctgcacacgtggaagggttgaaaaggtaagtcctatattagatacatagtggctggtagtcttatcctctctataaatacacactttttggcactgccccttccctgccatgcagagtccccatggctgaatctccctatgtctccaagtgtgcgtcacttgctgtcctctgtgctgtgtcccatgtgctgtgcccacagtcttatacagccagtgacttcagagccaggacacagctcagcagtctgtcatgaggctccatgtcttcccattttcctgcggcctgatccaggggaggctttggtgttgattagcatcttgatttagcctgattcaggacagacacctgggcaccttctccatatgccctggttccaccttaggtggcttcagggtggggtcagtcagtcactgggggtgctgggagcagagatgggggcagagtctgagctgctcctccatcacccaaggggcttcctcttctcatttaaggaaaaagtgtgagctcatttcaaaacctccttgtcccttgtagcttatggagtaggtaaaagaacacaaagaagtgacagaaagggaattgttggtgacagagagcaggaacttgaccctgaggacccttcctccttttttctctgtgaagcccctttcactacacagggctcagtgctgagggagccccctcctctcattccaggatggacccaaagtcagacatgagaaatcaaaaaacaaaaaacaacaaaaaacaaaaaaacaaggggaaaagagtctgcagaggtgaattgggagggttcaggggagaatttgggatttgcgtgtgccccttggacacaggttgggaaagaaaatttcttcctggctcttctctgagagccagactccacctgaaaatgtgatgctagtgcttcatggatccacttaccagagactgtgatcatcgtgactgtggtcctattgaggccagtggctgagttatgggcttggcacatataggatccgctattattcacagtgatgttggggataaagagctcttgtgtggattgctggaacgtcccattgataaaccaagagtactgtgcaggtgggttagaggctgcgtggcaggagaggttcagattttcccctggacggtaattggcctttgagggggaaatggtggggccatctgggccatctggaggaaagagaataaagccacaggtgatgttgtcagagggaagcataagttcctggtctgtggaagggccacggtgtccccctgagccatgtcacaaccctgaagtctcaaccaaacccccgctatgtcccctgagccaaagtctgagacattcacctgtttctcccatcagaaaatgtgaaccctgagccttaaggacatcctggagatgagtgatgatgggaatgggtgtttgagcagaagtagcacaggagacagcccctcccctcccattcttggtcaaggcctggtctgcccaggtttgctcagggcaggaagtcatggccagcctgggtgagggtctgagtccttagacctgagagggactgagagacctggactctggctgtgtggatttgggctggcagcctgggccacagaggaacagaagatactcacagaggacattcagggtgactgggtcactgcggttggcactcgctgggttctgtatttcacattcataggatcctgcatcgttccttttgacgctgagtagagtgagggtcatgttgccattggacagctgcagcctgggactgaccgggaggctctgaccatttacccaccacaggtaggttgtgttctgaacctcaggttcacaggtgaaggccacagcatccttgtcctccacggggttggagttgttgctggagatggagggcttgggcagctccgctgtgcagaaaacagagagaagattgccctgtgtggcacctttgattcctccacaggcatctttcaatcagagttggcatctctcacctctcagcccccttgagtccttaaaagcccctggcaggtgtgtgtgtcacacaacagatgcacgatgatttgagggctgagattgtgtgagatcacctgctctgtgtgggagaagcacagtctttctcaagtgtgaattgagcagcagcattgggtcatggacagacacaggacccggggtcacagccccttgtgcttctcctggtttctccctgaccagctgcctgcctggcttcccttggagtcctcacctgaaacattcaggtgctgggtcttttcaagctttagtcctactttgcccccctagctgtattttctgtgtggcttccttttctaaggacattctagagatgggtgatgatgggacttcttattgtccttaaaccccaaggatactgtgcagcctggcctgggattggatctttcagcagaaataacacaggggacaccaggggcaagcctggaggtcagttcggtcatcaggcagtggaaccacaggtggggcagtttttcccaggtgtttaataatgactgacttgagcctgtgacacctacagatagagcagaattcagagaatgatctagaagacagtgagggggacaggcaggagctgcctgaatttcccagcagaaccgtgttccttttctttggcctttaatgtttcttctccctctgcggagggcaggtgaggaccctgtggctctctccataaacacatgtggatgtttgcaaatgcacagctgagtggtggaaagggggagcatgaaatgctgcaaatctgactctcaaggaccatgtgtgtttgacagatatgagacagaaatttgaggagaagttttgcaaatattttctcccattggacattatgctaaatgcaataagtcactcacaggacagatactgtagggttccacttatatgaggtccctagagtagtcacactcatggaatcagagtagaatcatggttgccagggattgggagaggcagaatggggagttagtcaatgggtgtgcgctttcagttatacacaggatgaggttctagagatttgctgtacagcttggtacctatagttcatacggattgagtatcacttacgcataaggcttaggaccaaaagtgttttggatttctgactgtttctggatttttgaatatttgcagtagacttacccgtttagcaccctaattttgaaaacccagaatctaaaatgctccagtgagcatttcttttcagcatcactttagtggtcaaaaagtgttagatttgggagcatttcagattttggattattggatgtgggatgcttgacctgtagtgttgtaatttgctttgaaaagtttgtcaggagtttagacctcatgttatgttctgaatatagtaaaaaataaaagaactttgggggaaacatttaattttttccataagtggagatcgttactaatgtcctaaagatcaaagatcaagggctggaagtagtatttttcttgataacatactaaggtttaggtgtgctgtgaattccagcaggatcatattgtcgtcaaatgaagatgctgaagttggtttgaaattagcaactccttgagtagagagaggcatatgagtcctcttaggaggatagaaccagtaggagaggaagtcttaggtgtgtgtcagttacataaaggaaggaacgatgccaaattagaagcaacgtgtgttatgttagtaaatttagaaagagctccctgcccctaattcctgtgcagttaggcaaatagggaaggagccccaaacagtcatgtgaaatgctttcttcctctcctgttaacctgagaaaacacaatgagagtttaagttcatctaaactgggcagagtctatgtgagactccagtggctggtgcacttctcagtccaagggaccccaccttatgacaatggcatcatcatgaggacacagtagtgtatgtggaatgggcagcaaacccatcagacagcacctgcctggccggctccacctggggaaggtcctggggaatgactggaggatgtgagcctcacaccaagatgaggacggaagtcaatggatgaaattagcctctgggccttggggaaagcagacctgtcatcctgcctctgactgcctggtgagtcagtagagactgtatggaggagtcgcttgtccctgtcccgtggcctgttccacatgtcggcctcactgggggaaagagccctggatggggacacagtggaagctcattctcctgttgacttggggacattggctcgtgatggagcccggcaggggcggctgctccggctgatttctgtgccttctctgttgcctgggatgtgggccaggacacagtgtgagcaggaagggaacaggacagccagccttgttagaggggttttctggggaaggcctaagggtggaggaagctgtgcagggcagggcatcccagctagaatgaaaggggaggaaaatgagggacagagaggagcagaaagagccagagatacccatggcagtgagcagtgggggatacagtgacctcagagaccccagggaccaggagcctcttggctgccccagaccaggaccagggagacctgaaaaccctctaatgaccaaggaaccccagagtcacatgagatggggtaggtttagggacaggggttcagagggatggaacatgggtgtcagcccctgagggacaagaaacaggtgtggccagaacctcataggattctgcatccaggagccggtctctaaagaggttatggatccttttttcattccttcttcctttcttccctttttcaagagagaactcctgagcgagcgtgtgtctcactttgggcctgtgctggtgcagggtgtgagtggggagagaaagcaaagtcctctcttttatcctcccatgggagtgacacccacacatcgggaaacaggatttcaggtgcagtgaggggactgtggatcgaagggagaggcctggacaatcccagcactgactctgttatttgaggcaggtgatttagttctagagtaaaactgattaattctctgtttgcttcttactttccagaccagaatctccacttctgagctgcggatgcacaagacaaaaggaagtgaacccatgactggcctcagatgcagatgcctaacaacaaacagccccatcacccccggttgaggagaggagggggctgtggctgcagacagacctcatatgtctctaatctgccacctatggcctgtgtgacccttgttagtgactgtctccctgtccctcaatttcctttctataagtaggataagtgctatttggctgtgaggttgtttgtgagttaacctcaaaatatttacaattacttgatctcagctctgcacagaggagctgcccaagtgaacagttatctatgattatttgcttccaagacagagggccctgggcctgatccctggtggacatggagctgccaggagcatcctctcttctctgttcctccccttggggactctgaacttcccagggagtaacctgtgtcccccagggcagtgggctcatgcactagtaattttttccatctgtcctttccatgctgagcctcaagtgaaggaggaggccctatcctcagctagatgaggctctgggtgctcggacctggctggtgaccaactccaggagtcatggcccttggatagctcacatccttgctcccagccagccctgcccaagaggccaccacacagccctggcacagactccccaggatcacctggaatcaggaaccagggacagggctttgtacaggggctcagttcagggaagagttgagcttctctctgaggggtccctagggggacccctcaggccaggccctgatccagttctccagggtctttctcagggtcaggtccatggggagaccatggggtgcttgtctgacactgacctcgccctgctgagtccccccatcagactgtccttcctctgcagcgagtgtctgcagggtctggatccaggaaaggaattctgatctgtggaagtttgtctcccccgtgtgtgtcctgcactaaatgtccaaaccctgatacaggatgtaatgcagagagggccacaggcacaacccaggcctgacaatcccgtatgtgggaagtagaactgacccccaacacccagaggtcatgtggaaatactcacggtatacatggaactgtccggttgcttcttcattcacaagatctgactttatgacttgtagggtatagaatcctgtgtcattctgggtgacgttctggatcagcagggatgcattggggtatattgtctctcgaccactgtatgcgggccctggggtagcttgttgagttcctattacatatcctacaattagactgttgccatccactctttcgcctttgtaccagctgtaaccaatacgattctggggcaggttgtgggcgagtagaagaacctccttcccctctgcgacattgaacggcgtggattcaatagtgagcttggcagtggtgggtgggttccagaaggttagaagtgaggctaggagagaggagagagcatcggtcaatattgggacctatgcattagggtggaaaaacagggccctgggtcctgagcaggtctcttcacccctccacgttggagctgtgtgtgtgtgtgtgtgtgtgtgtgtgtgtgtgtgtcctactgagtcaaagtcagcagtgtgacacccccattccttcagcacctttgaccttggcatttccctgtgtggaatgctcttccccaggggtctgcatggctccctccccactggcctcaggtcctgctcacatcagggcattcttgggagatcccttccctgacaccccctctacagaccctgggtcttttctttctgacctttccctgctctgttccttccagggctcttgtcaacacctgacctcacattctatatctctttgtgtgtgtgttttcctcttcatgacagcataagctctgtgatgactgagacttgtctgatgcttgttgtatgccattgactaaaattgattgcaaatgcttgtggatgagttaatgagtgtatctggtggttatttttcaacttctgattggtgagtaagggcagcatttagtttccttgttatatttttatttggagtgtcatcctaatgcagttctgatttctatcatttttcttttttttcaaatggtaatgacaaatgatgattaacttggaaaacatgatcaattgattttcctccctttttatcaatcccagtttagtgtgactttcctgttgtgacccctgtccctctctggtgttctgtttcctcaggcttcaacaaaagccctctgtctcctctcagagccttgtcctccccaggagaccctagccagtctctgtgctccctcctcccatccactccgagggagtcctcccctcacctgtgagcaggacctccttccaggggacatgcaatctgcagggaggggctgaggggggtcccatggtctctgctgtcttctctgtccacctctttgtagaggagcttgagctccaggaatgctctggtcagggctgctgtgactgttggccctgctgtccttcctccttctgtgctgagcctcctctcagggatagaagcatttcccagggtcacgtgggtcatgggtgcggtctctgttcaggaatcctctatcccctcccctctcatttctgtctcttttgtccctcctcctcttccctttctgtttatattcagttccccagaagatgctctgagaagcaagcttgtttggacccctgttccataacaggacgacccgctctccccagcacggacctctgctgtgtctgggccttgggtctgtcagcaccacacagagagtccctggggtcctcaaacctggtgttattttctctgtgacagagaaacccctctatgtgtgcaggatgttcctagtgttctcacacgtctgggaaggttggatttacctccagcaaggaggtcacagagatgtttggggtcctaggagtggacacatccagggctaaagcccgggtctaagattctgaattgttctttctgcagtgttatgtgactctaatttcctgggagtaactgagaatgaagctgcatggtgctgtagtattatgtcatccagaccccagacatttctagaccaactttatgattttctctacagctttaccacctttattattatttacttcatactttttttgtaattaaatttagtttacaaaacatccttgtcttagcagggcttggtggctcacacctgtgatctcagctactcaagaggttgaggtgagaggatggcttgaggccaggaactgaagacaaaatatttttgtcttatgcaatattgtccatgaaatcagagatttgatgtgtgcttaattttttttcctgtcatgcgttaaaataaacacagttaaacttaaaagtttatttatgtttcacctaaaatcagttttgggaaatgcttatatagtggcataagcatggaatttatatccagatatagacctgggctcagctaatggttctgtcacttaactatgttgacttggacaagtcacttggcttctatgatccttgattccctgatttgtaaaaggaggatggtaaaatcctccttgcagagttgttgggaatatgtgggagcccagtgtccaggcgggtgttgagtacgtgatggttatcattgtgtttattgctgtggaattctggttattttccaaagagagtgtctatgctggaatattgggcttgtggctttctgctaacatgcatgtgtgaagaagttacttttgcttgttaggacttgtgcatctgtcattatttttgttttccagttctactacctattttctctgtgatgttggtcaagttgtctaacttttctgtgcctcatttacctaatttgtgaaatgtgggtaacagtacactagtgtgggtgtgttatttcccagctccgaccactagagggcatagaagcaccggcacctactagcaatgggcatatgggtgcccatggtctgtaaacatcattttcccatgaaaggaaccaggggtccctggagaaatagctgatccagggctgggcaagaaagcacaagaggagccttgtggggccagaagtaaacattctgtggggccagaagtaaggaactgcttgaaaaatgatggggttgtgtcaaaagtcacagaaaccaactagaaggaactcccaatggccaaatttgggacaatatcagcgacataataaacaatgccagccactcggggcggtggtttacgctttggcactttggcaggccgagatggacggatcacttgaggtcgggagttcgagaccagcctggccaacacggcaaaaccacgtctctattaaaaacatgaaaattagctgggtgtggtggcagggaccaatagttccagctactagggaggctgaggcaggagagtagcttgaatccaggaggcagaggttgcagcgagccgagattgcgccaatgcactctagcctgggcaacagagcaaaactccatctcaaaaaaaaaaaaaaagggatat

SEQ ID NO: 15157 - DNA, 11633 bp, Human
  misc_feature (1)...(11633): n = A,T,C or G
aaaggtttacttctgtttatacacacaccaagatgaattttcagtaagtttacacggggttctctcaatcccattagattagttttatgggtttgctaagagggacagtacacacaattttgatactcagcttaaaagaaaattcttggttatactaaccaggaagtcctccataaaatgccaacacccaaaacaccttaatccatattcactgctaaaatattttattttaaaatgtaccacagtgaatggatgtatccatactggttcttataaatgtacacatacacatccatatatttgacaaagtatatatatgaactggttaaagacctatccaaaagaggaaatatttctagaaagttcatgtgtttatacttcatttgacaattaaaacttatttgaactgatgaagttttagttgcttagcaatgactaataataccaatgcctgtcaataatgacaactaaattgagaactataaatttcactgctgtgccttgggtcaaaattttcaatgatggaatcctaaataagtaacagttattcctataatggggtatatattcagaaggaataaatacctgccactattaccaaaagactgttctctgtagagctcaaaaaaaggattatgccacaatacataatttttatttaaaaaagatctctttagatgccactgcaaattctgcttttactaaacagaaaggcagcaccccatttctttcttgtaaaggaggaaagtctttcataaaaaactctttgaagaagttttggtagtatgttcagagtcaaacacagcagcactttattaacaaggacagagtaatataatcacaaggaaatacttgttaagtctaaattaaatgatatcttgggcagcataaaatgaatactaacaagggcaggcatctcaatatgtctgtctcacagctgttcaatgtgaaagtagtttgtaagcaaggaaagacaagagcaacatttacaccacaaattgactgtaaaatacttcattacattgagaaaggtaatcaatggtcaaaatccataaccagaaggagacaccatttgagtatctatcaatgggccaaacagacctgttagattttaatactgcctggtatgcaactcagatactgatttcttctctatggaggaagccaatgttcatgttcttgataacagtcattaatctttctgattgagacagtccaaacccatgtgacctcagaacactgggtctaagagtgaacttcttacattgatatattttccttgagttctttcatggtgctgtatcagcatgctaccataatctgaaaatgacatggggcacaaaggagccatatatatatatttcatgtttatatatatatatatatgtatatatatatacatatatatatatatataaacatgaaaagtatcccatattccagtatcacatgacagaaaatttatggttaaattatttaagacatttactttatttttcttgtggccatccatttagtgaagaacatcagtgtattaagaaggtccctctttatcacatgatatttctaagcagatatttaggaatgctcagaagattccactttcagtctcctaagacataatttaaagtgggacttgaacagaaacaagtatcttcagactccagctgaaatcatagaagtagtttctgtttaaatcctgggaaaccttagataaggtatgtgaaactgaaaaaagatcaaatcagcacacacagataaaggatacaacagataccaagatgggtaaatgcccaattattttcagtcctcataatctgtacaaagctatgaggcaaccagtaggccatatctcactaggcagactttgaggaagatgtttccctatttgaaacacaagaaattatgaaaatatggagatgaagagggagtagttctgtgcttcttgctgtgttacctttattatattcctagtgtcactgacactagtttaaaaacagcctgcaacaagaatattctcatcaccagccaccttttccacctttcttctttttctgttgctgtttcttttttgttgctggagcccctgcaggtttctggtgtcttgggggtatgatgttacttgtagaggcagatactgttgcagcactgccaggtcttggggaggtgggtgggctgctcacagttttactggcatccctgaaatcatcagatcatttttggtcactcatatattcaacgaaggaagagtataaaaatgtatgtacatgggttttacttatcacacttaacaatctcccacacattttctacttcttttaaggtaagctccccaactccctatcgacttttcttttgaataacattttcactgtttttattgaagaaaagtaaaacatggtacacatgccaagttttagaaagcgtagaaaataaaaaattttatttttttgagacagagtcttgctctgtccctcaggctggaatgcagtggcaccatctcagctcactgcaacctccatccacctcctgggttcacgtgatccttctgggttcacgtgattctcctgcctcaaccacccgagtagctgggattacaggtgcgcactaccacacccggctaatttttgtatttttagtagagacagggtttcaccatattggccaagctattctcgaactagcaacctcaaatgatctgcctgctttggcctcccaaagtgctgggattacaggcgtgagccactgcgcccggccagaaaaaattttttaaaataacctgtcatccaccatgtaaaacgtattaatacttctaacacttctttctagtcatattatttatttacatctgtttatctagatatttatttagttgaatgactcagtgtatttagttgccttgagacttttagtttttataatagtttttactatatatatttcacaatatatatttgattatattgtaaatacttaaaactatttgactgaattgtaaaaactaaaggaaaaactagtctaaaaaggcaatatattttctttcatttgcataagtgtagtataaacatttatcaaagatacatcacatttctcatactttatattaacaaattctcactaatagccttgagtcaatctagaaacaacgtatgttctaagtgccctcaattgtggagcaataacttacagttcagatgaagctcctgcagttgctccctgggtcccttttccaatctgatccttctttttacccttctttcttccccggtagtaagaacgttctcgcattggcagccatctttctggatctggggtaacttttgggtcataattcttaggcaattttcctgcataacgattataaagaaatgagagatgtgtcataatattttcaagatagtttgtttaaacgatgtctctaagcctgggaataaataacattaaaatggaaatgaatttatttgagaaagtttagtttgtataatctagcaggcgaaatggtctttttttttaaattattatactttaagttctgggatacatgcgcagaacgtgcaggtttgttacataggtatacatgtgccatggtggtttgctgcacccatcaacccgtcatctacattaggtatttctcccaatgctatccctcccctagcctcccaccgccccccgacaggcctggtgtgtgatattcccctccctgtgtccatgtgttctcattgttcaactcccacttatgagtgagaacacgcggtgtttggttttctgttcctgtgttagtttgctgagactgatggttttaaagcttcatccatgtccctgcaaaggatatgaactcatcgttttttatggctgcatagtattgatggtgtctatgtgccacatcttctttatccactctatcattgatgggcatttgggttggttccaatctttgctaatgtgaatactgctgcaataaacataagtgtgcatgtgtctttatagcagaatgatttataatcctttgggtatatatccagtaatgcgactgctgggttaaatggtatttctggttctaggtccttgaggaattgccacactgtcttccacaatggctaaactaatttacactcccaccaacaatgttaaagtgttcctatttctccacatcctctccagcatctgttgtttcctgactttttaatgatcgccattctaactggtatgagatggtatttcattgttgttttgatttgcatttctctaatcaccagtgatgatgagctttttttcatgtttcttggccacataaatggcagttttgagaagtgtctgttcatatcctttgcccactttttgatggggttttttcttgtaaatttgttgaagttctttgttgattctggatattagccctttgtcagatggactgcaaaaattttctcccattctgtaagttggctgtttactctgatgatagcttcttttgctgtgcagaagctctttagtttaattagatcccatttgtcagttttggcttttgttgccattgcttttggggttttagtcatgaagttcttgcccatgcctatgtcctgaatggtattgcctaggttttcttctagggtttttatggttttaggtcttatgtttaagtctttaatccatcttgagttaatttttgtataaggtgtaaggaaggggtccagtttgttttctgcatatggctagaatcctttccccattgcttttgtcaggtttgtcaaagatcagatggttgtagatgtgtggtgttatttctgaggcctctattctgttccattggtctacagatctgttttggtacccgtaccattctgttttggttactgtagccttgtaacaatagtttgaagtcaggtagcatgatgcgtccagctttgttctctgcttaggactgtcttggctatatgggttcttttttggttccatatgaaatttaaagtagtttttttctaattctgtgaagaaagtcaatggcagcttgatggagatagcattgaatctataaattactttaggcagtatggccattttcacgatattgattcttcctatccatgagcatggaatgttcttccatttgtgtcctctctcatttccttaagcagtggtttgtagttctccttgaagaggtccttcacatcccttgttagttgtatgcctaggtattttattcttttgtagcaattgtgaacgggagttcactcatgatttggctctctgcttgtctactattggtgtacaggaaagcttgtgatttttgcacattgattttgtgtcctgagactttgctgaagttgcttatcagcttaaggagattttgggctgagacgatggggttttctaaatatacaatcatgtcatctgcaaacagagacaacctgacttcctttttgtttgaatatcctttatttctttctcttgcctgattgccctggccagaacttccaacattatgttgaatgggagtggtgagagagggcatccttgtcttgtgccggttttcaaagggaatgcttccagcttttgctcattcagtatgatattggctgtgggcttgtcataaatagttattattattttgagatacattccatcaatacgtagtttattgagagtttttagcatgaaggggtgttgaattttattgaagggggaaaaggcctcatttctcagcatgacaaaaaaattcagagaccataaagaaaaaaacttcacagatacatctataaaaaaatgttaaaatcttcatttagtaaaaaatatatttctaagaaaaaatttaaaatacaaactatataatagaggagtggaaaaaaatccttaatatagaaagaattcttgctgatcactatgtaaaccactcaaagaaaaatggactcagttataattaaggtaggctaggagaaaggaaagtcattcatcttctgaacagatgttcaccctcactaattaaaaatgagaagggtaaaaaactctatcagacttgcagtaataccccagtgttggtgaaatggtgagaagcactcaccaacactatactaggggaagtgtatactggtatagccctttgtggaaagcaatttaatctgggcagtaccattagaaatttatagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttgggaaacctgtatcctaagacggcagagagcaaaatcaagaaataacctgatttatatgatagattcctcaaaacctcaggaacttgggtggctccaaggataacatctgactaggtaaaatcaagcacggtaatgccacccaatttttccagagattaaagccacactccaagccaatcaatgcacattatttccctggttaataattcaaggctggacactgacctgcttggcccaatcagattaatgagaaatacttgccaagtctggagagggcttctttgttgtgatggatataaatgacaagtatgtggccctgactgtttacaatatacatcatatgactctaatgggattctgttttgtggagagcagaacaaagaggtaaaaatactgagtcaaccaaccttgatgctaacattcctctagactgccaactttataaacagtaaattttcttaagctagtttgatggaattttgtagttatgtgtagcagaaacatcaaaatgtgtaagtgcttacttttgtgccaggcaccactctaagaactttacatgtagtatctaatactacaaggatatatactatcatattccattttacatatgaaaaactctggcaggtatattaaatagcctgtccacagtcacagagtaaaagagggagcaacgatttgaatttaggcaaactagtgaattgcgatctttaaagtaatagaataaaattaaatgttagctatagtcaagataaaaagttttcaaagatacaagggagggcagtatatttatgtccaaatatttctatatagggctaaaatcaaacatttattttggagaaaatttataaagacttttttaatgccttacccttctttttctttttcttctttttcaaatctccctgtctacaaagagaaaaaaaaatcattaccatctttgtgataaaatatttatagagcattaagtaagtgctctataagagttagttgggcacttatcataaacatggtttaagacttggtatcagcttaccaaagctaacaaattagttaagatttgattcaggttaaagtcaattaagcttcagatactataatttttggaaagtagtttagaaaacagaggtgacaattcgaaaacagattctgtttacactgaaaaaagtttttcagtggcacacattaagtctatgtaaaaagtaatttgcacaagcatgactacctagaatcccttggtaagttactctatgtttggcaagactttagagaataaattttttgccagaagaacatgtgtaggtaagatacatgcaaagaatatctctggaaggagattcaaaacaagttacgttggttatggccctgggagggaggtgggtagacacggatggaagactttttacttactcttacacttttttatcttttgtattttaaacctgtgagtttattaatttttttatgtaagtaaaatctatattaagtacattgaccaaaaaaggcactaaaaagggcataaaaattaacacttcaaaataattgtcaagcattctgaaagtggctgggaacagtggctcacgtctgtaatcccagcacgatgggaggccaaggcaggtggatcacctgaggtcaggagttccagaccagcctggacaacatagtaaaaccccgtctctactaaaaatacaaaaattagttgggtgtggcagtgcgtgcctgtaatctcagctacttgggaggctgaggcaggagaatcacttgaaccagggaggcagaggctgcagtgagcgagattgcgccactgcactccagcctgagcgatggagcaagactccgtctcaaaaaaaaaaaaaaagcattctgaaagctctagtgaaaagagaaaaacataaaaatacatctctctatatattcttatgtgatataactcgagaaatatgaaacagtgaactaaaaagatgagacaacaattcctaccaaaaattcattctacaagtcattcaattgtgaacgttctctcaggataccccaaataagaaatgcaacatactgtatcttacttgagtgtttcatctcttacccagtgtgcaatagtattctaaattgtctccctacaaattatactccacagccatactaaaatttcccaagggttctctgctatttcttatttctctgccttagctcaccctttgcctacctcgtcctcatcttcctcagagtcaacacaatcatcttctccatgaagcctttcctaacttcccactgtcctcaggaagaagtgactattccctccggtgtactcctctatgccctgtacaatcacaacaggtgcaatctttattgcaattactgtttaaatatatttccttctgctagattcaagttccttttttttagacagagtctcattcggtcacccaggctggagtgcagtggtgagatcttggctcactgcaacctccacctcctgggttcaagtgattctcctgcctcagcctcccaaatagctgggattatagacatgtgtcactacgcccggctaatttttgtatttttagtagagatgggggtttcaccatgttgtccaggctggtttcgaactcctgacctcaagtaatccgcctgccttggcctcccaaagtgctgggattacaggcatgagccaccaccatgtcagggctcaagttcttttgagagcaagtaccatgatttattttctggtcaacacctagcataaacctatcacatagtgtattgttaaaggaaactaaacctttgcatccaagttagtataacaaaatactaacttctaataagataaaataaagagcattaataatgcataatgaaaatactgtgctgaaacttaaaagcttaaaaagtcaatgtatatcttaatgattgtctaagcaaaaaagagaaagcaagccaggcttggtggctcatgcctgtaatcccagcactttgggaggctgaggcgggtggatcacctgaggtcaggagttcaagtaccagcctgatcgacatggtgaaaccctgtctactaaaaatacaaaaattagccaggcgtgatggcaggcacctgtagtcccagctactcaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcaagactccgtctcaaaaaagaaaacaaacaaacaaaagaaacaaagattatttaaaaaaacttttaaaaacttattatttttagagatgggggtcttgctctgtcactcaggctggggtgcagtgatgcaatcactgctcactggagcctcaaactcctgggctcaggcaatcatcccgcctcagcctcccagtaactggaacacagagccactatgccaggctaaagaaggaactgcgtgtccttagtagttactcaaccctgtttggggaagaaaaaaatagtaaacatactttaattgaaaatccatttaagaacccagactgaatttataattgtaagatgaaatggaattcggaacaatgtaacctctttgagactccaattccttattaaaagttttggaagttattatgagaacaacaatgctttttatgaaatgcagagtttgttagaaagaaatcagtcattgttgctgagttttttttaagttagggaaaaatttagatttcaaaaggcattcaaaaaaggaggaagtagcaaaaacttataaaagtcacaaagctaaggaaatgttttatcttttccatgctctattcatcctgagtcaaaagtaaaatcttaaaacattttactgtaggtctctgctaactatatttttaagatgacgatggaagaaacaagtcaaaatctgacttcttttaagtagatgaagccgactaaccttttcttcaaatcagcaaaagaaatcatatactaaatgatgtactaaatgtacaacaataactaaaaggtaaaggaaggcacatccagcctatggagtgttatgcataaaaaggatgaaataggtccacattttagtacgtggaaagatctctaaaactcattaaataaaagtaagttgggaaacactaagtacaatacaatcctccttctgtaaaaaataactgggcgtggtgcccagcactttgggaggccgaggtgggcagatcacttgaggtcaggagttcaagacgaacctggtcaaaagggtgaaaccctgtctctactaaatgcacaaaaattagcctgtagtcccagctactcgggaggctgaggcagaattgcttgaaccc

SEQ ID NO: 15158 - DNA, 9087 bp, Human
  misc_feature (1)...(9087): n = A,T,C or G
aatatgaatggaatgcctgtctatagcaggcacagggatactgttggtcaaaactcccacctggcatcgtagtcctgccttcttcacaactgacacgatctgcctggccctggagcccctgacatctggagctctttctctgggccagatttctggcccctgtgaagtgactgaacctttcgacctagtttctagtcccacagctgtcactattccctggatagccttgggcacccttagcctcagtttttccacttgtaaaatgggaccaggcaatctgccagttaggacatctatcagtgtgcactaaggtcccagggctggaggctgtggcttacacctataatcccagcactttggaaggctgaggtggggtggatcacttgaggtaaggagttcgagaccagcctggccaacatggtgaaactccatctctactaaaaatacaaaaattagctgggagtggtggcacatatctgtaatcccagctacttgggaggctgaggcaggagaattgcttgaacccgggaggcggaggttgcagtgagcagagatcatgccaaggcactccagcctgggcgacagagcaagactccatctcgggaaataaatgaaataaaataaaataaaataaagtaaacaaacataactaaatgccataaataaaaaagataccaggctgtaactacattgtcaataatatacttggtttaaaatattacagttggctgggtgtggtggctcgtgcctgtaatcccagcattttaggaggctgagacaggtagatcacctgaggtcaggagttcgaaaccagcctgaccaacatagtgaaaatacaaaattagccaagtgtggtggcgtgtgcctgtaatgtgggtttccagatacttggggggtgaggcgggagaatcgcttgaacctgggaggcagaggttgtagtaagtcaagatcgcaccattgcattccagcctgggcaacaagagcaaaactctgtatcaaaataaataaataaataataaaagaaaagaaaacattacagtaaataatgtaatcatagtgttcattgattgatattaatataaatatattattaatgatggcttatcacacccttattgtatatcagatgctgtattgtatattagactctgtgctaagtgctttttttttttttttttttacagtttcactctgtcgcccaggctagagtgcagtggtatgatctcggctcactgcaacctctgcctcctgggttcaagtgattctcgtgcctcagcctcctgagtagctggcatagaaggcgtgcactgccacagctggctaagttttgtatttttagtagagacagggttttggcatattaaccaggctggtctcaaactcctgacctcaagtgatctacccatctcggcttcccaaagtgccagcattacagctgtgagccaccgtgcccggcctgctaagggctttatatatattatttcctataatcttcataacactgccaggtgggaatttctgaagcttgtgactccacgttgcacagctagcgtgcagaggatgacacacctgagcctcctagggcccttgccctgtgtcaggacatcccagcagctccctgagatgcagcaagtgacgactcctgggaagaagccagtctcagtgggcaggcgtgaagtcagagtcccaggcaccgctctggtcccctcactcctgtctgtctctgtccctcctgcagctccagtaccagggcagcccctttagtgaccctggcttctcagcccctgagctccagctcagcagcctgcctcctgccaccgccttctttaagacctggcacgccctggatgacggggaacggctgagccttgcccagagggccattgacccagcacctccagctcgtggaggacgaccagagcgacctgaaccctggcagtcccatcctgccggctcagctcggggctgcgagactcagggcccaaggcctgctgggcaatatggccgccatcatgacggccctggggctgccaatccccccagaagaggatactctagggcttgctgcctttggggcctcggcctttgagaggaaatgtcgaggctacgtggtgacccgggaatatggccactggacagaccgagctgtgagagacttggctctgctcaaggctaagtactcagcatagaggggtaggacttcctgtcagaggctgcagcacttcctctttcacaatggcctcttttctgccttgcttgtgggctagaaaaggagataaacctcatctagcagatggggcttgggtgccatgtatgggaatatttcctgggagccaggcctcaatttccttatttcagggccttccggcccaggtcctctggcctgcgttctaggtctgggtcaacctccatggatgccattccatgggttacccatccagtggtactgggtgtccacttcctggttggaaagatgcacctctccaaagaggcttcacctgtcactctacagggagaggacagttggtccccttcctaggctctccctgagaccttcccttttttgtaattttgggacggttggggctgccttcctgtctctgtctgcctcattcgctgtatgaagagcccgcctttctaagcggataggcttccttcttcctgctgaagttcattggctcccctccttggcctgtctctctggggctactgttccacttcctgtcctcaggggctccacttcctgatccatggaagcccaattcttgaagaactaaggactgcatcacatctgtttcctgttaggacacatccacttcctgttctgggctggcagagggcaccactggccaggggctgtcagcctcctatttatactgctgggcttcttgggcatgtctgggggactaggctgcatcccaagggtccttttctccctaaagctgtctccccattttcaacaactatatatacaagtaactttagtttcttttttatttttaaacattttatttacaaaaaattaatttattttcagaaataaaactcttttaaggtgttgcttgttttgtctccacagatctgctgggaggcagtggaggtgtgcagggacagggcagaggggctgaaggaaaggaggacatcaaagggacagggctgaggcccaaagggatggggtgtggcagactggggatgtaggtggagtgagcctgaggaaggtggctgagatgcggagtagccttccccccataggaccagcaggcacgcccctggccagggaagcacagagagacggccagatggggacaaggagagaaggtgtcacctccttgagataaggctgagatgtacacatgtgctcacacagggccacgagaaggcaggaagtggggatggaaaaaacagagacaccccaagagctgggtaaagggggaggccaaagggaactgaggcaggcccaaggaaggagggagagcaagaaaatggtagactcagacggagttaccatgcagacgaggagggtccaagagttaagagaacggggcaggcaaagcaaagagaggctgggaaagtggctcacgcctgcaatcccagcacttagggaggctgaagcgggaggatcgcttgagccccggagttcaagaccagcctgggcaacatggcgaaacctcgtctctacaaaaaattaaataaaaaattagccggctgtggtggcgcgtgcctgtagtcccagctgctggggaagctgaggcggaaggatggcttgagcccaggaggttgaggctgcagtgctgggatcgcgccactgcaccccagcctgggcgacagagaccctgcccgtcccctcccctctcccccacaaaaagcaaagaaggccgaggcaatggagacagctaagagcagacagacagacaccgacagcggcagagaaagacaaagaagcggaaggagagacggaacccagcgggaggaggcggggcgagctgccccgcggcgctcaggccgagcccccgggcagcagctggcccaggtcgccctcggtgcggctcagccactcgcggtagaggccgcaaacgcggagccccagcaccttggcggggaagaccccggtggcggaggcggctgaggcggtggcggcggggggctcggccggggcccgcggttggcgcgcccagcgcgccagcaaggctccacgcggcgcccagggcccgggcctggccgccgcgtcctccaggcggcgcaggccggcgcgcgcgggttcagctcggcctggcggcgacacactgcgtccagcagcgggggcagcgcggccaggccgccgcgtccagccgcagccgctcgtgcactggcagccccgcgtggctcggagccggggcgctcaggccggccaccggcagccgcggcggcgagaagctgggcagcccgaaggggtctccctggagctgcacctgcggagacacggccggcgggtcagcggggccccggagcacgggcagggggctgttaactgggctctccaacccgctctctgggggtgtcagtttcctcatcttgcagatgataatccctcctaacagagctgctctgtttaaggcaaaacaaagtggcatgcgcttgacaccaatgcctgtttcttcctccctaaactggacccagactgggccagtttaggtcagcactttgggaggccaaggtgagataatcacttgagcccaggggttcgagaccagcctaggcaacacagcaagaccacagctctaaaaaaaaaaaaaaaaaaaaaaaatagcgagtgtggtggcgcatgtctgtagttccagctgttccggaggctgaggctgaggtgggaggattgcttgagcccaggaggtcaaggcttcaatgagctatgatggcaccactgccctccagcctgggtgagagtcagaccctgtctcaataaataaataaataggacctaataacagcagcaacttcataaagcagttatgaccatgtcaagtgttcaagacagggcctggtcccaggaagagttcagtaaaaatgtcagctcttttattaaagttaccttacagaccagagttcaaatcctatcttcaccacttactagctgtgcagtttggggcaaaaccacttcccttctctgagcctcagccttctcatctgtacaatgaatggggaagcttcctgtcctgtcttcatggaaatcatataagatagtccaggggccaagggggcttcattcccttccctatcctccccaacctctgtacctgcattgagcaggggctcaatgaatcaacatcatatgaatgaacaaatgaaagataaatgtggggctgggcacggtgactcacgcctgtaatccaggcactctgggaggccaaggcaggcagatcagctgaagtcaggagttcaagacccacctggccaacatggtgaaaccctatctctactaaaaatacaaaaattagccagatatggtggtggtgactgtaatcccagctactcaggagactgaggcagaagaatcccttgaacctgggaggcggaggttgcagtgaactgagatcgcaccattgcactccaacctgggccacaagagcgaaactccatttcaaaaaaaaaaaaaaaatgttgggctggagatacagtgactatagtgacttaccctaggaagtggcagagctggaatttgaaccaaagttcatagcagtacaaagctagttttctttgtttgttttaaatagatggggtctcacactgtcgccaagggtggagagcaatggtttgatcacacagcctccagggctcaagcaatcctccacactcagcctcctgagtagatggaaccacaggcatacaccaccacgcctggctatttttttcttttcctttttattttcttttcttttattcttttcttttttaagagatgagggctcactgtgttacccaggctggtctcgaactcccgagctcaagcaatcctcctgcctcagcctccaaaagcaatgggattacaggcatgagccaacgcacccagcccaaagctagttctattatgccactattctcccactatccgctgccataattgttacattattatttttaatgttattgttactgcccaagctcacagttaacaagttggcaggcctgcagtctgattcaaagctataccctcccttcactacacgagggtaatttggggaaatattttctttccttgggcagggtcctctgcccaactaaagatgtcagcagatccctgtcttctgtgaaagtgccctcttgggataactgttgctccagattggaacctcttcttggcttccctgaatatcccaggtgggagagttcagagttaatcatatttagctgcctccttttactgttggggagagaccaaggcccatggaggggaggtgtcaaggtcacgcagagcctagaacctcggtttcctgagatacagatcagagttctcttcactgccccaggctacctggctacctctgacttaaagcaccaaggtcacttgagcccaggagttcaagaccagcctgggcaatacagcaagaccctgcctctacaaaataatgaaaaaattacccaggcatgatggtgtgtgcctgtggccccacctacttgagaggctaaggcaggaggattgcttaagcccaggaggttgaggctgcaatgagccataatggcaccactgcactccagcctgggcgacagagcgaggcctcctctcaaaaacaaagcactgaggagggtgcctctaagctggagaggacagagtggcatctgggtcacagacagggtcctcttccaatttgctgtgtggccaggggcaagttgctgtccctctcaggagccctgatttccacagttggaaaatgaggttgagagaatgggtgatcgaggacctctgtgatgtctgctcccattccccaggcccccggcacccccacccccattcccactcacatattcctggagcagctgctcagcgtatttggtgaggaggtgcgcaaggctgtgtgtctgacggatcttggcctccaagtggggaagaagtgagactgaggaatcagtctgggggtcttctggtgggaaaggggggaggaatgaggatggccaacctcctgctcattgatcacctctcccacgctggctctttgttcctgaccccatcagggtctgtcccattccaactgaaggaaaatgaggcaccagaactttgtcaagcaggtggtctacctgaaatgtattgcctgtccccaaatcactgttgaaatcctattaaagtcaaattcaaagacagtcatgccttgcttaacaacatggatacattctgagaaatgcatccttaggcgatttcatcgtagagtacgtaaatacatcgtagagtgtatttacacaaacctaggtggtacagcctgctacacgcccaggctatgtggtgttagtcaattgttcctaggctgcagacctggacagcatgttacagtacagcaggcaactggaacacagtggtatttgtgtatctaaacatagaaaagggccaggtgagattgctgatgtctgtaatcttagcatttcgggaggccaaggcaggtggattgtttgagcccaggagtttgggaccagcctgggcgatatggtgaaaccccatctttacaaaaaatacaaatataagccaggcatagtggcacatgccggtagtcccagctaattgagaggctgagatgagaggatcacttgaaccccgggaggtcgaggctgcagtgagctgtgagtgtgccactgcactccagcctgggcaacagagtaagaccctatctctaaataaataaataaataaaaacatagaaaagctacagttaaaatacatatataggtatgtattttattatataatatatatcggttaggcgtggtggctcacgcctgtaatcccagcactttgggagcccgagatgggcagatcacttgaggtcaggagtttgagaccagcctggccaacatggtgaaaccccgtttctactaaaaatacaaaaattagccaggcattgggctcagtggttcacgcctttaatcccacactttgggaggatgaggcgggcggatcacttcaagtcaggagttcgggaccatctggtgaaaccctgtctctactaaaaatacaaaaattagtcaggcatgatggtgggtgcctgtaatcccagctaccagggggcctgaggcatgagaatcgcttgaacctgggaggaggaggttgcattgagctgagatcaggtcactgcactccagcctgggtgacagaccgagacttcgtctcaaaaaaaaaaaaaaaaattgtccaggcgcagtggctcacgcctgtaatcctagcactttggagggctgaggcaggtggatcacgaggtcaagagatcaataccatcctagccaacatgatgaaacctcatctctactaaaaatacaaaaaaaaaaaaaattagctgagtgtgatggcacgcacctatagtcccagctactcgggaggctgaggtaggagaatagcctgaacccgggaggtggaggttgcagtgagccaagatcgcaccactgtactccagcctggcaacagagatagagactctgtgtcaaaaaaataaataaataaaaataaataaaaaggacaccactaactggtgtccttccttcattttttgttttggctcccccggccctgagccccagctataacttagtctagtgtcaaggaatattgagattgtttctagacacactcagacttcatcaatgccataaagaatgtctcctatcctaaattgagaccacaacctccttgagaacacaggtttgtccatgtccaatctacatagtatagtaggtactcaacacataggaagaactcaatatacattgactgaataaatgaatgaataagtgaacaaatgnnnnnnnnnnnnnnnnnnnngccgaggccactgcactccagcctggcaacagagaaagactccatcccaaaagagaaagagagagagagagagagacggagtcttgctctttcgc

SEQ ID NO: 15159 - DNA, 7190 bp, Human
gaagaaagaaatacagaaatagtacaaaatctcaggtgcagagaaatcagtgcgctctgaaagttgaacctcctcaggagccatcaaatacccagtgcaaaatttcctaaaatatgatacaaaagtataaactagaacagaaaaaagcaacaaacggagctttaataaattcacaaaattttaaacttttgctcttcaaaatgaaaaggcaagccacagactgggaaaaatagatgtaaaagatatatccaacaaaggacttgtgtttaaaatgaataaagaactcttacaactcaataaaactcaattttgaaacaggtaaaagaggctgggcccagtggcttgtggcttatgcctgtaattccagcactttgggaggccgaggcgggaggatagcttgaagctaagagaggccagcctgggcaatactaatgagaccgaactgctacaaaaaaaattttttttttaattagctgggcatggtggtgtgcgcctgtaagcccagctactcaggaggctgaggtgggaggattgcttgagcccaggaggcagaaactgcagtgagccgcgatcatgagactgcactccagcctgggtgacagagtgagacactgtctcaaaaacaacaaatacaatgggtaaaagatgcaaacaacaaagatatggggatagtaagtgagcacatgaaaagatgatcaatatcactggtcactaatgagctaccaaatactcagtgcatgcaggaaagacagagtggccagctgccgctttaagtgtcatgtccctgcccagtaagtcaggctcagggacacacagttcacacttccctccctgctgccgctattattctactctgcttaggactttctactcctaggcttcttgtgttagacaagaaacatcactggatgaggagagcaactgagtacaatcctctcacatgggccaagattagagtcaactgggcacctgagttcaaatctcttctcctagaccatcagtttctacaaggtagaaagtaagttactttatactctagcaagatacaatataaaacatgggctttagggacagacacagctaacactgaaggccctctcttacttgctgtgagcctgggaaagtcactctgattcatgtttctcatctgtaaaagttgaagtacctttgagaccagatgctgcttatccaacagcccttatctcctttcttgctagtagacatgactgaactttctagtctacacgactcaaaggataattcattaatctaagccactcctgatggatgatcttacttgctttgccaatgacaggagtgagatgacccatttctagcaaagccatgaggccgtatctgctggagcttccaggggaagacttccttgctttagaaggacacagaaaaatctgtctctcttttgccagacacggttctgtcagcatttccttcccagaattacagtagccatattgggaccatgaggcgaactggcgtgaggataaacatggaggatggcagagcaaaaaaatttcaagaaactgagtctttggtgttatcactgagccactgaattaaccaaccttggagtaacattaaattaggatttcttgtcatatgaaatgatagttttcttatttaagaaaaatttaatcagaattttgtaatatgcaattgaagataactgataaactatttcgcatgtaaagatgctgtaagatgcaattatataagatactgtagaaaacacctagctaagtacttcaaagtacccaaacaaacccttcctccttttgcagctcactctcattaatagcccacaggccttttccaaaaacctggctaaaagttcccactgtctcttttaagaggaaagttccctccctttggaaaatggggacaaaggaccaaaggctccctagaaaggtccctcaatattattatactttgtccaaaaaaaaaaaaaaaaaaaccccaaacaaaaaaccattgccaagaggatggtggtgaagatgctacagtccagaacaacaggacacagtatgttcctgcagggtaagccacaaaggcctaaaaaaccttggtatgatatactggagaaggcagttgtgcgtaagtggaaaactaaatgcatctaattccccagcaaatccacttttccagctcttccttcttgacacagctgctttgaaggagtacttctgtcatgctgtgtgccttctaagccggcctaggcatttctcagcctatcatcagaggaataaatgtctgcaaagctagaacaaaaatggtgagctaattttccaattcgacattacttcccattcaggcagtagacagcagcttaaggatggcccagactcagaaattccaactaggcttttccttgcactaactctttcgtttagccaccaaatcctaattgccatgagattctggggtctgctacaccaagagataccaaacaaatacccagcctgactaccccaaggcaactgctagtccagaatgtgctccagcatattttgccaattgacagagcagaaggaaggatgctcaaccagtaatgaaaaggaatgcccagaggtgccaggacaagccttcactgaaaaccttgagctccaggaccaaacaatgcaggctcccagtctttttaacttgagtagcaaccacaggcaaatcctgaaggcttttcaatatcaatcttttctaaaactaaagtttatagcaaaatttgccataatcatcctcctcctattccccctgctaagttctttatttctgcctcactcggagtcataaatttatgtcttatttcaactggtcaaaatctgctccatgtccaatctgctcttcaagttcaaccaacctccctaacccttgctgctgaaaagaagcatggggctggctggctctttcccaagggagtctgccagatgatagccacaggccaatttacaacacttggcctccagaggaatgctaggtccacgtatgtacacactggctgccactgacgatttctcactggggtatccgccaggatccttctctgagccttcttacccccatgcatagaaataacaatgctctagcagtaccaggaagaatgccagaatttacatgcttgacaattataccaccagcttaaagtacaaaaccatagaacctccaacttggggtgagtgggaaaagacaatgataatgtagttaagtatctgcttacctgaagattcaggaattctgagttcatcctgtgtactcctatcacttcttgatccactgcccacccagcccatactcataaaccacagactactagcctatttcaattatatttgcacatactgatctgttggtatatgccatgaccctgagatgacaaaaatgaagagaatatagcttctgctcctaggagttcataggctctaaagaagacaaattatggaaataaatatagtatgctactattatctagtatgctggaacatggtttataatattggctaggaacaaaattaggttttgtttattcttttacaattatctcctaattggtggtagttgtggtgaacttgaaagtcctagttttagccattttagaattggtttttccaatgctcattttcaagaaatactggagaataacgtaagtaagtcatagagttacaagatccccaaaagatggggagtagaaaggtaaaacacacagaaaaaaaaagaactccctctctgcagcagttcatgttgttaatcactcccttcatgaaccttcttctactctgatttcttctcctacctcaccaaactggctaaacaaagaaacaaaaaacccacaaactgtctaccagtgatctgtcaccttaagatctgcttcctcccccgaacctttaaattgagtttcttagggggctgtatactagtttctcttctctttttctaagctatctcattcatgcctatggctttaactaccatctataagactcctgtatctataaatgcagttttacagtcttacctgagcaccaacctgtgtttactggacaccttacccttactgccccacaaacacctcaaaactcagtctatacaacattctgtttcttcaaaaactccccaccttccttctacagtctccccgtcacccccatcttgactggcagaatgtcccaacacactcctatggtcaaggagaaacctgggagctaacctctactcctgtcttctcctcccaccagccatcgagtcctattaattctacctcgtctctcaaatctgtcccttcctccctatattcgttgttgtagccttattccactccctcattatcttcctcctatgccaggggactatttggctaatcatatcccccaccaaacttaattcccttaatgagacggacactattttcctcattttgaattgtgcctcccctccccacaatactgctggcacagtgctttgcatgtttgttgaatgaagaataaatgaaggctctgtgaagtattcctgcataacaatctacagtattattctcacctaaaatctattagagatgtaatcagtcccaaaagtttgttttgctggtaggaaaaaaaaagagaaagaccgcactttagaaatagaagccactgttgtctttataaaacacagaattgtgctgctgctgctgctgctgctgatgttgcttgcttcagaaggaactgtacattacagctgctgggataatttcacaatggactggacaaggtacagctcaaagcaggacacaaacacaaatctcaaagggaaacaaatgcaaacaagtacacagctgtggggatccagagacatttccccatccatgctggacttgagagggataaaaagtttagaaactaaagtgaaaaccagagtagtcacacatgcccaccacatggctgctaagtgcaacatcacataccaattaggctggactgtgtgcacaggaaagtaatttcatttttccttattgctactacaccaagggactcagtgcattcaacaaatgtctttacttgcacaattcttggagggtttcctattttcctctgtaaagaagaaaatctccctttcccacctcattctgttttgtttttagctcattccttcccctccctttcttggatgcccaaacagcagccagaggctctaagtcagtatgagtagagtaagggagagcaccaacccagcctctctccctgcccagggagaaggcaagtcctattaagtcggaggaaagcgaaaaccagaaaatacctccttcccaatctgcttagaaggccaaatagtaaaaagtgccctgcatatccctgccatgatcagattttaagaaggaaggtattccagctaccatcctggattggcctaggccccatatataaataaaaataacgtcccccaatgtagtttccaaaactgccttttggctagtttgagatgatttttctaccctgatggggaagaaacgtccaaccttgttagttacacatgattccaggtccaaaactgtcccaccagccttacagatatcctatgggccagctaatagtcagtgcacccttggctgcccatcttgagtgctggccttattcacaaacagaaaaaaaaagtatccaaaaacactgctgcttagctaaataggaggccacagagaagctatctagcaggtgggcattaggagctttttagggaagtttcaaatttctaggtaccttcttcggctttatgttaagcctaagttcccagcaacagtagccccaggcttatccctggaggccagtgtagcacctcgatccctaatggatcaggttggactggataaacaatcaaagaacagtgctctcctttcccaccttttattcaaattctctccattctcttctcatcactctttttcctttatgtccatcccctaacactcaaacccaggatacccaaatagctcaaccctaagacaatctcagaaaagccaggccccaggtaaagagaaaaagaaccagatttagaaaaagcaatgagagaaaccagctccaaggagtggacaggtgtggaaaatgccagaaaccctcctgacttcacacaagttgggcaggtcagttgctcttctctagtataagcttgagggcagtccagcccaggtggacatctctgggcttggggaacaggttcttggtcttctgcagtcaaggagctaagcctgaccctgccagctaacagtgggatcattgcagccatgcagagatttcatcatcacataggcagacaggcaggcaggcaggcaggcaggcaggcaggccggccagcaagcaagcagagtgaatagaagaaaagggaaaggaagccaggcaaagagagaagaggaaaaggaaggcaaaacagtggtacaaagggaacaagagacccaactaagaggatgaggctgggggtcccccaagcacttccttgaagcttgggtaagaagcaccacttaaaccaaatccacatgagccaaagcttgctgccaacaccacttctccatctgcatgcaccacctttcaaacaggaataatctcaaggtcggggtatttttcaagtctcaaaaattatctttttacaaaaaaatcagagtaagaactcatttcttgtcattgcccaaagctgattctcttgctttttatttcttgaatggcataagccacgtcaaagggctaaaaatgcatttcaagccccagctgaaaaccaactggagagagtgaggcaaagagagaaaaggagagaacacaaacttgttgctgggagtagaggctgccacctgctccctatggacatttgcaaatgctggtgaatgactggaccctccaggaatagtgccctgatcctagccccaaaatgtatccaagtggagaacatgcagagcccactgtcccaggagaactcccctccccaaagggtgacagaacacgaagtagactgtatatgaaggcaatggacagggcagatggagtgttagcatcactctctttaggcacttgtgtaaggaatgtaggctctccagtgagctgcctcctcccagagccctccattctgttcttcagctgggcttgtgcctatagggcaccccatgctgtagccagcaggaaaaaagtaaaggaggagttactcaacagtcctgatgctttctccataat

SEQ ID NO: 15160 - DNA, 16225 bp, Human; identical to SEQ ID NO: 15152

SEQ ID NO: 15161 - DNA, 23172 bp, Human
ccgataaggctttcaagctgaaattatgtagtcatgttttaagagccaccttggagttgtctaagggagacaaacttaagagaacaaagcacctagagtcataattactactaaaaaagggtttggcaaacttttgtaccccatgcttgctagaacttaagacccagttgctgagtgacagttttatttcattaggaatagattggaaaagccatatttatgagagctttcttttgctctaaataagtttcaggacaaggtggaggatgggtagtcgaaacactggcagaatcttctatgagtaataacatctacctgtatgcagttgaattcaaaactagtggtttccccaagaggccctgtcatttaatcgtcagaactaattaaggagattttgtagtaacgtggaatgttctggctactaggtatgtgccaaaaataacacttccttctttacactattatgcttctgattttcccaacaaacctatatagtcatccctcagtatccttggaggatttgttccaggaccctcctggataccaaaatcctcagatgctcaagtgccttatataaaatggcttcgtatttgcatataacctatgtacatcctttaaatctagataatacctaatgcaatgtagttatattttaaaatttgtatttttttaatttttgagtattttccatacatggttaaatacagatgaaaaacctacagatgaggaccaatttgctcataagcaaagcaataaataaattctgtctgctaacttcatgataaaaatacttgaaactttccaactttacgccaatcacctacaaatctgtcattatcaccacaaaactctcaaggacccataaggaagcagtgtgatgactctgaaagtaatttttttttcctttttttctttcaataactttggttaaaaaaaattgataaaacgcatctcccttgtgacactaataaacaaacatgctcatgtttgaataggcagtcactagatttcaggaaaagagtagatatggtttagagagatgttaaaattgtgtatggcttaaagagtacaatattaaagctagaaaagtctctaaggtttaaaaatgagttttctgaagttgcaaactttaaaaactgacattttcatactattgagctatacctttatgatttgtgcagttttgtatttcaacagaatttatcttcctaaaaataacaataatttgtggaatagccatggccattcaatgatttattagcaagttgtgatttttctggtaagtcaaataatttaagactgcaaatttaaagatgaaggtgatggaaaaagtattgctgatcttagtttttaaaaatttacctttggagaaaaatcaaaactcttatagagatatctctttttttctttttgtagttcaagtacccttacaagactgatggaattacagttgtataaatatggactactgaagaatctgaagtattgtattatttgactttattttaggcctctagtaaagacttaaatgttttttaaaaaaagcacaaggcacagagattagagcagctgtaagaacacatctactttatgcaatggcattagacatgtaagtcagatgtcatgtcaaaattagtacgagccaaattctttgttaaaaaaccctatgtatagtgacactgatagttaaaagatgttttattatattttcaataactaccactaacaaatttttaacttttcatatgcatattctgatatgtggtcttttaggaaaagtatggttaatagttgatttttcaaaggaaattttaaaattcttacgttctgtttaatgtttttgctatttagttaaatacattgaagggaaatacccgttcttttccccttttatgcacacaacagaaacacgcgttgtcatgcctcaaactattttttatttgcaactacatgatttcacacaattctcttaaacaacgacataaaatagatttccttgtatataaataacttacatacgctccataaagtaaattctcaaaggtgctagaacaaatcgtccacttctacagtgttctcgtatccaacagagttgatgcacaatatataaatactcaagtccaatattaaaaacttaggcacttgactaactttaataaaatttctcaaactatatcaatatctaaagtgcatatattttttaagaaagattattctcaataacttctataaaaataagtttgatggtttggcccatctaacttcactactattagtaagaacttttaacttttaatgtgtagtaaggtttattctacctttttctcaacatgacaccaacacaatcaaaaacgaagttagtgaggtgctaacatgtgaggattaatccagtgattccggtcacaatgcattccaggaggaggtacccatgtcactggaattgggcgatatggtttattttttcttccctgatttggataaccaaatggaacaggaggaggatagtgattctgatggccattccctcgatacattcctggcttttttctgggcaaagggtgccacattggaagaggtggaaatataagttctgaaatctgtagggaagagaacacattaagttaattcaaaggaaaaaatcatcatctatgttccagatttctcattaaagacaaacaaagttacccacaacactgagatcacatctaagtgacactcctattgtcaggtctaaatacattaaaaacctcatgtgtaataggcgtataatgtataacaggtgaccaatgttttctgaatgcataaagaaatgaataaactcaaacacagtacttcctaaacaacttcaaccaaaaaagaccaaaacatggaacgaatggaagcttgtaaggacatgcttgttttagtccagtggtttccacagctggctaagccaggagtcacttggaggcttttaaatacaaaacattggagctggaggccattatccttagcaaactaatgcagaaacagaaaatcaactaccgcatgttctcacttataagtgggaggtaatgataagaacttatgaacacaaagaaggaaacaatagacattggagtctatttgagaggggagggtgggagaaggaaaaggagcagaaaagataactattgagtactgggcttcacacctgggtgatgaaataatatgtacaacaaatccctgtgacacatgtttacctatggaacaaaccttcatgtgtatccctaaacctaaaataaaagttaaaaaaaaaaaaagataaacacaaaacattcatgccctagcactggtctaatgaacaataataaaatctcagaactagaggccaggtattttgacaaagctccccaggtgattctgatgtagccagtttagtatttgggaataatagttttagattatcccataaatcaggtgggcacgtcaggttcacattattcaaagtgttcttatcagcagttttagacctctctgcttagaatgccacatcttcttaaatttctgattttgctgatctcaaatctgcatttctaagtataggatttttttaaaaaaattatattgtgtatagcattgcattcatgatagaaaattcaaaaagtacaaaagggtaaactgtggaaagtccctctttttttatctcaccctttatcttctttatcttaacccttctcaagggcaactgacaccaaacatttttttaaatatacctttagagatattctatccacatctatacacactttaaaaatatatatgtatactggattgtatcctgctttttacatttcataataatacatttcagaaacatatcaatacataaagatccttctcatttttctacagctagatagtatagcaatgactataaattaaatggtctcctagtaatgggacattgaggctgttttcagtctcttactattaaaaaaacaatgatacacaacgaacaaaacaatgctgcaatgaataacagcacagttaattctaatagaaggctttataggcatattttcgtttcttttggtaaatatttaatacttaggagtggaactgctgagtaatagaagagttacacatttaacgttaaaaagttccagttttccaaagtagtggtactattttacatgactagcaagtttatgaatctagctgcttcacatccttgctaacatttcatgctgtcaggcttttaaattgtgcagttctggaagaactagtgtttcatatggatttaatctgcattcctctgatcataaatgaggccattcacataactccttttgtaaagtgtttattcacatcttttgctcctcctgccctttttttgagattacagcaggatatgcccattatttttcattgaatcatttaccttttactagtgatttgtgagcgattttaaaaaaagtatattctggaaataagtcctttacagatatatgtaatgagaatattttgtcctagtctatggtttgcccattttcttaatggtttctttgatgaacaaaaagatgattaattttgatgaagtccagtttgtcaatttttttcccttattagttactttttgtgaccctctagaggaaatatttgcctgtcacaaaataaagattatatttccctatgttttcttctaaaagcgtcagagatttatcttttatgtctaggtacacaatccatctcaaatcaatatttttgtgtatggtgtcagctaagttaggttcgttttttttcctacacagatcatccagttgtttcagcacaagttcttgaagactttccccattgaattgctttggcacttttgttaaaagggagaaaaaagactaactgtatgtatgtgggtctacttctggactctctatcctgtgccatcaatatatttgtatgtttttaaaccattaccacactgtcttgatgaatatataatagctttgaattagtgtgagccctccaactgatcctccttttttaaaattttgaatcaatttgtcactttccagaaaaaaaccttttaagatgttcattgatactgaattggatctacagatctatttcaggagaactgacacaatcttcatttcttcgttttttaagatatgaataattctttatcccctctcttgggataccttttagaaaacagtagagaacaaaaattccaagctagaaattttgttgtccttatttgataaaacttttttaaagcttgtggcaatgccagattcaagatactagaaagaagaaaatcaaagtgggccatttgcactagctttcacacaagtagtgtttctctattataaaatgttttgctaatgagtattaggccaaggagaaatgttttccttaaaaagcacgtaagagacacctcaatttccatacctttctgttatcctaatagtctttcaacatgagggaaaataaatgcaatttaattttaaaagaaatcctaaaaattaaaggttaatttgcttgtaaaaaattagcagcaatcaatttaatttgagacttacattcttgcttaacaacaaataaaattctgaggtaaaattgccacacatttggatgaattccagaaaattcaatatacctaatttgcaatatataatccatcacacagagaaaaaaaatgcctcaaatatttatggcaaggtttttaaaaatgatcctgaagtacaaatactatgtttacttatttatatagggaatgtctctggaaggatactaaaaaaaagaaaaaaaaacctggtaatgaatgtctctgtggaaatgcatagggactggtggttggggagaaagaggacttctcactattatactgtcttgtactgtttgaagtttcataaagccaggtacatgttatatacatatacatatacatacacatatacatagaatcctaaattatgataatcttcagaaataatcttcccctaaagtctaggaagaataattcaactgagaaaaaaatgagaaaccaaaaattaagttacactgaaataatgttcattatgtaaatgtatgctgaatttaaaagtttagtttatcatactaaaagctccaatattctgcttcttactcattaggtctaaattttcattttcagctcaaccttaccacaaacctggtatgtttcacatttaatcaaagcaagtaagtaaaaatagataacctttaaaaattagtaataagtacatttacagaataaggctcaactcaaaaaatctctttaaattgttatgactttaaaatatctttcctgttgaagaatgctgtttggtcaacaattttttaaagtcgattaaatgttctttggtatgtagatataaatagtaaatcagtgaatggatctgtaagtgcaggcacactagctatatgacttttcaactagtaaagcaaaaagggagacaatgtttcagcttgagtaaaatattaattataatataataaatttagagaggtttctctttaatcatggaacgggagagaatagaaagttaaacccaaaggtacaaaacaaagtgttacatactacaaaaaataagtggtaacttttgaatgagattttaaaatatcaggaatgttttaccatcatgaattttctactttttgccaatttttctgaaatatatttatcctagttattgtatagtgaagctgacctttgataaaatgactcaggatgcctatttacgtgccagagaaacagctttcccttagcatggggaaaggcaagaactattatccagaatctcaagtcagaaaccttgggcaatgccaagtaggactacctgaaaggtcctggcaatccctgcacatccctttaaaactgagctgttttcatggttacctggtacacaggacttgcggctgcagtcaccgaactgggtttcacttccatttccttacttgtttcttcatctgaagaagaggatcctgaatgataatcagaggtaaccttatcaagggccctggtaactttcctggagatctcatccttgttctcatctttattttcaaagctggcaacaatgaatgcattgtttttctctccatacctaagaataaaattaaaaacttacaaatcttgaagtcacatcagcaaagcaaaaaatgtccataaaaacaaagagatctggacatgccatcaatacaaggcaaagattgaatcatcacagaacttgaccctacacatttaatatcctaatacagctcaatgccagcaagcaaaccacagttttctacttctggtctatttaagtattcataaacataaccccattttctttcccttattttctttctactaattcctaaaaaaaaaattgtttaaaacatcaaaaaaagtccattgttttgattacatttttgtatgtaccaatgaaattggttgtacaataaaacattctgatgtatttttatttttttgagatgggtttcactctgttgcccaggctggagtgcagtggcacaatcacaactcactgcagactctacctcctgggctcaggtgatcgatcctccaacttcaaacctcccaagaggctgggactacaggagtgtaccaccatgctcagctaatttatatacatttttagagacagggtttcaccatgttgctgaggctggtcccaaactcctaggctcaagagatccacccacttcagctacccaaagtgctagaattacaggcatgcgccactggctgatttttttttttttttttttgagacggagtctcactctgttgcccaggctggagtgcaatgggtgcaatctcggcccactacaatctccacctcccaggtgttcaagtgattctcctgcctcagcctcctaagtagctgggattacaggtgcccaccaccacgcccagctaatttttgtatttttagtagagatgaggtttcaccatgctggccaggctggtcttgaactcctgacctcaggtgatccacccgcctcggcctcccaaagtgctgggtttataggcgtgagccatcacgcccagccccagctgtacttataaatgtaacatatatgctagtaattcaagtcacagatcaactagaaatttcctataaaattgactttaaccccaattaaataaaaaagggggcctgttatttatactcacaaaaatgagaactgaggcagttattgagattaaagaaaaaagatagttgttgaagaatatagaggttttgcttaaattatattgcttacttcagagtttcctaggataactactcacctctcatcttaattttttttaaggtaagatgaaaaaatcttgttattcttccaaaacatttttgaagatttttgattttttttaagttgtcaaaatatgtaacatatgctgctggttacttaaaaaaaaattctgaactgtaggaaaatagtgtaataaactcaagtaaaaccaagagtttttattcagtggacataggagaaatccacaaatctatttaaatagattgcacagtgtcaacactatcaaacaatttctagcatcaggacaaaggatattgttaagcggttcttacaaaacacatacagttagaaatgtaattaaagtgattctaagtttgaaaaaagataaaaataagtaactctaagtagaaataatgtcaagcttttgattcaatagttagctgaagttaattcatttcaagatagcactcgtctcaaattatttctgaatcagaatggttatctattataaagtaaaaggcttaactgctataaagcctttgaaaatgtacatgaggctgggtgcagtggcttacacctgtaattccagcacttcaggaggcctaggtgggcagactgcttgagcccaggaatttgagaccagtctgggtaacatggtgagaccctgtctctcaaaaaaacaaaaaaacaagaacaaaaaattaaaaaaacagaaaagaaaatgtatgtggaaatctagcagtctcagagatcacacatagatgagttctatttcttcagatagctatgctgtcttccattcctataggccaaatgaaactataaatactacttaaatatagtacataacttcgcttttgtattcttttttagtttacctcataaaagttgctacaggggctgggcgcggtggctcatgcctgtaatcccagcactttgggaggccaaggcgggtggatcatgaggtcaggcgttcgaggccagcctggccaacatggtgaaaccctgtctctactaaaaatacaaaaaattagccgggcatggtggtgtgcgcctgtaatcccagctactcgggaggctgaggcaggagaattgcttgaacctgggaggcagaggttgcagtgagctgagatcgcaccactgcactccagcctgggcgacagagtgagactccgtctcaaaaaaaaaaaaaaagttgctacgggatggtagaaagggcattagactagtttctcattctggctctgccactgactagcttggtcaccagaggcaagtcacttaatttccctaggccttagtttcctatatgctggacgaggaagctggagctggctagatagtggttgatctacggctggtgactcttcgtagtataaaatacctaaacagaagctggacatggtagcttacatctataattctagtactttggaaggtcaaggcaggaagattgcttgagcccaggagttcacaattatagtgagctatgatcatgccaccgcattccagcctggacaacacagcaagaccctctctctaaaacaaaacaaaacaaacaaaaaataaattcctaaacaattgagttcctcacaacataaaatttgtgttctctaatttcaagtttacttagcataaggttttagcaatacacatttactccatgtcccctccacagttggaagactcaacaaatttcaagacaatcaagggttaattcatgtgttaatgacactaatataacaatgacttaggcctatcttcagttttgcccattaatggaatcaaaattcaaaaatggaaaggcaagaaatttgagaaaaattcctgcctttgtaaacagaaacctcaaccaagggcaaatatctaatgattgaaggatcagcattattaactcagatttctttgacacctagtttggttctgcatttttccctttgtactattttggtatgaaggctctctcttcatggtaagagaagctgctgactatactactataacattacaatgtgcagtcgatatcttaggagaattagtagacacctggacaacttttaaactttccatttttcaatgatcactgataaaacatcaaggctaatttagttatttagaaacaatcaatagtatttaacactctattgggggaaaaaaaggatggcagaaatcaccaaaaaaaaaaaaagttgtaaaatatgttgagtagataagctggcatctgttctcagaacttctcatcataggcaagatttattttctattctgtatcacgaagtgataacctttctaactatatggcactctttgtactcttgcagcattttattctatcagagtaagtgaagactatgaagaatgttctcagtgcatctcaatttttttttacaatcttagtctctagtataccaatgagttattatttttaaagattctcagatatttgatcaattgtatacttgctagatcagctttaattttcaaaatatctatgtttccagttttggtgaaaaaatatttctcaatgtctttttcttctgttaacttatatcaaccacctctactaaacgattaatacgtctttctttttggggttctgttattgaatgaacacctgacactcgcaggtgatttctattagctgtgaaaaaaatcacatcagagccaatttttggcaaatttacatataaattagaagcctactgaatgaaaaggttttctaagattaataagatgaaagcaaagtagcagttttttcctaccaggcatcatcaagtaatgaaatgtctactgaagtagaatgtccgtataactaaagtttttatgttcaggtactgagacttattttaagcattttaaatacataggtccaaaatgtttatataattatgtaacttgttaaacatccttggacataaaaactttcccctgatggtttaggatcattatattgaacgtaaactatttgattgtgtgataacataatcgtgctgattttttagctttttcatttttgcctctatgtcagaccacatgacattttttggtagcgtctgactcatcaaccctctttaaaatgctgcttctcacatttcatgggttaagaaaccacacaactaacttaactgtgtgttaaataggagccaactaggatctaagtgcaggtcaaattaaaaagtaaacaattcaatatagtagctttttgacagctatttcttataaatggaggtcttctgcacaggttcagtggccaaagttttccaagtctgaaactagcctaaagcaggtccttaattagtcccagaatctaaaaatgtttattttctcagacctaaatttgagatagcttgctccttttctacccgagaaagaagtattggagaatgtttatcacaaacctctaccacctacatctggtttccaaaagcaataaacttacaccaaccactggcaaatcaggtagtaacctcaagcggtggtcctgacaaaatttaatggaagaataatcatgtaattcatctctcctgtcttcacctccaccttcattgctggaatcaggtcagtctgcgaccaccttaggagtacatagttagggttccttcaaaaagcaactttactacaatcaataaagaggccaggtggtcaggtgaattgtacctcaaaaccaaatagaaacatcctaaaggcagagccacaggaaaattcttgcaggaattccatgcctctgttcatcttcttcctgctagttagaacatccttcccaccttgtcacctggtcaaccatggctcatccttcacctcccagctcaagtatcacctactcagtagtctcctgactcctcaccagatgcagtaactttctactttgtgcaacctaccactgcattttgtacacatttctaacataaatcagataacaatgtaatttgcttacttttcttctcaatttcaaactgaattacctaaaagcagaatgttgctttcgtttttgaaaaccctacaactgagagtgcctggtccacaaataatggtttttgagcaagtggagttcaaaaagatttcatacctagcactgatctttcacaactctattcattaggagatgtgaaaaataacttccattataaaaataaaaccacgaagtatcactcagtcacttacataatcaaaaaggaggaggccgggcgcagtggctcacgcctgtaatccagcgctttgggaggccaaggcgggcggatcacgaggtcaggagtttgagagcagtctggccaacatggtgaaaccccatctctactacaaatataaaaaaaaattagccgggcacagtggtgggcgcctgtaattccagctactcaggaggctgaggcaggagaatcacttgaacccggcaggcagaggttgcagacagccaagaatgcaccattgcgctccagcctgggcaacaagagtgaaactccgtcccaaaaaaaaagaggagagagggagaataaacagaaacagaaacaaaccaaaagtggttatccagtattatttgggattagcttcttaatttgaagacagacaagtgcaccaccaattaaagataatagacacctagcggaatctaggtgtctacttcttggtctacaataagcttcttggcaaagcactactagaaaacccccgcctaatcagtttcttttttcggctataaagcagaaatctaactagtccttcaacatcacctccagaaaagtatttcataaaatttacatctgagagagttaaaccaccagctcctggccataaagatacacaggcaggccgtacatgacagaatgtcataaaattagttccagcatggtcatcagttcagcctctaaacttgagaactcaccgacagcacacctcacatgggtccacccagagagtgagctcctttggcaagcccaggtcactatacaagatgcagctgttttcacaggctttcaggacatcaggatcaactctctgaaatttattgacacgaatacatctacaacaaagtggagttacgttaatggatttaaatgaatttaatcataaacgccgtaatatctattcatacttgccaaggtgagtaataaaatagtaataaaaaaataccctggtagagaacctaggagcatatctatcctaaacagataataaatgtgaactacaggcacagaggcagcctgaaaaaaagatggcacctatgtgagcccaaggaaatcactagtactgggtctacctcagtctacccagagacttgaccacccatgtacattaaatgagcacggagtatgaaagttgcacgaaattttagaactctgaaggtaaaagtttctataggccaagttcctatacaaaaaaatctctaacaaaaggcctcatctaatgtttcagatggtatttggaaatgcttacgacaaattctgatctgtcattaacttgcttttatatctcagatagtaaagtggtaagaggacacccttgctttacctataattgttctataaatacaggataagtgaaggacacagattcattcatatcatatacttatgattaaaatacctaactaacatgttattggcttatttcatttaacttctatttacccaagcacttttatttaaatagttgtcaaaattaagtgaggaaaatttctaaaccaataaagcctctgtcccatctttttttaacctattatacgacatctacctaatggaatgtttaataaataaaaaatatgcattctgttaaatgataagcattctgattaagtagggaaatagggcctatgaaggaaaagtatttactgcctacaatcaagaatcaatcaagagaacttggatttcagcactaatcctagtatttatcaggtaagcctagttaagtcactgtacctcttcctcagacctgtaactataaaacatggaaatacaagttaattgatgaatagtaattacgctgtaaaatacaatgatataaagactaatgtgctatttaaagtttttgtaaaagttaaattattagttggttttaatttctatttaaaaaatgaaaaagttctcaacaggtaataggaataagtgtttctacataataatattaacaataataagcattttaaaaaatttattatgcaatggacaatttcctaaatgctttgcatgtattaactcttaattctcatgatcatcctgtgagttagatacttttttcctcagcataaagaaaaaaggaggcagagagagtttgagtaacttcccaacattacacagctactaagtgatggatctagggttcaaatccaggccactagactccaaagagcaagttatttccttaatactcaaccctgtatatacgtacctatcttagcgtcaccattaacaatataacaaaggcaaagtgagaaaaattattttctagtatgtaaaatactgcttagtccttttaaaaacatggtcttatgctatagattctaatattgtatagggtaatttgaaagatcccatgtgctctgggaccaaaagcagttaaggataaaaagatatatcttagatgtatgtgtttttcttatctacaattaaggtgatacaggctctaagcttacaaattatatataaatatagatgcttaaacagagactatgcttcaacaaaatctgcataccttacatgttttgtactattttttttcactctacatactacttatccattaactactcttcaaaaacaaaattttaaaagttgcataaaaatattctatcatttacttaatgttgacagtttagttctttccatttttgcaattacaaagtgtaagagacatccatattcatacatgttcgtctgcatttctaattatacttctagaatagattcttgggagacttactgttcaaaaggtatgaatatttttatagatcttgataatattgccaaattgctctctacaagtatcttatttatattgcagaaaaacaatttcaacttacaaacattttgtaagagaaagaacactccacctattctacagactgaagtctctactaacttggttaatcttatattctattcatttttataatagtaacaacccactattttttctacttcaaatacagctttaaaatgactcagtaatgatacttctgatcacatgccaatttaatcgtttcagtttttttctcaagtttttagaattaatggaaatgaaattgtacactgtctgacctttaaatatttacttgacagtgcctcctttttcagtaatagtatggtggcttggcacttccaaaaagccttcatccaatgtcagttaaatcagagtaaaaagcctcaacagttctaacttaacgaaagctgttcactctattggaaatgaaaatatgcaaaaaaaaaattaagataatcaagagataagataaaaaatgacttgagcctgtgttagcgtgcacatttctattttaattcattttccaatttactggaaacctctttggattaaaaatgaaaaggaaaataaactattttgattctcttcttgtcaatagaacacaagctcacttgactttcagtacatgagaaattagcaaataatatgtttacctcctttttagactccttgaatagtgctgtacttgcaagagcccagtggcagaaaggaagtccttctgacatcaaagcacaaagtgttgatttgtgtaggaaactttggggacatcaatatacacaaataaaagagtatttctgtagttatcactatagtcactgttccacttttatttctcgtggccacatccacaaaatgggacaatgtttggcagctgagtttagcagaacattctcaactgaggttcctgagcagtcacataaatactacagtgagcatgccagggcatgttttataggagtctgctcttctttactttaagctgtaaatgtaccttatacagcagagtacaaaagacagctccaagtgagaattaccttcgttctcagtgccaaaacagtggtaacactgtggtgtgcagaaagcccatgaaaacatggggtcatgtagacctgagttcaaatcccagaaccttggccaggcatggtggctcacgcctgtaatcctcacattctgggaggcaaagggagaagatcgcgtgaggccaggagtttgaaactcacctgggtaacacagcaagatcccatctatacaaaaaaaaatttgtttttaaattagcctggtgtgttggcacatgtctataatcctagctactttggagtctgaggcagtaggattgcttgagcccaggagtttgaggctgcagtgagctatggttataccactgcactctagactgggtgacagagcaaaaacaataccacaaaaaaaaaaaactcccagaaaagcaaatcccagagccattatttactagtcgtggatcacaggtgagtcacattcatctagaaaatagttacactgacttctaccacaaatatataaatgagattattcttgtattaacgacatatcaggtgtctgataatcttagttccctttttccatacttttttttttttcaaagaacatataacatgtaatttacttttagatgcaagattcacttctttcaactcctaccatgcccattaatgtgttattaggggtcctctagaattgtgaaaatccctaagtatttgtgataaacagaaatgcactgttaggagccaggctataaccacaaaagactaactcctttgaccccatagcattggcctcctgtgtccaggcagtgggactccaccactccgccaacaaatacttgttttaaaatgagtaaggagaaaatatacaaacaccccagagttctatattttgcagatgaaacacctgtaggcatggtctgcacacccttcaatcatccggccttgaacccacctcaggggttgatcagcctctgcttaatccaatctaatcctttacctgtaggcctgtcctttcgatggtttttctggataccagtgatttttatatttttcttgaagtattagggtcaatttctcagcaaacctctcaactgcctcttttttcaacttatcatgttttcgaactagccttgtgaaaaagaagacaacggcagcaatttcattcttcatttttttccctgcaaagataaaacatgttttctcagaaaaacaaaatataaaaactgggaagatgaagctctgtaagatatacctcctttacagctctccccttcctccttccaattttatcttgtatttctttggcttatatctgaagtagagaacaatctacttatctttatgccataaaggccttattataaaatactacttaaaaatcttatcacttagcttcatgaagaaattccataaagatagcacgttgctcctgttggctaaaataaaaccacacctatcagtaaaagagaagcactataataaatgatacgacatagatgttactgtgtgtgtcaatatttagctgcaataatctaagtttaaaattctgtgaaatgatttgaactttaaaacataaaaaaagtctactttaaaatctagaactgtagagctattttataacagaaaagttcggcagttcctagaaaggttaaacacagagttatcatatgacacggccaattctacttctatttgcccaagagaaatgaaaacatatgtccacaccaaaaccttgtacagaaatgcccatagcagtattcataatagctaaaaagtgaaaacaatatgtttaccaactaaagaatggacaaatactgtgttatacacacgtatggaatattattcagcaatgaaaaggaatgagtactaatacaagctacaatatgggtgaaccttgaacacagaaatgcccacagcagtattcataatagctaaaaagtaaaaacaatctatatgtttaccaattaaggaatggacaaatactgtggtatatacatgtaatggaatattattcagcagttaaaacgaatgagtactaatataagctacaacatgggtgaaccttgaatacatcacactaagggaaagaagccagtcacaaatgaccacatattgtacgattccattgatatgaaatatccagaataagcaaatctatatagacagaagacagattagtggcctacggggaagtgggaaaccaagaaaaggagcattgctaataagtacagggttactttttgaggtgataaaaatatttactaaatttcactatagtaatggttgtacaactttgtgaatatactaaaaccattgaactgtacattttaaatgggtgaattgcatggtatataaattaaatcccaaaactgttctacataaaaaatttcagcattgactttccgaaagtactctttcaggaagagagatacatttatccacaagttaagagacacaaaaactagtggatctatcaggacatatttaagaaatggaaattcaggtcacccgcagaaaaacaaactaaaagaaataatcagagatttagctacattttggattgcctcaaaggactttaaaaatggtatatctgatttatcattgattaatccttaagggcaaacccttgtcctaagattgttttgatgtatgttgtctctactcagtgagctcattcatctggctgctgtaacctggagttattaagatgctgcctttagtaagcaacatcacctttttgggagccaattacgtattaaaaacatacagcctctgctatgtttagcataaaaacaactaacctagcagtagtttgtgttcccacatttccaaaaaaataaagctgattgttagctttcttttctcaaactgctctttcagtctctcttcagaatatgactcctttattccaagtgcaaattcaaacaaggaacctcactgtgaaataaattctacacagttatctgagaggtgtgctggcagccgcagatagcctgatggaggggaaggcacacaaatcttcctcccagaaccctagaatgagaaattcaccttctacagccagctagcaggcaccgggcatgggtccacacacgagtgtacacgtatacataaccccagcccaccacgactgctgtgcagcctcctcctgaaaaatgtaagccatttccactttgtaaagctacgtttatattccaccacgatacgatggaaaagaaaacccaaggcaatttaatatacgggttgggaagaaagttttgctgatggaactacattagcctccactccagcaaagcaaacaaggaaccacactaaagaaatgtactgaatcttttaactagatctttctcctcattcattacatttgccaactatgtgccacatatctgagttctggatttgtttctgtttgctctgcttcatataaaaaaatagaaaagaaggaaagaaccacttagtggttgcttttggttgtaacacaagatgactcatttggacttttgttttccccgtttgaagaaatgatagctcgaacagctgaaaaataagcccactcccaccagtattctaggagtaccaaaaggtgaaagagggagagttacagtcagggcaagaaccaccagaggcaagcagggccaagaagacctcaggcgtcttgagtaagtaggcgtcctccacccacactcagagcaaaaggctcccattttaaatatcgcacggtgacgtcatcctgggacctcgtcaccgcggcggctgctcctcaagttctactttgttccacaaggctcctctgctcacggctgcgtggataaaacccaaagggaatccagaatcaagctcggcctcgcaggagtttataacttttgtacttttccctcccttgtaacgaaaagctaatcgcaaacgtttctaggaacacatttttctcctgatagacgttcccaaggtggagggcgcgagaagactggcccgtggggtgaggagccccggcccgacctcagcggcgccacaaagccatgaagaggggaaataattttccaaggggctaagagttggactttctgaagccatcgaaacctgctgctaggctctcccgctggggttttgagagaggtaggtgaggagggatcaaacatctccacccgctcttgaaagaaccgccttgagctgcgcccaacttctgcaatcccggttttccccaagttcaaggggaagggccctggcgcccaatgcccagcctccccgacaacatcctcgccagggtgcgcctgccccgcgggtccgctgtccccggcgggcggccctgggttcgaggacccggcttcccggaggcgcgactctccagcaaacaagcggagctccagaaaaaacaccgacgcgaagggggtggacagagggtgggaagccgcggggttgtcgcccacccggaggcggaatgtaacgcgctgtgggaaacgtggcaggagccctgaggcggcgtctttttcctcaggcgcccgccgagggtcccgcggaaagcctcgcgggccgccctcgcggcccgcagccccgctctggcgccgagccggagcccatgcaacctggttccatcccctgcccctcccctgtccccggtgcgccgcccgccagcgagccttcgacgtggccgcaggggcgacgggaccaccctcccccgatacccacagccccgccatgtctgcctttccccggcccggtctcctcaccgccgctgccgccgccgctcttcggccggagattcggcggcccagaccgtgtcctggccgggaactgagggctccgcctcaacgggcccgcgctgggcaacagggagcgcagcgagcctcgtccggcgcgtgcggctcccgcgtcgtcgggcggccaagcgcgcgttgagaggactggcgggcggacgagcgcgcacacgagtgagcgcagccccaaagcggcgcgcagggggctcgcggcccggaagaggggaggggcgatgacccgggaaagggttggcgcgcgcgggatcggctcgcgcgcctgaggggcggtgccgggggcggggcttcgccgcgaggccacccccgagccccgggcctagccgcacgggaggcgacacaccctcgccctaccctgagcctggcgcagaccctcgaccgcgacggcgcggtccgcagaaccgcgggcttccctccccggcaaaaagcggcgctgaaggcctgtgggacccccgcccggccgccctacgtgcgtcagcgccttcgggggtcgcgcgggcttggtcctttcggctgtctcggcctttttgtttccccctcaggtctctccacgctgcacttgacaccctcagggcggaatggcgagttctagacccagctctctagacccggggcttcatgggggacacggactcgacgggaaggggaacttggcatttatggacagatcctcatccttcttgctgtagtcaattacacgcacgttaaccgtgcagccgccctgctgtattttaggcggttgttggcactcctagttgggcccttccctggcccctcacagcagggcctgcctcctgtggacgcttgtgtgctgccctggcaccggccactgtgttttgcataaaggagaggctccaaagatgttggccaaaggaatgaagccttgagagtccaggctttctatttctgagacactctactcaaggacttcccagatgcaaagcttcatctttgagcaaatacaaatatggagagggaacattaactttctgaagaaaagaaggaacatcttttcaaccttttatattgagttaacaccatggtcttagttttgtgaaagcactttaatacatccaactagcgggaggaatacaagatattcctacctttttattattattattaaaagagggctaaaccatgttgtaaactacttaagaactgaatgttcaagttgtacagtatattggccagattccttactgcccactaggcttgggagcatgttttcagctcagttttatgaatgttttaaatttgtattactgatctttgttatagccaattagcaattcaaaatggtaatttttttagcagtaataaatataccatcccccaaacagtacaataaactttatttgtaaaaaaaaaaaaattatactcttctaggacttagtctacttactggtacatttaaagaggatatttacaccttggagtcttctaggaggtgtgaaggtgtttttattttaaaatcataacaatctgatgaggttatttttacagataaaggcctttaattctgcagtttcataaaatagctaggtaaccacccacattactcaaaatttgtccagaaatttctatagtttaggattagtattttgtgtagtatttataaatctgtggtccacattttccagtcttagagcagtaccatattcaaaaaatacaggcaagaacctgaaacccaatttcaaaatgacttttaaaaaattctcaggctgggcactgtagctcatgcctgtaatccagtactttgggaggtcaaggagagaggatcatttgactccaggagttcaagaccaacctggccaacatcatgaaacccaatctctacaaaaaatacacaaattagccaggtgtggttgcatgcagctgtagtctcagatactctgaaggctggggtgagaggatcacctgagcccaggaaattgaggctgcagtgagctatgataacatcatggcactccagcctgggtgacagagcaagactctgtctaaaaaaagaaaaaaaaattctcatagctgaacactgtgaaatagacacatagcaaacaatgtctcttaaacactttttctctcatccacttcccttgcacacacagtatttgtttttatgtctctttcaaaacttgccctactcttgtgtgcttcagatgctttgc

SEQ ID NO: 15162 - DNA, 12097 bp, Human
ttatgccacatgaaccaaaaaaaaaaaaaaaaactggcaggaggaggagggtcctaggccattctggaagcaagctgggttttgcattattcagagtcaactattaagctgacttatattagaatggcgacagataagaggcaatgagtgacaccaggacatgcacagcacacagagaatatggtctactcttgtcttccctgcacagattaaacataagaggcttggtagaaagacatggggaaaggtgctatgggggccagcatttggaaagcatatatcccagtgacttgagtatttgctatgcaacctcctggacgagaaactgggaaaaggcacacttccgcccacagttgtggacagcagcagtcacccgtctgaatgctttcattcaatgtgaagatgcagcttgaacaaaagtttctttttgtttgtttgttttctgagatggagtctcgctctgtcacccaggctggagtgcagtggcacgatctcagctcactgcaacctctgcctcctgggttcaggcgattctcctgtctctgcctcccgagtagctgggaatagagggtgagccacaacacccggctaatttttgtatttttagtagagacggggtttcaccatattggccaggctggtcttgaactcctgacctcatgatccgtccgcctcagcctcccaaagtgctgggattacaggtgtgagccaccacgcctggccgaacaaaagttttttaatcttactgatcccatctttccagctgctctgaacagaggggcagggcggggaaaagtcatgtcacagactctgcccacagcagccattctgaggtgccttttcagtctcttatcctcttttgagctttcctcttcttaattttttgttttgttttgttttcattgtactcattaatcccctcctcaatttttaacagaattataaaagcaaagtcaaaaggtccttcaggatgactgggaggcttcctaggctaacttttgcatttgaaaatggaaaaaataaattacttgatatttgtgataagactaagatttcttaaaagtctgcacatcaatatattacctggcttaggagggtgagggcacagtatccatctgcaccctctcctcgtattttttaaaaacaggcaaaatatgtaagaaaaggctggtgcacgttggaagacagagcgtgcctgtctatgccagtgctgctgtgccctgcagcctggcagatggagtcggatgctggggcctcatgcccacttaggccaataacatactcaagactctacagcccgttcaccagcaaagtatgccctgaggggcaacactggctgtggaagtgaagacacacaaagcagggactaaaggcaaatggggcttcacgatgcagcgacatgaagacagaactggtgtgggcgccaaaggcaacctgcagggctcacataaaaggaaaataggacagaaagccacgagttccacaagcagaatcatttctggtcttacatctgagggcatttgtagagaaaagtccaaggcaatgtcccctgggtctgagagaaaaatcctacgcaaaagagggcagacaatgcggtgctcgtcttgagggagcctgaccctgaccctgaccctgacgggctggatgcgagaggggctgagtatggctgtattcagtaaggaaactggtagcagacttttctagaaggtggaaagaaaaagcaaagactttcacagatacaaaaattgttttcaaaacaattacctagaaagttcactgcggttgggtggggaataagtgtaatattttcatttcaaatgagccatggtgctactaatggattataaaagaggatggccagttctggtcttccttcccttcccttaacccccgaaccttcctactcctgacattttccctaccctcactgcaacccacccccatcctggcccaaaattaatttgcccagccactgcaccaaaccagccttgacacacaattgttggttggatttcaattaaacaatgcacctaatgcgttggaagagaaggtggggagggcacaaggatgttggcgtaaacctggaggtgtgtggaccttggacagagcttccgccggccagacccagggcagggtgggcatctgcagtgcagcgcaggccgcaggtaaactgaggtaaggaagaacatggtggctctagctggccctgctttccgagacagtgcagcatgtgtgtgctcttgggtgtgggcaccaaaaaactcattttcttccagttgctgctgccattccaccctctgactagaagaatgctctttacagagtccaaaggatcagccacttggtcttcctctgaggtacaaatccaacagagctttaatcccaaagatccagtggccaccagagtacagaagtcagaatcaaatgctcagaatcaaaaggtgtggcactcctgcccagccggcttatcagcagttgtatagacagatcagaaaaaactagcatttattataaaaactgtttttcaaatggggtgatttcctgtccttctccagagatcataattcttcacgtttctgaggacctaaggaaaaggagaaccacagaaaagaaaacagatgatcttcaaattacaaacaccactgagtgggcatttttcatcactggaacctattctttgtacctccaccttcatcttatctcacttactaaatctttgggatttgtgcttttgtactgtattttgaaagcaaaaactaaattaaagattttttaaaaatggaaactatctgtaaaccccactccaactgaattgttttcacaaatacaatatttactttcagtaaacgttgcatgcatttttttagtcgggatttttcttttatcatttaatagcatctaaacattttctatgtatcagtgtagctcattcttggatgtttaaactgtttttgatgcttctggcttataagtaatagtaaaataaattttttcatgtatacaactttgttttttctgttgaattatttctttcagatatattctcaagagagtaattcttgagggtatataaacgccttacgggcttctaatggcagatgtactgctttgtaacaagggctattccaatacacaaagcttcatcaagctacatccacaacggtttcatcaccgcctcccaaacaaatggcattatcactatgtctgttttcttccatgtagcagatactagtgatagactgctttaatttgattactgtttcctcaaattcatttattatttgtgtttcctcttacttgaacagtgtgtccacattctttgcccatttatctatggaaatcctcagggttttactgatgaatcggaattaattacttttatggttactatataaccttccagctgtgatatttaatatcatagtacagtctgagggatgtataggcaaatcacccaagatccatgttctggatttttttattttgagacagggtcttgcttggtcacaggttctctctctgttacctaggctggagtgcagtcgctcactgcaaccttgacctccaggctcaagcaatcctccgacttcagcctcctgagaggctaggattataggcatgagccactgtgcccagccacttttttagaattagtctaaagcagaataaatcttaaaaatccagagcccatgtacataccaaaacatcactatggactccacaaatatgtacaattattacgtgacaatttaaaaataaatacatttaaaatttttcttaaatctagagcccaacttattaatattttaaaaagtcaatttcgtattctaatgattttttcaagtagctatcattcaagacacacacaacagggaagacattaaagacttaacactaaattaaatacaagcattccatctccatcccaacatgcttgttttaaagaatacttttttcggccaggcgcagtgcctcacgtctgtaatcctagcactttgggaggctgaggcgggcggatcacttgggtcaggagtttgagaccagcctgggcaacatggtgaaaccctgtctctactaaaactacaaaaaataaaaaataaataaaatttaaaaatagctgggtgtggtggtgcatgcctgtaattccagctacttgggaggctgaggcatgagaaacacatgaacctgggaggtggaggctgcagtgagccaagatcatgccactgcactccagcctgggcaacagagtgagactctgtctcaaaaaaaaaaaaaaaaagtttcttcaactacatatttgtgttgatctaaattttttcattcactagtacactgacagatttaatgaaaaaaaaaacaaggaatctaagaagaactctgcaaaaggtttggtttatgtatcacaaaactcatgaacctaaataactataatcacaattaaaataccctttctccccctcaccagaaaaacgagaaaaaaaaaaaaacatagcaattgcactaataaatactgtttagaagaccaacataaaaggaaaatgaaaaatatatactggttgatgttagaatggaaggattaataggagatttttctcttccttttatccattattctattgtctttacaacaagcagaaatcagaaatggaaagaagtactgtcctaaaaccaacggtttgtgcttaccttctcggcttggttcttttgtcttctctttgtacagtgctcccgtttctttctccttctgaaagcggatctgtagctgtttgatctcttggtcgtagtcctgccactccgggacaatccgcacagctgcttccagtttcggctctttggtcatcggattattacactgtgaaaccaaaagaacacacttcagctgagttgaagaaaggccacatgatagagaattcaaaggttcttgggttacaagtcctaactggacaagaaaacaatagtaaggaaccaaatgatatactaccagaagcaatatggtagtgggctatgtaaagctgtatttacatctacaaagaatgtgtgagtggctaatggaaggcaggaaaagtgaaagtccatttggaaaaattacaaggcacagagataaactggaagccaaggagtgactcagcagattgtaagttgtgaaaacagtcccattaagtgctaagggatttggtttcctaatgtaagcagggaaataaaaccagtgaaatattctataagataagaatatttataagaatattctataagaatagccccaacaaactatatacttatgcttactatacaacaaacgatactaattctataagataagaatatttataagaatattctgtaagataagaatagccccgacaaactacacaattacagagaaagtctaaataagaatctaggaaattcttaaatttaagaatctaaataaaaatcattaatcgtgattcactcacacatccagtggatgaacatgcagaagcacaccacatacggcttaccaaatcaatggtttttgcccttttcttagaggcgtcatcacaccacgtttcacaccaaagccattcttgagggagggatttaattggcacctgatgaatcatgttattgggcagatcctgtttggttaaaaaaaaataaaaataaaatacatgtatctaaagttctggcgatatttatttatttatttattgagagatggggtcccactctgtcacccaggttggagtgcagtagtacgatctcggctcactgcagcctccacctcccaggttcaagagattctcctgcctcagcctcctgagtagctgggactacaggggcccgccaccatgcctggccaatttttgtatttttactagagatgcgttttgccatgttgccccaggttggtctcaaactgctgagcttaggcgatccacccaccttagcctcacaaagtgctgagattataggcatgagccactgcacccagccagttcgtgtggagacaaacgtatagaacatcagtgatgtacagctgctcgttacagatcacatgccaatcacaaatgtttaaaatggaaaaggtccttaccaatgccttagagaagttattcaaaactacaaattttagaggatccataaaacatctgcccataataagcaactgaaaagctttggcttaaaacttacaaacagcctgcacctaaccctcccttcattagggcaatcctgagaaaaatactcctactgacttctgaaagtcaactaaatagagtggtggttcgtaaattttgcaggcttctgtcaaggaagttctgaatctaccttgtctattgagacttgctcccaaatagacgacattttttctagccaatgctaccctatgctttaaacctttttcctgtggagtccttctgactttgccacaataaaatgttccattgtcctaagacttacatggaacaaggaaatgtacagaaatgattgactgcgatacttgtaaagaatgttccatgatggtacaaaaataaatagatgatacttctctacaaaaccctgccaacagactaaaatttaaaaatagctgctgaagtgggtagatcgcttgagcccgggagttccaagactggccagggcaacatggcaaaaccccatctctataaaaaatacaaaaaattagctgggcctggtggtgtgagcctgtcgtcccagctgctcaggaggctgaggtgggaggatcgcctgagcctgggagttcgaggctgcagtgagccatgatcgcatcactgcactccagcctgggtgacagagtgagaccttgtctaaaaaaaaaaaaaaaaaaaaaaaggccgggcacggtggctcacacctgcaatcccagcactttgggaggccaaggtgggtggatcacctgaggtcaggagttcaagaccagcctggccaacatggtgaaaccctgtctcaactaaaaatacagaaaaattagctgggtgtggtggcacgcctctgtaatcccacctgctcgggaggctgaggttgcagtgagctgagattacgccactgcactccagcctgggctacaagaacaaagctccatctccaaaaaaaaaaaaaaaagagagaaacaaatactgttgggtgataccatttttgaactcaaattattccccaaaataattctgcaaaaacaacgcctgacacactacagaagataaacaaatatgtgatagacagtatgaacaaaagaataacagaaataatacaacagaatcagatccatagtagctccataaattagaagataccaggtatcacacaaattttaaagtaagtagagccgggcactgtggctcgtgattgtaatcccggcactttgggaggccaaagcgggtggatcacttgaggtcaggagtttgagaccagcctggccaacatggtgaaaccctgtctctactgaaaatacaaaaattagccaggagtggtggtgcgtgcctgtaatcctagttactcaggaggctgaggcaggaggatcacttgaacccgggaggtggaggttgcagtgagtgcaacccagagcatgccactgcactccagcctgggaaacagagtgagattctgtctcaaaacaaacaaacaaacaaaaaagtttaccttttattattccattgagatagaggagaagaaaatgagcaaattaaactagtgtttatggatacatgcttaaacagtaaatctataaagaaacaaaaatgattaccataaaagtcgtgatgctagacacttttgttagggaggaaggatggcttctgggatgctgataatgttctagttcttgaactaggttgtggtatctgggtatttgcttcataataattcctggatgtatgtgaatatgtatgtatgttttttgtatacttttctttatggatgctacatatcacaataaaggtttaaaaacatttaagtagacttaagcaaaataaaatgcttaaaatatgtgaaatatgtatccaaaacccttaaactacaatctcacctctgaaaaatgcttaacattaacaaacagtaatttagctagccttgaaacacatcatggtttctgacatagaaaaaggggaagctgtgatactatactgtgattctatactacgaatcctgagctatttagttcctacagcagaaaaacaaactgaccctagtaggtagagaaacaaacctatgagattagtttgagtacaaaatacaaagatatgctaatggttcagagaggcagcattctccttccatctctctccccagccagcatcaaatctatgacatttttcacgctgatatgtcttgagggcagataaaaatctctctctctctctctctctctcacacacacacacacacacacacacacaccatgaaaaaacaagacgccatcctgtgaggagaggactgaagacacaagtaatacttcattttctgatgcaacactgtatacccgtcactcacagttaaccataaaaaatggacacttacttgatcaagatttgaaaggctgttagggtcctgactcagaccttggtactgtcccctgagtctgtcaccagcagctattttcctaaacttcttcagatccacaacatatagtgcactgaataaagaagacccgcttgttacaaccaaccatggattacgacaggaaaactaaacccaatgaataatggaacaggccactagccaaatattctggcttttctttgaaaaggtatgctacagccctacagtggagttaaagtgtgctactttaaagatctctaagaaagtcactgcaaaatctatactgtgctatgcttttgttactgttctgtatttgccatccgaaagaaataatctcagaccaaagatttctagcatatgcggcagtaacaaaagccatagtaactgataaacaaccattattcaatgatatcctgatgatgtcttcaatgttacaggggggggaaaaccccagagtgttacagtccttacagttcttttggaccaggaatgtaaagaatgaagccaccatcactaaaccccagcagtgatctctgcatgtgccgcttcctacacgttcctcttccctgcacatcttcaaatcacacttctcgcagagaagagaatggggtgctcattagaaatgtaacaacacacacactgttcgacctaaaaggtctacgtctaggaatttatctcacaaatatatgagatatgaaaaattatttagtagattattcattgcaacattgtaggtcacagggaaaactataaataacactcacacactggaataatatgcagctatgaaaaggaatcaggtctctctctattcactgagaagatgtatatgacattaagtaaaaaaaaaaaaaaaaaagccaagttacaaaatgtataaataggtagcatattttgtgtaaaaaaaaaaagaatacacattcacagctgtttctgtaagaattaagaaaatctggaaggatagacagtcaataagttgggaggttatctgctgtgagaacaggaactgagtaggaaagagagagacaggattaggaagttttttttacactgtattttttttttttttttgagatggaatctcactctgtcatccaggctggagtgcagcggcgtgatctcagctcactgcaacctccgcctcctgggttcaagcaattctcctgccttagcctcccgagtagctgggattacaggcgcccaccaccatgcccagctaatttttgtatttttagtagagacggggtttcgccatgttggccaggctggtcttgaaatcctgacctcaggtgatccacctgccttggcatcccaaagtgctgggattaaggcatgagccactgcacccagccactgtgtattttttatcatttttatttttcaaccataccaatgtattacctattcacaattttaaccacacaaaatcaattttaaggaaaaccccgtaacagtgttaggagtgcttcttttcagtacctgatatgatactttcgcccggctaaatgactggcccagtaccctgacttccagaacctgtagccgtccatttctcttcggctgtcacagaaaggagtgtaaccataaggagcaccatccaaattgaaatctcttaactctttcagatctgttcgtacaatctggagaatataaaaagtcatttgttaagcaaccatgcagacagctctaatgcggtttccttcagatacagagtggctcgcttaaggcagcatggaaggctgctccgtggttagtggcacaggcactaggggcagatgcactttgattgctccacttattacctggttgactcactaacatgtaagacacttcttagcaaggtgtgtgggagtaggaataaaacaaatttcaactgcttagcctttctgtgcctcagtttcttcatctgtaaaatggagataatgataatgacagtacctatctcacagggttgctgggaggattatgtaagttaacatatggatggacagatgtagaataatgccttgcccatcgtaagtactcaacaaggattaaatgtggctatgttacaatcaggaaggcacacttcaggctaagccagtggaagagaattccaaagaggtgagtgaagtctctgtcccagtgactttcacacacattacatccttccactcaggtggctgacttgggtttccgcccgctcgggctgaagtggaaggctgtgggcagacgtacacttatgctgtttgagtttgtatgctctaaaatcacatgttccctttcactaagtcaaaccctgacggccggaagaatatccggaggttccctactgccaaagccatgtatccacttaagcttcgtctattacccatgacaataactcctatcttttgggcagataattagagatgatggcaagcactgctaaatgttaattttctaatttttagttttcatgttaaatgaattaagtcagatacaaaactgcacacattatgtcatcacaatgatgttaaaaagacagagaaaaagatgtaaaggagataagctaaatgcaaatttaaaaagtgatgacatctatgtgatacatattttcatattttctaaatgtaaaataagcatgtccttttccataagtggaaaaaatagcatttaaaaagaagcaatttgttgcttttaatacaaactgtcaaaacttggcctttaagggcctacctgatcagcatccacaaacaggaacttgtcaacaactagtgggaaaagtacatccaggaagaggatcttgtaaccccagatgatacgctgtttttcagtttgttgatgaagccaccggggccatttgtactgaacaagctcatactggaaattgtattcatttgccatgtaaggtataaactcctatttttagacatgggaacaacaaataatcatttcttctgattaagaaaactgctttcataatgtaagccaaccaccatgatacgggacaaataaaacacatttaccaaaacagtggtcttacaaagaccggccgtgacccactcatgactacatagaagaacagatataaacctttgtcaaatccccatttctttatgacttctggtcaccacatgaaatgacagaatgttcaagagaaggattttagatgtatatccctctgtgtgtgtttttacagcacatgaactttaagtccatttgtctaaacttgatttcagtaaggcatttactgagcttgatgacaagccttcctcgaggccagatctaacccagggaataacactgcaaagccagaactctggacaaatgtgttgtcctttttgaataagtctttcagattctaagtataagcacctttaggcgccagcagtaaagtgcttatcaaggagaatggttattgaatatattaaaagtcacttagtaaattctacaagaaaaaaaaaggatgcaaataaatcaacttagatgacaaatactgactgatataagtaatgcagaaaacattccaagtacgtgttttgttttgcacagaggaagcactacttccatacatcatctaggagtggttcatgctaacaccaat

SEQ ID NO: 15163 - DNA, 6527 bp, Human
ttttcggtgagaatggcaggatgtgctacacgtagattgggttaactatgttggcccctctctgctactcttctgcttaaaacgtttcacaggttctctatggtactaatgcatatttatcagaattctgttggtagcaaggcacaaaaacctaacttaaaaagctttagcttaaaagtatgtttattggttcatgtggctgaaaattccagcgcatgggactggtttcagctggatccaggagttcaaataatactgccaagattttctctgtctcagggtgaggtctgggcaatctttgtgcctggggtgcaagatttcaggcagcaggtcatgcaagtactgactctgctctagcagggccctgagagacagagcccatgtacacaggcttgccttcttaaatttgcactgtaggcatcttgcctgccttaccctggaccctctttttctcttagctttttttttcatgttcctttctttcttgggtgagttcttctcactcggtgcgcagaagctcaccaaagcaccagacatggttctaccacatcaccagactttttccttatcacctctgcctccctaaaactctttttccatttatttcaggaaagaatgaccccaagacttgggctcattggctcttattagccccacttgagtgtggaagagtcactcaatagaatgtgctccccaaactgtttccttttcctcccgagcacacagctaagcacattccccaggttcctcgcatctaggtctggtcatgtgcacagtgccaggtagggaaatgtaagtaaaaataaagaccatctcctccagacctggacccactccacattcacttcttcactcattgtctgggcatagaacattcagcaggtgacagcgccattagttgaaatgagcctagatccctgagtcaccacttggaggaagccatactgaagaaccacctgatcaggagcgtgcacaatgttttgtttgtttgtttttgtgagggggaaaccagccattgagatttagagactgttacaacagctagtgttactcattctctgtaatccattgagtgtttgcctcttgttgaacccattagtagtatcaaaaatgatgggatgttctgagcagccagccattggtcatgtgctcatctttggagccctgagttaggtagagccctatccccaaccataaaaaagttagagcagaagtaattcccccaaagaaaaccaagatgccattactagaataagggggagaagatgcagcacagacaacaaacgtgacgtgcacaacagccccacacgtccctctcaggctggcctctaatgcagtgcttgaggaacacccagcattttgaggtccttttcaagccatatccctgctctcattcttgctcttcctctccatcttccctcttgctcaccttctcagcccccactctcttaccctccattcaccttctggaaattctgctgatttttaaaacgcggcttggatatcccttccttcctgacgtttcttcacattcaagctaagttttatgttcttctctttctctcatggggccctgtgatttctctttctttgtctttacttcattatttagaaattattaactgtgaaactctcaaagccgggataggcctagtcatcattttgtccccaacacctagcacagtgcttccatctggttgaaatgttcagatgaataaagaaaggaatatagtccaatcatcaaaccgtgggctaaattcatctttgcagtggctatccacaggatagctaaatccacatttccactcctatcattaaggaagtaagaaattttataatcaaaaacaatcagttacatgcatgtttctgaaaccatatgtctattttgcaactcttattgtgttagtaaatctaagggctaacttttgagtaagataaggtcttattaatttatttttttaatctaaaatagatttattgcatttcacgcagtttgaaggccatggaaaggggactagcacagtttttaatgcatttaaaaaataaaagggaggagggcagcaaacacataaagtcctagtgtcctgggtccctgggagaaaagagtgtggcaatgaacccacccactctccatggggaataaatctgtctcttaaatgcaaggaatatttccatggcctctggatgcaaatacacagagctttggggtaagagcaagggatggggagaggaccactagtgaaaacgcagctacacatattgacctaattcaatctgagggtagaacaacatggcaaatcttgggggcagcagctgttccaagggtcaagaaatatcgtacacccacggggagatttgcttctaaaaagaagtggcggtgagaaacaaaacaaaacaaaacaaacaaaaggagaaatatttcttcagccacactcttcaagaaaatgccacaaatatgtgatttaatattttaatttcatagcattggacacacagctcaacatattgaaatattgattccttggagaaaaaaggaaacaaaaaatattgcatctttctgttggagaatctcggcccccaggcatgaggcctagtgcgccattgtcctagcctgcaggaggagctgaggtcggccgggtcctctggggaagaaggctgtgttcatgacctggggctgtacggcaaaaattgtgttgagtgtcctcggccttgccagctccggccctcagccgccagtcacccggggggcctgcccatcagagggctggttgactgactggaaaaacatgggctgggcaggtcctggcccgcaggtatggatacttgctggatctggtagagctgctgtccatctgtgaactggctgaactactgctgtctttgctggacctctgtctgtgtaatcggttgagcgctggtggcaagtgtctggatctgtccctgcagaacgtgggtgcctgatacagactgggctaagcggatacactgcagctggccagccttcagctgcaccgggatctgctggatctctcctgtgttagtgaggatctgctacatcacctgcacggtccatccagtaccactctgggcctactgggcttgaccctgtggctgggcctggacaatctgcacctgctgaccttctccaacctgcgtcgtcacgggcgtggtctggccctgctgaagctgtgcgatgatgatctgcccaggctgcatggtggtcatggagctggcggtggtctggccttgctgctgtccctggacttggacgggcggtgggctgctgagccagcgtgaaatagtattggactggctcagcaggagttacagactgcagcacctcctcctgacactttggaggtttcagttcatctcttagaacaatatcgatgagaaaatccaattgatcaaatttcgtaattgccatggcgacataagtccggcagttgttatcctctgtgtgaatccaggctcgaagagtcaactctgtgataaaaaatctgggctgccctggcaaagagcacaggggcctctgcactgatcatcttcacatcttcatccagtttcataatcttcttaatacgagccagtgggagttcctgcattcagaaatctttcactgctaaattccagatttcttccatgacccgaagccagaaggactttaggctttgctgggcatcactgcggctagtaccaccaaatcctccttctgtggacatttcgacaaacgcctcttcagggagtccaggaagagcaggagccgccctggcgctcctgcggagtcgggcactgcataggctcaggcaccgcggaggtgaggggggaagcgggagtctcggagaacgcagcacgcgcgaagctggcgcataaacgagatggcggccacgccgtttgcacggtctccccttttcccctccccctcccctggcgccccgactcctataattaatttcatgtaagaggtattctgagagcgtagttatatcaaaaacttacctgcgttatttgcgtgtgtgtgtgaaaaatgaagataaagagcatatttaaaagtaaaatctactttgtgggaatagaatttacttttcacttttatttttccttcccttttccaatgtttgggatccgcagaggatgagtgctcaacgtacagcagagaggaggataaagctgtaagcagtgtctcagatttgattgtgatctctctcttaaataatgtcctcattgtctgattgagacagaaactccccacctccctattaaaaattttttttataaaccctgacccagaggtttctgaagcctccattgataacacacaatggcctgttcttctaggatgtttcatggcctttaaggaaggctctgttcgcccgcatgatgaaagggtgagagatgagcaaggagaagccgaggttcacccgcctcgccctggctaggcagaggactgtgggcaagtgcaggaatccataaaggacgagctgggccgagggaagccacgtttgtatctcaaggacaagaaataggcaaaccttcacaggaaatatttcccggcacctttcagcttagaggacagaggaaagaggaggcaagaaggaaaagggaaataaagtcacagaagggggaggaaagggagggaacctaagcaagcaccaccatgagccagagccagtgttcaaggtggctttgccccttttctcgtcgtgggctttccgatgccagtcctctccgccctggcctttggctgaggccatttttcaatggtctagaggtgaagtatcccaagcggatgtgtcgtgctgagctgtatttgcactctctgtcagcttggcctagtgcccacccattgtgaaggccctcactctaatccctgagcctgtgaatgtgtcaccttacatggcacagcggactttaccgatgtgagtaaacttacagtctttcagattagactgggctcatctggattatccagatgagatacaacgtcactggctttgaaactggagggagggaccacaagccaatgggggaatgtgggctgcctctaggggctggaaaaggtcatggattcttcccgcattggacttcagaaaggaaagtagccccgctgaaacctcgattttagcccagtgagacctatgtcagacttctgaccgacagaactataaaataataaatttgtattattttaagccactaaatttatggtcatttgtggcagctatggaaagctgatatattcattaacagatcttcagaagagctagaggccagaggccaaaaaacacttcatagtctgcttggcagctaatagcaggaaacaagcattaaattgtgtgtcctgtgcttctctgcactagtcccactctgcttagttataaagggctgtaatgagaggagggagctgaaaaagaactgaaagtatttaccgacgtggagaggaaggagatgacaaaggtcagcataaatggggctgtctcccatcttttagggcaagtaaaaggctggtgagccatagagttgtgaaaattatattttaaaatcaaagttgggaaagatttcaaagttggattacttttttcaagctctgggattgtaaatatattaaggtgataaaataaaatggtgcatgtgagatctctttgaaaactgtaaaatataagatgtagtgggctagatagttgtctccaaaagagtaagtccgggtcctaattcctagaacatctaaatggacctcatttggaaaaaggggctttgccaaggtgatcacattaaagatcatgagaaaaggtattctgaattacccctaaatgcaatcacatatattttcccaagacagccacagataggagaagaggaggaagcaatgtggccacagaggcagagactggagtgatggagccaaaagccaaggaatgttggcagctgccatatgttgaaggagtcacaatctttcctcataatctggaggaagtggcaccctgccagcaccttgatttcagacttctggcctccagaactgtgggaggatacctttctgttattttaaggcacacaatttgtggaaattaggtatggcagccctagaaaactcatatatgtaaggttaggagctaagctagaaaataaaagtactactagaaatggcaatatattcatttatgagtgttattaagtggtccactgacaatcccatgttgtagtaggatgatgtgattagcatgtgagcccctaatcagagttcaagttcatgattaggtggtgagatccttgaggatcctgtcatcccatagtgctgggtgccaaataggtgcccaatagatattttctggtttgcatatcataacaaggagtaattcctccaaacaggagctcatcaagaatgtggaaaagtagaactgctcccatcaggaatcgtggccctgtggaaccccagctcactctttctcttgggagctactgaattctcaggaaaagcctataccaagtccagcaacttcagggccatctgtgacactctgtggacc

SEQ ID NO: 15164 - DNA, 11254 bp, Human
atctttgacaaacctgacaaaaataagcaatggggaaaggattccctacttaataaatggtgttgggaaaactggcagcatggaatactatgcagccataaaaaaggatgagttcctgtcctttgcagggacatggatgaagctggaaaccatcattctcagcagactaacacaagaacagaaaactaaacaccgcatgttctcactcataagtgggagttgaacaatgagaacacatggacacagggaggggaacatcacacaccagtggggggctaggggagggataccattaggagaaatatctaatgtagatcacgggttgatgggcgcagcacaccaccatggcacgtgtatacctatgtaacaaacctgcacattctgtacatgtaccccagaacttaaattaaaaaaaaaaagatattcgtcaaatcagtagttaatggggactgatgtcaatgtatagctttacctccaactaagaggaggttgtgaagatacaggaaaatagtaatgagagacataaagatacttgctatgtggcaataaaaactgtacttttattaaaaagtaaaatctactgtggaataattttagatttacagaaaagtcaaaaggatatagagttcctttactctcttcagccaggtacctctaacgtagtatagccatggtacattggtcaaaaccaaaaaattaacaatgatgtggtactattaactagacttagagttctgcagattctcagtaatgccctttttctatgaaggatgcaatcggagatatcacattaagttcagtcatcatgcctccttagcctcctctgctctgtgataattattcagtctctttctgtgacagtgacactttaaaaaatcctctcagaaattttgtggaatgtccctgaatttgcgtttgatgttttgtcataattagactatgtgtttttaagaaaatcagggagctttgagatgtacacttctcaaagtatcatatcagataatacatgttatatcaacatgacttttcactggtgatgttaaccttgattacttggttaaagtagtgcttgccagatttcaacaatgtaaagttattttcttctctgtctgtactctattccttgaaagcaagtcattaagtctaactcatccttccaggggaggagaactaagctcatgcatcagagggcatagtagctaccaatattatttgggattcttctataggaaagatgtgctccttctcccccatttatttttcaaccattttatttatattagtatggattcatggatatttactttattctttgtgctgtaatctaatgctatcatcacttatttagttgctcaaattattccagttttggctactggcagctaagtgattttatataaatcactgaatcctccagcaatccagtgaggcaggtactgttagccttagtttacagaaaaggcatcttaggctaagagaaagtaagaaaccttctcaatgacatcttatttgtggcaaagccaggatttatacctagtagtctgactccagagtctgtgtgtttagtttggctatgctatgctgctctctcagggaaagaattgcttcacaaatgtcaatcagaggtaaggcattgaatcacttcttcttagacagtatgtacagaaagagccacaaatggtcaaaactaagcctgctgccaggtgggaggaggaaagagtggttaacaaaggaaagaaaagggataataggagcttacaggacaactaatgtcatggaagggaagaaaaaagttcattgaaagtgtaatcagtttggttgcagggccatagaaaatgagcctatggtaagaagtttagtgaaccgcaacactgcaatataatggaaggatggaaaacaaaaccagatctcaggagatcaaaactgttgttacaaaggaagaaggtaaagaagtaatttaatagagaagaaagtgcaggttcaagtaatttttttccaggatggaggaggacctattcacaggaaatcctacagagaaggagagcctctcagaaagcaggtgtcgaagctgtgtgcatgagaacgagagaggacgggggctaaccctggagttcaggaaactctcctcctcacatactggaggtaagtccaaggatagaggaattgctgaggtgaaggtacaaacttaggatgatatccttgattttattagtaaaaacggaagcaaggtcatctgcagacagtgaaagaaatgagagatgtcatccagccctgtcagtggccaacatccctgggtcggtgtttggtagagctggtgaaattggacaagctagagtcattcatggtgacagaaatcacctaagcgcaagcagagatgcactcaggttatcaggatttttacttgatttttttcagatcaaatagttaaaactaaatattttatgtaattcttaaagactcaggattagtctaaaatgttcagaattaagtatgatgctaacttatgatatgctagttgagaaaaatgcctaattgtaaagaacaaatataaaactaatagaaaaataactgtcacaagaatgaaaacattttctcaggaattcttcttcaatcaattctaattgcagggttttccatgaatgttcaacagttatgaatttaaggccaaaggcttctgtatcatttatacttattaaacagaaatactaagtttgggcaatggtttttctaaactaagcacaaaatacagctaacaagggttatttcgaatttcttcagaaatattcttaaaatattaaaataggattttggattttaatctaagacacactactacactgataacacagggctttaaaaaagttcatttcagaagcattttaatttatgaagctactgagagtgttttttatatccagataaaggtcagacattggggggcaaaattgtataagaagtttatgaattactgacttaacatatccctaagtattgtagattgccctcatctaacatagttataatactacagaataaataatttcctttacgtggaccagaaagaatttacattaaaacatattattcatatttgttattttattatatattattgtatacaactttgataatgaggatattataaatcatactttaagcaaaaatctatgcatgatatatgtaagcagtaacattttgaagaaaaaagccatgaaagcatttacctaaaatttagtaacatcgaaaaacactagtttgtgcatagtaatgttgaaagcttcataatacactagaatactggtaagtcttcaggtattgtaagaaaaacctggtacaggaaaagactaaattagacacatccatatccttagatgtgcacatcatctagaaataaatcccacaatgtagcagtgcactaagtatcctttgtttggcacttaacaatacagacaaacgtgtatttggtttaacgtgattttattattcttagatacattttagttattttatatagataaaaatatacaatattgcttttcaaacttttaattttataactgtataactgattgtcatcatattcatgattaaaaagcctattttccactaaacaatttatccagtaacatgtggaagagagtaacaaaaatggtttatgtaagacttataataaaaggtttaaatgtaaaaatagagtattaatctagacctctggtctaaatccttagatacctcatgctggaaacaaattatgaaatgtttcagacaaattttttccaacacttaaattgattctacaggtttaaagttttgactgaaaatacacagaactcagagatattttgtccgaagccatttttatatacattaacttactaaaaaaagtaaaagaaataaaaattgtattttttttttttttggagacggagtctcggtctattgccaggctggagtgcagtggggcgatcttggctctgcaacctccgattcccaggttcaggctattctcctgcctcagcctcctgagtagctaggactacaggctcacgccaccatgcccagctaatttctgtatttttagtagagacagggtttcaccatgttggtcaggatggtctccatctcttgacctcgtgatccaccctcctcgccctccccaagtgctgggattacaggcgtgagccactgcacccggccaaaaattgtattttaatacatctcagtttgggattccatcagattttcaaataatacatgcaaaatgtgtctaagctcttcagctctcatatctaaagaaaagaagagctgaatgcagtggctcacgcctgtaatcccagcactttgggaggccaaggtgggaggctcacctgaggtcaggagtttgagaccagtctggccaacatggtgaaacccgtttctactaaaaatacaaaaattagctgggcatggtggcacatgcctgtaatcccagcaactcgggaggctgaggcaagagaatcacttgaacccaggaggtagaggttgcagtgagccaagattgtgccactgcactccagtttgggcggcagagtaagactctctctcaaaaaaaaaaaaaaaaaagaataaaagatggtgtcattttttcttttaaaccatgttaggacagtaaagttggtagggtgattaatttgcctattggtaatgaagatcagtatatcattaaaaaaacctaaagtttgaaggtaaacgaactatgtggttgtctttttattaataccaactttaagcagttggattcattacttgatttcttagaaagacacattgataaagtatgtaaagccccaacaaattaagtgcatatataaggtatggactttttaaaatgaaaaactgcaaatatcttacaaataattttgttcattatatctatacaatgcaccattcaattcactcattacaatactttgcaccaaaccttgctatctgcaatcttaacactcctcaaatatgagaaaaacacatagtttccactgttctaagaagcgaaatttataaagtcaacacaatatattatcaaggattataggtctaaaacagtttttaaagacaatttatacacattgaaatgggtgctttgcttaattaaaaagctagaaataaagcttcttgcaatttaataaacaaggttgcagttaacagcagatttttcacattgcaacattcaactatcatcatggagatatcaataaaggtaaagagtggtatatttatttcttctgaaaacactgttgaggaatttaagtgctattgtcttaatatttttataataattaagaaataatttggaaagacattttacttttaaattttttcaacataaggcacatagcaacatttatagtctagaaacaactaaattatgtaataaataattattttttcgatcattatttgccctttacctgaagaaagtaggtaagcagtggagttaaaatatgcctgaattaatgaaaatggttggatttaggaaacacaaataatatttgtgtgcagaaagatattaatttaaaaaagaaaaagaatactttatataaaatatacatcctagagtgttataggtagaaaaaaatgtgaggcacttagatgaaacagtgaaggaggaaagcactgagattatctttttataaaaagcaccaaaccatttattttaacatctgagataaaagcagaggttaacatgataggaaaaactagtttagttctctaactttgtatttggggaactaataagaatccagtagctcaaaactcaaagtattttatttttactgtgacagaaataattcaaatagagaatattttctaatttaaaagaatcttagtttccctgataaagttttgtatattttgtggtgcccagaataatgtgaaatgtagacggtacctcaccactccgtggcagcaccctttctatcttgactgtagtatatgtaattttgataccatttttaaactcccttttctaaaagcaaaaattaaaatttggtttggaataattgtgaatagcatgcatcaatgcctccatgtgaacttgctgacgtccaacagtgacagttttatttttccataatccttcacaaactaatttaatccaaaaaccagggtcaaaattgggcttggaattacaggaatccactggatgtcaaatcaggaaaaggtctggcttctgacggatgatgaagtggctgaagatgtgtggtagtctgagtgttatttatgttatttaattcagctggatatgtttcatttaaaactccattctgaaactgaaaacaaaaatggtgatgcaacttattggaatagatcttccaagtatcttaagccagtaaataacattaacatgtatttttaaaatcttacccctgagagttgtaaacttcaagttcctttactgttgctaaattttaaatctttcacacagtgaagacatactgaggacatattatgtattagttgcatttataacctgtttttccattaatttgacaggaaattttgaacatggtacagatgagtgatgcagctgtctcatttcagattgcctttgggtcaggtaggaattgatgggtcaaacagcacaagtcacaaattacagttaaatattctctatcataagtaggtttgctttgaccaggtttgaagttataggtatcaatgaattgattatattcaggaatcttacactggaatgcaaaacttttccaaaaaaggcagcttctgattttctaaatgtttctaaatattcctaaaatattacaccacaggtatgattttcttaaccgatttcttattcataatatacttttaattaatgaatactactgaaagcatagttctaattacagaatcaagttaccaaaagaaaatgctctgtcttgttttcttacactgcaatgaatctggtttctataactgctagtagaaaaaagaaaaataaaaaggaaggacatgaagatgtatagctctgtagagttttatagattacagagcctttatattttagttagtggacgttctggaaactttaaaacagattaaaatcatatccttaattgcttcaaataaaatctacctttgtaaagcctacataactggcttcagtaatcaaaatgttaattacttcacagatcctccaaaacatatataaaatctatagtaaaaatcatataacctgtatcttcaatgaatggcaacactgtaaattctttaaataaaaagttagtattacctggccagataatggtgagtttaaaatgattttttctcattactcataacacaattcatgtcaccattctctttaaacatactgtacacagcagtgtaatccaatagaaatataatgtgagccacatacagaacttaaatttttggctacagtagattaaataaaatacatttctaaagttaattttacctgtttctttttacttttgtaatgcggctactgaaaaaactaatcatttcaacatgaaatcaataataaaagatgagatattttacattcttttttcaagccaagtcttcaaaatccaaaaatccaatgtgtacttcacacagcacatctcaatttggactagccacatttcaagtgctgaacagctactcagtggctcaatattgagtgtcttagctcaataacatgtactctggaacatatgtaggtctatagaattatttggttatttacaaagaagcagtgaaaagtagtgaggggaaaacactgcaaagaacttatgtggtactcatgcaactccttattcaaaatgtaattttacagaattaacttctgtacaatttgctttactcaagagtaaaatatactttcatagcaattttgtgagacggactataactgaatattattcaattttaatataattgaaggatgtaaggaataagaaaaattttcactgtccttttctattaaaaagctcatatacgattagacaagcaaaatgtatgaaaaagccagaaaatacaattaaagataaagcttcaggtcatacttttaattattatactctaatacagagtaaacaggggtcaaggagcttaattttagtcaagatattctttaaaactaaacttaaatatactttaaaatgaactaaatattttctaatggaaaaagcataaatgcaaacatgatgtattcctgagtggccagagacagcagttactgacattatgttaactttttttttttaagtgatcatttttagatttaaagtgtgctcactgccagacggattctgatgacacatttaaacaacaaaaatgcactatcaagcttgatttccatgacagaaagccagctgagttacctcttttaagaaagccagaaaagaaagccattctaccttaaaggatgagatgaggataggggaggtaatgtggaggaatagctagagaacatggaggtgcctaggactgaattccagggatataattaatctagggtttcagaggcattgtaagaaagcacacttaaatttgagtttaactcaatttcaaacatatataaaaaaatagagctttgaagaaattattcttaaaaattgcaatacgttttttaaagcttgaatttttaaatagccatataatttttaaagaatccagaaagaataaaccaaattatctattttaaacaaaatacttctaaaaactaatttcacctggtaatttaggtcatcttatattaaggacacattcatgttgcttcattccttgatatctttctccctcatgaatcaggtgaatgatatattagtaacatactggaaaaagtacaggcttgtaaaaaaaaaaaaggtagtcacagatataataaaaaatgctgtctccatgaatgctgtagataaccgattaaaatcagctgacataaaaaatgtgtaacatgtctataaggtaaaaagaatcactgaaagatttaattcagtttgataacacccttaccttgtttaaaaatgcctgttggcctggcagtactggattgtactgcatctgacccacgtgggtgtgctgaggttctggctggcactgatacatcgacacggccccagcataacatgtctgaggagttattatggctgactgtggatttaatccatgcttttggttttcaggaagttgtaaacaagtgacaaaatcttctaaactagaagtagtggggtatggggatggttcaaaactccccatagggtagtccagctctgtacatttggaatgttgtggtaatacaggctgattacaggaaataaagttctgtgtataaggcatagaatccatttcagatttgtaggggaactcttgactgatcccatgtaagtctgtaaagacattatattgttgtgggtcttgctgtggacaattgaaaggcacgaattggttagagttccaattttcaaacatgccattaacttgcatgtgcttcatcttctgacacagctgttgctgtggctccactactacttgcttttggtgatgttgctgttgctgttctagatgtaggtgttcctgtaccatacagcttgagttcagagccaaggactgttgctgttgataatctgaaggtatgaagggagacttacttaaagaatcttggacatacgtcaggatttcatccgttaagtcaatgtctctgaagtcaacctcaccagaaaaatcatttctgaaaaatttttcattctgcatgtgtctgatgtcttcaaaatcaatgcctaggtttttcattatgctgtacaagtcactgtttttactatcttgaaagagccctgggtgacctccagcaaatgagttcacatcctgaggctggtcaatttgctcatgtttcaggatagtatcatttcccatcggtgcagtattatcttgccaatttctgcattcattcatagattcgttgaaaaagttgttttcaaaaggtgcagtacttgaagtacttgaagcaggatagagataaatagactcatcttgttgcatcatggcagccaggagggaactaggattgagagagtccttgcttagagtggatgtggtagcagagtcttttccactagtgccatttttagtccttagtggtaagggatccattatggcaggaaaagggttggttgcctcatacaacacagcttctccagtggtaaacataaaaggcaacttcgtatttcgttttcgtaaatgctctgttccttcctcatctctaaaattgtgtacaaaaaagtcttagaaaaaaattctatcaaacattttaaaataaaaataatttaaaaaagaaaaacataaagcaaaatacattgtaattgaattcagaaagggacatattttattttcacctcaattattctcatgactggtgctataaaattgtttttcagacaagcatatttaaatgatttaatttttaaaaaataacttagttaattccatggtcaggttacatccctacctgacaccctgcaaaaaaagaaaaaaataataaatttgtgtggaataaatatctacacataaaaacagactacgagaatttaggggccaggcatggtggtgcatgcctgtaattgcagcactttgggaggctgatgtgtgtgaattgcttgagcccaggattttgagacaaacctgggcaacatggcaagaccctcacctctacaaaaaaataaaaactagctgggcatggtggcacatgcctacagtcttcagctactctggagtctgaggcaggaggactgcctgagcctggaggttaaggcttcagtgagccacatttgtgccactgcattccagcataggtgacagagtaagatcctgtctcaaaaataataataataaaaaaataaaaaaattaggaattagaaagttaagaatctgaaacaactaacctctataataaaacccagcagctataaagacaaagattggcataataatatgaaaattacttaatattaaagtatttgtatttttgcaatagatttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctacaacgcccggctaattttttgtatttttagtagagacggggtttcaccgtgttagccaggatggtctcgatctcctgacctcgt

SEQ ID NO: 15165 - DNA, 70947 bp, Human
accatgaaataagaatactaatggtcaaagccttatgatcagaatgtaatcaatctgtgaagctcaaaagttcagttaactgtgtctgaagtggagatgccaaagataagctctattttatcagttgttatcatgcgtatacgaaaaatgaaacataaaagctctatctcctgaactcttccaatcctttcttactgattcatgacccccacttgcttttcttatttggacattccacccttcccctagtgctccgtgctccttactcaggttaaagaaactaagcctgggctaaagagcacttgaaaataaagaagtgcaaagatgtaaccaaaaattgctaaagaccatgttttccttacaacatttctgactgtggttctctacaggaagaaccagaccactgccatttgcagaaacatttgcaaacacttgtcctgatgaaggcatcgacttactggaggatttcctacgccttctaggaacagatgtcatgcccctttgtcaccaagaacagggcagtaccagtcacaggagtcactcactgaaggtggaccaaatgcactgtgaccccagcatggaagcccttccaaaagttcccattttttcttacaagacaaactgacgccttcctcaagaccctctcctctctgcctcctcatccacctctccagcgtggtactcaaaacacacccttcttgagttacccttcccacaggcctgagatgttctgcgtgctgcctggttaatgcctccctgacacccctgtctgggtcatctttctttctaacacactttcacggaccacactccttcagaactcttgcctggtttttaattattcactcattagtatcacaattggattaatactgcattccctcaatagactacgctccatgagaccagagccgtgtctgctgtgtttctgcaggatgtacagccctcccagcacggtgctcgcttccctaatgccattccacagtatttgttgcagagaaggaagcagcatgccaggacagatggagacaggactaatttggcttgaggtatgtaattttgaacttgagcctctctctgggactgtaaaactccaaatcaaagtcttaatctgagaatacatacatctgaaagagtgattagggactggtaaacatctattaatattcaactctgatacaaagtacaagttgtttattcttaccacgcaaggccaaaaaaggggagaaaaaaaaaaaagcacacagcatatgcactgggaaagctttcgcttattcaaaacagtatttgtcaagcacctccaggtctgggtgctgcaggggaaacaaagattaaacagccagggctttgcttccaaggtgcttacggtcttaagaaggagacaagacatgtttataaatagccaaaatgcaacccagaaaaggctaaaaaacactgagagggagggagaaataaacgaagcaagaggtctccggaggaagagatgaatgaattagcctattaataactcctcactgtaatcccaatgtaaagcaaggaattccaaaccaggaaaggtcaaactgaagtatttgaggaacacaggcgtcgccctaagcccttcacaggctcgctggggataatatcgcagctgaaaccgaacatcaagctggcttttcaaaccttcagttatttacattagactgagaggggaaaagcgctaagagtgcaagagcagagaaagagcaagaggaaacttgaaaaggcggatcacgccaatgcgctgtgcacagcgcccccgcgccccgcgcacccgctaccccacccgagcccccagcggcccgcgtcccccatcccggtcccaagcccagacacctccgagatccgtcccccggctccggccggcgccaccgccaccctcaagacccccgcagcccaggcccggccccgcgccaccgacgccccccgcggcccgacccgcgcgccccgccagcccgggcctcgtaccgtaggtttcggacatggccgtctgcgacatcttgggagcggcgccgcctctcgccgggtcaccggctgcactcgcccgcggtccgccggcgcgtctcggtggggaaggacctggggcgggggaccggaggagggaggggcccgaccggtccccacggcaaccgccggtctcccagcggctgcggcccagccggactccagctccgcgcaggcgcagggccctccaccctccgtccggccgcgaccgcgaggaggaagaggagatgggctacgcgaggcccggcccaccccgcgttcgcgcgtgcgcacggggaggccggggcggggcgcgtgaggacttcggcgcgcgccggaagcacgtgcgcgggctgggcgctctggcggtgtgcgctgaggtgggcagagcggcaggtgggggcgttgggggctgagtcccgatttccctgagggagggtcgggtagaggcgggcggtgggcaggtttgggggtgacagagggctggggacagtggggtccagttgccggacagaggaggaaggtgcccgcactggggaggaaagcagtccatttgccaaattggcccgtctcagttaagacgttgtcttcggtcatcatctgcggctgtcagccaggaaaaaacttccctgacgctgttacgatggaggccagaacttggttaatgtgtaacaaggaggcagtaggccccaggtgtccagccagaggccgccctgtgaatgggaggcaggttcatttacccgttgggaagctaagctttcactccaaactgccgggccctcttggatggagctgagcgggtgtgggcggaatgacagaagcgcaagatgcccaggtgctaaaaggtcatcgcaagactacaggctgcagcctctccacatcccattttagagggttctggattacggttgagaagtatctcccggccctcagctggggatgtgtttccaaatttaggagtttttttaatttttattttttaacagggtctggcactgtcagcccagcccaaccgattctcctgcctcagcctcctgagtagctggggctaggggctcacacgaccacaccgcgccaatttttaaattttttgtagagatggggtcttgttatgttgcccaggctggtcttgaactcctgagttcaagcatcctccctccttggcctcccaaattgctgggattacaggcatgagtcatctcacctggccttggatagtttggtttcagaagcaaaactgagttagaatccccttctgtgggaaatgtagagataaacatttatgggaaagagaattttggttgaggatttggcccatctgagcttgatcagggccacatagcgcctcatagttcccaaccttgttcacaataggtagtcgaatgctcaaaatatccttggctaagctcccaagtgacctggactgtgtggaaaatgccagtacatacttttgtgtgtgtgtgtgtgagtcagtttggctccatcctccacataaattggcatcagagcttccctcttccccagtggctatttgggtcggtatttttctcttgtctccgatcctaataacaaataaatgcagttttttctaaatcacagagaaggccccatggtgaaaagttgtgacagctgtaattcctaaaactgttttatatatatttcttgttcagtggctcagatcatttgttgctttcttgtttgtctctctgcatgtcgtgtttgatttaggctcctgagtataacagattggttctgattaaaaccatttcagaggaaagacagtgatcccaggaagcgggaagaaaacagcatcacctgaagttattcctattcgttagatttgttttcttcctgcgaaaaactgctatgtacaagaaagaagtcagtgagctgcagtgatagttagcattattgactgaaactggaccagagatccctgaaacctggacaaggtggtagaaatacaaattatgctgccatttcaaagctgtgggcagttttctactttgtggaaaatgaagacttaggtaggcctttgggaaagacgatttgttttggaaaaaccacccaaagggatcatttggtttgcaaatgtaactgcagtatcacaactggaagaagaaatatacaagggcgaggtttgaaggagcccttcagtatccttggatgatactgtggaagattctttgcatctcagtaactttggatctttgaagatccaagaaaataaatttcttcaaaatatttttagagactgctttgattctgaggcactgctgattatatggaagaaaaaaatattggaagattaatttgtggttttctccagttatcgtctcccttctctttgggggaggtttgtgacgcagtaaaaacagatatacaaaagcctaggcatgttagagatttgcctaagggaaatgtaattatgaagaaggattttttcaagctgaaactagatcccacttttttccaggtcagtgggtccttcaagtatctggtactttccttcctgcttcctgacaatgttaaagaatgtggcatgaccttacatttaatgcccaacgtgaggagccctggggcttgatgcatgagattcttggagctaggcctggtggagggcactggtcacagcctcggtggaatggtgactttctttggtaactggaattgaagaaaatgagtggacttgtgtctgagcacttgggaactcagcaatccctgggtgttaccttgagaaggagccaaattccagacatacaagtggagacttgaaaatggaagctcaattccacacccaggctggtggagactatgacatataactcacatcttcaagaaagtagacacctcagaggtcactgggccactttaccttccactgtcaaaactatgtccatgatcagatacctctgttgctagggaatattcagtcagaatgggctagattaactgcagtaatgcagatctctcaacccatttatgacttacgcagcaaagttcctcgctcagactacctgtccactcccacgagcagagacttgctcatgggccctcctagacccaggctgaccgagtgtgttttatctaaatgcatctccacaatcactcaggtaggagtggctatgcattaggactgattgtgcattagttagagaagcacttaccaggaattgctataagaacttctatttacatttcatgggccaaagcaagtcatgtggcaacacttaatttcaaagaggacaggaaatgcaatattgttatgtccctgaaagaaaggagaagagaaagtctatggaaagacattatgactaccactggaattttcacctgtccaggcagctcatcgtgcttttatttgaaacaattttattgaagtataggcataactgcacatacgtatgtatttattttattttattttttgagatgtagtcttgctttgttgcacaggctggaatgcagtggcgtgatctcagctcactatgacctctgcctcccgggttcaagtgattctcctgcctcagacttctgagtagctgggattacagccacgcgccaccacacctggctaatttttgtatttttagtagagacggggtttcgccttgttggctgtgctggtctcaaactcctgacctcaggtaatccgcctgcctcagcctcccaaagtgctgggcagcctcccaaagtgctgggattacaggcgtgagccaccgcacctggcctgcacatatttaaagtgtacattttgacaatttttaatatatatgtacgcttgtgcttgctgctccaggggaccgctatttctaggccttttcagtggacagaggcatttttgtgattgttttatctcatttgtcacttaggaagaataacttcttgtgaggtttagtggtggttttggggttgatagtataggtcttcatcacagtccacctccaagtgataatacactactttatacagagtataagaaactgacaaccatttgcttccatcctcccccagcatctgtgctggggatgttgtacttctacatatgttgtacacccacatacattgttattgtttttacttaataagctactaattctctgtctctcttttccttttaattgtggtaaaatagacataaaatgtagcaactcagccatcttgaaatgtacagtggcattaaatatattcccattgttgtgcaaccatcaccaccatccatctctagaacgcttcatgttgcaaacctgaaactctgtacctgtttaacaacaactccccattcacttctccccacagtgcctggcaaccaccattttacttcctgtctaggaattggcttctctaggtacagtacctcatataaatggagtcatacagtatttgtcttttcctcactgtcgtatttcacttagcataatgtcctcaagattcatctgtaacattgtagaatgtgtcagaatttccttcctgtttaagactgaatactattcaatactttgtacatatatactgcattttcagccaattcttttcaatagatttaaacaataagaaaaaagtgttttatatttactcacatagttaccatatctaagactccttattctcttgtatagattagatttccatggtctcatttcccttttgtctgaagggctttccttgacagatcttgaagtgtagatctcctggtgactaattctttcagcttttatatgtccaaaaaagtctttatttcacttctgtgtttgaagctatttttgctcaatttcgatttttagggttttcaattttttttttctaacatgaagatactgtttcagtgttttctggctcattttgtttccgataaggagtgaactgccattcttatctttatttcttttatgcaacgtgtcttttatctctgcttggttttaagatttcatctgtatcactagtctgaagcaatttgattatgatgtgccttggtgttgattttctttaaagttcttgtccttgagtttcactgaacttctctggtctttgagtttatagttgctatcagatttggagttttttcagccattatttcttcaaatatttttttctgcccctgcctctcctttcctttggcgattctactacacaaatattagatcacttgaatttgtttcacagctaactcaggctttgttcattttttgtcagtcttttttctttctgtttttcattttcgtgtaatttccattgctgtgtctttaaattcactcatctttcctatagtatctaatctgctgtcaattccatccagcgtatttttcgtctcaggcattgccatttcacctgcagaagtttcactcggtgtctggacctgcatctgggtcctctggtttccgtgtttagtgctcaagcatatggaacatgtgtcatttctactaactttatcacctaagtaatttctgagattgtttatattgattggcttttctcttcattgtaggtaatattttcctactttacaagccagataattttttattgaatgccagacattgagaagtttactttgagatacatataatgtttatttttatgaatatttttgagctttgttctggggtgcaggtaagttccttggaaagagcttgatgcttcaggtcatgtttttacactttttttagggggtgggccctgagcagcattctactcaacaaatccttgagttgtgaaggttttcaccatgattggcggaattcggagttcctctgggccgtgcgtgagtgctggggattgttttctctaatattcgctggtgattctttatctggcatggggtaggagtgcctaccacagtaggaatttgaaatgcaggtatttcttcacttgcctgcactgctcagtagaagacttgaagggaaccctctgcaaacctctggcactctctctctctctgtacagctctgcacaacccccagctcagggagtgctgcttcttcctcctgtctgactccagagctcagtctgtggcagtctttctctgcagtcacttacttgctcattcatttcatctggtcttaaggctttcaatatgatctaaagctgatgattccttaatttctagcttgcctaggcttctatgtacaattgcttacttgatacgtccacttgaatgaatgcctattaggtttcttaatactaacgaaataaaaaccaaggccgggcacggtggctcacggctgtaatcccagcactttgggaggccaaggcgggtgaatcacaagatcaggagttcaagaccaggctggacaatatggtgaaaccctgtctctactaaaaaatacaaaaaattagccaggcatggtggcgcgcacatgtagtctcatctactcaggaggccgaggcaggagaatcgctggaacctgggaggcagaggttgcagtgagccgagatcatgccactgcactccagcccgggcgacagagcagattccgtctcaaaataaacaaacaaacaaacaaaccaaacatccagatttcttgaccaaaccagtgccttctgcaatcttttgtatctcagtaaatggcagtttgccaggtgtattagtcagggtcggggttctctagagggacagaactaataggatacatgtatatatgaaagggagtttattgaggagaattgactcacacgatcacaagctaaagtcccatgattggctgtctgcaagctgaggtgcaaggaagccagtggtggatcagtccaagtcccaaaacctcaaaaatagggaagccgacagtgtagccttccatctgtgggcaaaggcccaagaggccctggcaaaccactggtgtaagtctaagagtccgaaagctgaagaactgggaggctgatgttcaagggcaggaagcatccagtacggcagaaagatgaaggccagaagactcagcaagtctgctttattctagccgctctggtagccgattagatggggcccacccagattgagggtgggtcagcctcttccggtccactgactcaaatgttaatctcctttgggaacaccctcacgacacacctaggaacaatactgtgaatccttcaatcaagttgacacttaatattaaacatcacaccagggccaaaccttgggagtcctgcctgacttctcacacccacatttgatccatcagcaagtcctacaggctctactgtcaagagcatccagaatctgcttttgctactcccactgcctcacccccgaatcctggccacctcctggaccagcccgcctcacctctctcctgccttttgcagctacctccccttcctgcttctatgcttgtctccctgtgttgtcttttctcaacacagctgctagagcaatcctattaaaatgtaaacaaacaaaaccaaaaataaatgacaattctcctttaaaacagccagtgttgcctgtaatcctaggactttgggaggccaaggtgggtggatcatttgaggtcaggagttcgagaccagcctggccaacatggtgtaaccccccaacctctactaaaaatacaaaaattagccgggcgtggtgggggcgcctgtagttccagctacctgggaggctaaggcaggagaatcgcttgaacccgggagacagagtttgcagggacccgagatcatgtcactgcactccagcctgtgcgacagagcgagactctatctcaaacaaaacaaaacaaaacagcaacaaaaaaacagccagtgttggggggaggaggggactataggtcccatcaggccaccctctgctcaaagcctcatctcactcacaatggcctataaagtcatccatggtctgctcccccaacccctcattctcttgactctgatcctacaggccttcttgctggttcttatacacatcaagcagcctttggcctcagggcctttgcatgtgcttttttcctcttcctggaatgctcttgtcccagatgtctacatggccctcacagcccacatgtgttctgctcacagggcacctcatgaggagggcttttcttttcttatatgaaatagcaacccctctccatttcatccccccagcacttcatttgccccctattttgttctatgccccactccatagcatttaacatcacttaaaatacatatcctttattagtttattgtgtgctccctctctagattataagttctataagggcaggaaatgctttggccttgttccctgctccatccccatgcctaaaatagtatttggcacatagtaaaccctcaatcactcggaagatgttgaatgagtgaatgaatggaacaaaactcagcagctctctatggatttaatgtaatgaacttaattgtaaatatgttgatttatgggaaatttaaaagtgggggtctctggccgggctctgtgctcagacctataatcccagcactttgggaggccgaggcaggcggatcacttgaggtcaggaatttgagaccagcctggtcaacatagtaaaaccctgtctctattaaaactacaaaaattagctggatgtggtggtgcatgcctgcaatcccagctatttgggaggctgaggcaggagaatcttttgaccccggaggtagaggctgcagtgagccaagaccacaccactgtactccagcctgggtgacagagagagattccatctcaaaaaaaaaaaaaaaatagtggatctcttatatgctaccaagtgattgtgggaaggctataataaaactaaagtatcgtctaatactagtataatttattgagtacttgataaacactaggtatagtgctaagtgctttacatgtattagaaaacctaattcttacaacaggtttataagggaggtattatcccattttacagatgaagaaacaaaggcccaaatggattacatattttgtccagtttccacagctagtatgtatcaatgttggaattgctatctcaaaccaaaccaaactgacacctctccttttaaaaatgcaatataaaaagcccaaaacacagagctatgatttcaaaaggcattgaattatttaatgcctaaggaaaacagcgctctgttgagccaggccctgttctgggtgctttatgtcacttcccttgatccttacaccacctgacaaggttgctcttcttatctttatattatagtcaagggtgacatccaaaccagggctctttattgcactgtgatgccaaataagtatggagacacagatgagaaagggtttgtggtagaaaacattcccagagcacttctataaattcagcataagctcaggttagctttaagatagaaaatagtcctgaagttatcatccagttctctaatatgaaactcaaatctttgagtctgtcatcctccaaagcacagagattttgtttatctaacaggaatatgctgcaaataacagtctacaacattaagccaaggctagagttgtggatagagttcttgagttcagtgatacgataatttcctaccttcatcttctcatttgaaagttaccagcaaatcttccatcagttctaatgtgatgcatctctgcttatttctgcatttaacagcattgatacccagggattattcattcgagtcatttaaattcttgttttgtattcagaaaaagaggattttctggttcctcttttctttttaattatatttatgtgtttcctccatattctgataaaagtaccatagaattatcttttatttacttatttattttcgatactgtgtttcaaattaaatggcctgttttcagcctggtttcttatttaaaagatagttttcacaagaactgcttaaaaaaaaattctccgtggctcacgcctgtaatcccagcactttgagaggccgaggcaggcagatcacgaggtcaggagttcgagaccagcctggctaacatagtgaaaccccgtctctactaaaactacaaaaattagctgggcatggtggcagatgcctatgatcccagctacttgggaggctgaggcaggggaattgcttgaacccaggaggcagaggttgcgatgagccaagattgcgccactgcactccagcctgaggaacagagtgagacaccgtctcaaaaataaaataaaataaaataaaataatccctgaacaccaccaactgaaattttcttttatggttaattttaacattttaatcagctttactggggtataattttacatacaacaaaattcaccaattttaagtgtacaatgagttttgacaaatgtacacggtcatgcgacaacttcaacctcgtcccagtatggaacttttctgtcacccccaagagttcctttatgcctttttccagccctttgtggactcattttgagacgttttggtaacggattattggctttcacatgggaagatgtaacctactccaggaaactaaggtgggggtttccccactgcacagaccacccaccatacgctccacctctagacctctcagcagcctgtctttcttgccctttcaaacatcttcatttgtgttccaccagacagtagccaataccatttccatctatcagcttggtgaaatgtgccctttaatggaagactaatgaggcctaatagaaaaagcttcctggctttattgatgttccctgtgactttacaggagagagagagatttaggtcagagtcattagactttctcttcctttccctgaaattgtgtggactagcagccaggtcagcaggcatgcaatcaaactctggtgtcgcaccatgtcaccttcctggattagatgactggggccgctgtaacaaagtaccacagaccaagtggcttggacaacagaaatttattgtctcacagttctggaggccggaagtccaaggtcaaggtgtcagcagggttgctaccctctgaatgctgagggaaattctgttccaggcctgtctcctggcttctggtgccttactggccatttttggtgttcccagcaagtgttgctcctatctctgctttcattttttgttttaattatttctcttttttgaaatggagtcttgctctgttacccaagctggagtgcagtggcacgatctcagctcactgtgatctccgtctcccgggtttaagtgattctcccgcctcagcctcctgagtagctgggattacaggagcgtaccaccatgccaggctaatttttgtatttttagtagatgtggggtttcaccatgttggccaggctggtctcgaactcctgatctcaggtgatccaccaccccccctccccacccaactcggcctcccaaagtgctgggattacaggcatgagtgctgcgcccggccgaccccaggtatttctaatgcaggtggtcccacatttggagaaatcctgctgggggttgaggaatggttttgttcctaaaggcactgccacttgtggaaaatggaacagagaacagcagagattgaatacagcattaaatgcagtgagtgagaaaatccttatgtctgagcagtgaggacatgttgctcggagatatttctcagttagaaatatctatgggttagaaacatactatgggctaaatgagagctggtagaaaaagggtggttgtcaacttcccctgttctttcccgagtctcactctccctcctgcattctctctcctttctttctttcttttcttttttttttttttttgcgatggagtcttgctctgttgcccaggctggagtgcagtggtgcgatctcggctcactgcaacctctgtctcctggcttcaagcaattctcctacctcagcctcccgagtagctgggattacaggcacccaccaccacgcccagctaatttttgcatttttagtagagacagggtttcaccacgttggccaggctggtctcgaactcctgacctcaggcgatcctcccatctcagcctcccaaagtgctgggattacaggcgtgagccactgcacccggccctctccctcctttcttagggaggagctcgactcagaacttttcctcgatcctctctgttgagatggttgatttcctccttaaaacattatctgttcagtttcttttaaaaatttactccccctgcccccattctgtaggaattgttgggtattggctgggcaaggagtttggagctctctgagctgataatgtaaaatctttgaggggagagacttgagctttctttttttttttttctcctgtagcatctgtcccagtgtcaggcacattttaggtgcccaacaaacatctgtggaatgaatgaatgagtgctggcaccacctataagcacacagtaaggataaccatggagagaatatgccgagccttttaatcagcccagaagagcgccttctgtgttaaggcgaaatgccagaatcccaaggaacagattcaccacccaggggcgggactcagggactgctgatactgaggctgccctgtgggttttccttccagatcccttcttgatttgcccaaaagaatttcacgttttgtttcagttaaggagaggcctttccttactgctgactttaaggaaactggaaattgtgcttgtgggggaagtggctttggaacttggggcctctttgggacctggtaggcaatggggtttgggggcaagtttgtgggacatgtgtctgaacaggaaggaagggaggagcagtggggccagccaggaagcagtgccgaatgcagatttctcttcttgtgcagctttgcttagagttgaacattacttcccagagatagattgaccccaatcctgcagagattggctatcctgctcttcaacttatttttagatatatggtctcacttgaatctcacatccaatgaggagttcctgacccctcaatttagctccacctggcattccagagcaattcaaggacctggtagggctactagcaatccactgctacatataggggaacaatgagttttaaagctgctcagaaatctgtgattcgagtatcaggaaatccttgactctttatcaaatgtgaagttgctgatttaagaaataaagttaagaaacaatattcattaacagaatggaatttaatgcaaccgctggtgttttggggttattttctggtcacatagtgccccctggtgggttcactgacatactcttctggaatgctcctttcccaggctgtgctttgtgacaaggccagcaccagcagggtgattccaagaatttgcagtttaggcacagtccaacgatgctctaaagattgtctgttaagggaaaatatgagttatgaaaatgctgtgggttgtactgtatcccccaccaaaagatacgttaaagtcctaagccccaatacctgtgaatgcagacttatttggaaaaagggtctttgcagatgtaactatgaaactaaggtgaggtcattagggcaagcccttaatccagtatgactgtgttcttataagaggaggagaggctgggtgcagtggctcacacctgtaatcccagcgatttgggaggctgaggcgggaggatcgcttgagcccaggatttgctgggcaacatatcgagaccccatctctactaaaaatttaaaaattagccagacatggtggcacgcagctgtagtctcacctacttggaaggctagtgggaggatggcttgagcccaggagtccgaggctgcagtgagctatgatcatatcaatgcactccagtctgggcaacaagggagaccctgactcaaaaaaacaaaacaaaaacaaaacaaaacaaaacaaaaaaagaggaggagagagacacacaaggagagaatgccatgtgacaatggagacagacactggactgatgcacctgcagaccgaggaatgcgcaaggattgccagcagcccccagaagccaggagcgggacatggaatagagtctctctcaacccctcagaaagttctaatcctgctgatgccttgattttggacttcagcgtccagaactgtgagatgagatatgtttgttgcttaagcctcccggtttatgctgctttgtgatggcagcccaagcagacgaatacagaaagaaatggggatttgagttggaagaactgctttgagtcccagctaccacttagtacctgaatgaccttgggcaaagaagttcaatttttctgagcctcagttttataaactgcaaaatggagaaatacaaaagtaactgttctcctgcctcaggatccctgtgaggatgaagtgtgactatgtgtataaaaatattttgtttattgtacagcactgtgtactgcaatcttattacacaaagaaaggaaggtgggaggtagtagagcggagtgattacaagctaggctctggctgggcacagtggctcatgcctgtaatctcagcactttgggaggctgaggtgggtggatcacctgaggtcaggagtttgacctggccaacatggtgaaatcccatctctactagaaatacaaaaaaaaaaaaaaaaattagccaggtgtggtggtgggtgcctgtaatcctagcttcttgggtggctgaagcagaagaatcacttgaacctgggaggcagagattgcagtgagccaagatcgcgccattgcactccagcctgggcaacagagcgagactccatctcaaaaaaaaaaaaaaaaaagctagactctgaagtcagtttgccagggtctgtgagtggaaatgttacaaagaagcttctcatgaaaacttgactctcaaatgagccaaaggcagtgatgcccagaaatggagttgtggtaacacttaaaggaatgtatcagttgtctattgctctataatgaaccccaaaacttagtagcttcaaatgattagcttattctttcacacggtctccgtggatcaggagtcaagggcaacttaattgggtgcttctcacttggagtctcttgtgagactacagtcacctgaggtttagactggggctggaggacccacttcccagatggctcacccacctggctgtcggcaggaggctgcagttcctctccatgtggtcgtcttcacaggtctggtgagtatttttacaatatggcatctcctcattctttccacctccccttcctgcccacctcaccatgcccaatgtattttttctcttgtcagtgattctcaacctgtatggagtcacaggctcactgtggcctaatgaaaactagggactcttcctgagtaaagtacacatatgcatttacacagaatattctagatagaatttcaaggggctccaaggttaagtaccaattggatccacagagagctctgtcaaacgtgaatcaaattgtgtaattccctgtttgaatccttctgtgacccccactgtccataggataaaaaacttctttagcacaccatgatctgactccaacttacttttaataacaataaccttatcatcacatggaatgtcttctacatggcagacacttttcacactttcttcctaattcttagaagaactctgcaaggagtggattttatgattccattttagagataaggagaagctcagagctgaaatctggccgattcagcacctgcctcatctcccccacacccccaagtgaatggttgagtttaggggagcccggattcttctgactctgaagctggcatccctccaggcctggccaccccgctttctgccccttcttgtctactgccaggcacgctcctttctgttgcttcagaaccactcatcatttccagacatgctgtgggttttgtgtaggaagctttttctaccttaaaggtcctttcttcccatcttgtcctcctcctccaaccttctctaatcattgtgctctgatatcctattccttcttcaagactcagggtgtcatttcttccatgatcttttcctgaactatgactttccagtgctccttcacatattccacggcaaccaccaggctgtgtcataatttctcatgtactcacctatatacttactacccctagactgtttcttgaaggcaaatatcagtcatgcctttctaacctttttataaatctagcttttcataggataggtgttcactgtatatttgttgagtgagtgaatgaatgaatgaatggcattttctgtaagaattccccctagcatgtaaattatccagcttttgaataaatgtagctaggatctagggcttcttgaggcttcagtctttttaggatatctctcatgagcctaggggtggcagtgtgatgccacacctgaaaatactctgccattttcaaagctttaacattttggcacccaaggggagaagccacagagttgatctgtgcctagcttttgtagttaacctgtctcatttgaacaggcagggaaattgacactctgagaatgaaagtatttctacccaaggtcttgtcatttaatgttgtgctgaatagggaccaggagctggatgtcctgagctgcgtgttgagatcttctccctacagacaatgttgaagacttgtaaaggttctacctctttgaaatttttttttttttttaagatggagtctcactctgttgcccaggctggagtgcagtggcactatcttggctcactgcaacttccacctcctgggttcaagccattctcctgcctcagtttccccgaatagctgggattacaggcatatgccaccacgcctggctaatttttgtatttttagtagagacagggtttcaccatgttggctaggctggtcttgaactaacgacctcaggtgatccgcccatctcggcctcccaaagtgctgggattacaagtgtgagccaccacgcctggcctaccttcgaaatcttaaagggcaaagctgacttcaaacagacttcaagcagttgttttggtatggctccattttaataagaaaaaatataaatatgtagatggatacatcgacaaaatggtaaaagaatatgcatcaagtaataactgttatctctgggattagattaaacttatttatttatttatgtatttatttatgtatttattttgagatggcatcttgctctgtcacccaagctagagtgcagtggcacattcttggctcactgcaatctccgcctttggggttcaagagattctcttgcctcagccttccaagtagctgggacgacaggcgtgtgccaccacgcctggttaatttttgtatgtttagtagagagggggtttcaccgtgttggccaggctggtctcgaactcctggccccaagtgcctgcctgggcctcccaaagtgctgggattataggcgtgagccactgcacccagcctctgggattttaaattatttttatttactttttaatgtatgttttaaaatctttctataaggtatataaattacatattcgatttttaaagcttctagttgttaaaagaaaaatgccctgtgcataagataagctatcactgtaatttaattttctgacttttctttctgaacacagataaaatcatgcctattttgcacttaacacaggaagtggtttctagagtagcagaaagtctcagtgacttcgaggtacataattctacctctaaggcagcgtcatcaagattatatttacatgtgtttagttcagtgaagtagttgtctcaggtgcttgtttagatctaacatcttcaaggaatgtcaggaagcctagaggctgaagaaagatgcagaatattttctaaatgtctggcaatgaggaaaatccgtcagtattttccttgtgattaacttgttgatggattttcttttaaagaagtcaagtaaagagaaactatcctaagggagcgggaacaaaggcgggactattctgactcactcacctctgtgttgatggtgccctttggcgtcagtttcaaagtaattcattcacatctgctcggcaagtacacattgcatgctcattaattccaggtgctgttagggttcccggggatgcagcagtaaagaaagcagagttcctgacctcatggagcaatacttgcatgtgggaggagacagatgtggcaaataagtaaatatatagcacatcagcggtgataagtaagtgaaaaaaacgaatggtgaggggggttgggcctgcctggagggcgagagggcgggggaagccatagttctgctttcagtagggtgcctgcaggattcttccataaggagacatttgtacccagaccgaaggggaagggagggagcaaaggttgtggtatctgggggaagagccctccagaagacaaagaccctgagatgggagcatactgatggggcctgcagggacagcagccggggcagggagatcaatggaatggggagtgaaccaggctgtgtagggcagaatatggggtcttgtaggccactgaaagcatttttctatttttaaattctgagtgagacctgatgcgattaagggatagggcacaagacagttactaacaagaggcactaggatgctaaagactcatggagactaggctgtaagggacaaagtccagacgtggggagccattaggggctgttgcccatcctgaaagatgatagaggcttgcgggggatggggagggaggtgacaggaaatggctggattctggatataattgaaggcagaatccactggatttgctgggagatgaagagtggggtttttcctgagcagtggagtagataatggctctataatcagagaaggttttcggcagatgcgtttcagttatctactgctgagtgacaaacaaaccaaccatcctgcacttagtggcatgaaacatcagcaatcatttgatttgctcaccagttgcagcctgggcagggttcgatggggacggctgcaggtgagattagttagggcagctcaaaggttggctggagccatctgaggcttgttactcacacgtctggctgtggatgctggctgtcagctgggccgtcagctgcgatgtcagccagaactcctgcacctcctcgtgttggggttcactccctcatggcatggcggctgggctccaaaagtggcctcccaagaaaacaagatatgaagcaggtgacattttcatgcctttgcctcagaactcccatagtctcatttctgctgtcctttattgcttgaaggagtcacgaagattggtccgagttcaaaggaaggagacacggaccctggccctggatgggagggtgtcgatgtcacattgtagaagaacatgtgggataggaggtattgtgcccatctttggtcaatgtcgtctgccacgtgaaggatgcagaaatcaagatttgtagagcataagctgcttgttaactatcacagagggatgttgagttggcagatggatgtatgagtcaagagaggtcaaggttggggaaatacacgttggaggctttattatacagttgatatttaaagccacctggaatgaggagagacgtggtggtgggaggaggaggaggagaggaaggaggatcaggataagagagagtttattaagcattgcattttttttttttgagatggagtctcgcgttgtcacccaggctggagtgcaatggcgccatcttgccccactgcaacgtccgcctcccaggttcaagcgattctcctgcctcagcctccccagtagctgggattataagcacatgctgccatgcacagctaattttttgtattttagtagagacgaggtttcaccgtgttgcccaagctggtctcgaactcctgagctcaggcaatccacctgcctcagcctcccaaagtgctaggactacagatgtgagccaccgtgcccagccacattgcataatttttattgagtagctctatacttagcctcgtgggaggtactttgcacagcttagagcaagatgaaggcctccctgccccagccccagcccacagtgaagcaggcctcactctgtaccaccatagaactcggctcagtttctgactctgtatttttctcttgctccccgtgcccctggtgctggagcgcttaattagatctaacaaggtctcttttgtccttgtgctttggagtgtcttcaggctttccctggataatgatagccaaaagtattcagagttttagaaaacctaaaacctaaaaccttcaaaagggcaatgttgagaaataaagaaatgaattattccattgttaagcaactcatgtctgagtaagagaaaacttgaatttatggtggttaaagtatatgtgagatattaaaaacaaaagagagagagaaagaaaaaaaacccagaaagccattttttgatcctcaagagatcagatgaagtttctatgtgaagcattgagagatctttattttatgataaggctaaatgccagattgtcaaaaaaagggtcaaatataaacttctttgcataatacgtaaatccattaataatctgaccctttcttttccaatctcctctactagcaacctccagtatattctggttaccctgctccaaaaatgctctaaacatgccatgcctgtgtactacttccccatggtttattctccctctccatttctggccaactcctactcatcctttaaaactcagcttgaatgtcatctcctctacaaagcaggtggttgtagtcacctctattagtgttcccatcttttgtatatacttcctatgattctgatcacattctgcttaatatcttatcacatcctgtcatgtatatgctcatctcctctagcagtcagttttttaagggcagtaaacctgggtgcttttttgttttttgcagtcccagtcccagcagtgctgagcaacagaagagataaacaccacagtttttaggaagttcagttgcataagagatgacagtagaggcccctgcatgtctattgcagacaattacttacgggctcacaaaagaatattctctggttttgcccagtgggatgcactgtcctacaaaggctgaagattttggggaggcaacagacacaccaaacagacttccttttctatatctttcagttgctgacactattaagaaatagagactgggcatggtggctcacacgtgtaatcccaacactttgggaggccgaggtggaggattgcttatgaccaggagtttgagaccagctgggcaacatagtgagaccccatctctaccacatacacacacacacacacacacacacacgcaaattagctgggcgtggtggcaagcccctgtagtcccagctactcaggaggctgaggtgggaggatcacttgagcctgggatgttgaggctgcagtgaatcatgattgcaccatcgcattctagcctgggagacagagcaagaccttgtctcaggaaggaaggaaggaaggaaggggagagagagagagaaagaaagaaagaaggaaagaaaggaagaaagagagaaagagagagaggaaggaaggaaagaaagaaagaaaaggaagtagagaaagaaaggaaggcaggcaggcaggcaggaaggaggaattcccttctgatttggtaggaattagaagattcctctactctatcattgtcattgtaaaacatctctagagtagttgtttgaggcacacaaactcctttccaacatgatattacaatacccagatttctggtgtcaagccacatgtcagtatgaacggtcctgcacagatgacgtgttcaactttcatggttgtctctaccttccattccagcctgctccgcctcctggattttccagaaacctctggcttctcccttcttcctcaggggtgtgtggctctctggtggggaattatcaaccaacatagtgggagatgctgaagcccgagcgatgagcaaagtgaacacagagcactgggaagctgaggtgcagatgcacgaagggaagaagctgggaagaagctggaggaaaggagtgaaggaaataggatgatggagccaaaactgggactagggaggccagacctgggaaagaaggtgggagctgaagtggggatcctgaggatgttaactgaaaaaccacgagatctataagcaactctttaaccgaaaggagagactctgctggtagaagtttacctgttgggggtgactcaggcagagctaagctagccctgcaatgactccaaatgatcctgcaaggtgggggcagacacaggagaggaaaacagccccatcctggcctgctggtcaaagcacacacgtgtgctctcttctctccctccctctctgctctgtctctctctctccctccttttctctctgtttctgtctttctctctctgtaccttggcagctaacctggcattctgaactccacccccaaccctgtcggtgcctcttttgaccctgagtagctcttttctctctttccctacttcctacttcttaccactgcctggagaggttattcttagccacttgctgaacagttacttgtttcatttaaacaaacaaaaaagaaacaaaacctgcctaatgtggcagtagacttgaatttaaagaaaatgtatttcaaactgggaagaagagaaaaattttttcttaaatgcaacttattttcattgattctgaaagcaatacatatttattgtagagagaaattggattgtacagagaagcacaaagaataaaattatagttatccattattccatggtcagagataactggaattaacataaggatattgctttggcttgaatgtttgtgtcttttccaaaattcatgctgaggccgggcgcggtggctcacccctgtaatcccagcactttgggaggctgaggcaggtggattgcctgagctcaggagttctagaccagcctggccaacatggtgaaaccccaactctactaaaaatacaaaaaattagccaggcgtggcggtgcatgcctgtaatcccagctactcaggaggctgaggcacaagaatcgtttgaacctgggaggcggaggttgcagtgagctgagattgcaccactgcactccagcctgggtgacagaacgagactctgtcacaaacaaacaaacaaaaccaaaattcgagttgaaagataatccccaatgtaacagtattaagaaagaggtgaggtctttaggaggtgattagaccgtgaggactctgctcgcatgattggattaatgcttcataaaaggacttgagggagccagttcagccccttcttctcttccaccaagtgaagactcagggtttgtcttctccctcagcaacagggtgccatcacagaagcagagagcagccctcagcagacatcagacatgctggtgccttgatcttgggcttcccagtctccacaactgtgacaaatacacttctattgttgataaattacccagtctgtgatattttgttacagcagcacagactaaaacagaaatatatgctttttagccttctacacacacacacacacacacacacacacacacacacacacacacattattgggatatagtgtatgtattgtttcataatctacttctttcacatgaacactttatggtgaatgtttttccatgctaatattttttccataaagatattttaaatcatgacatagtattctatttgaacatatcaaaacatttaatctactattattggacatttaagatatttcaaaaaaaattttctttttgctactagcaatagatttgtctttttttttttttttcttgagacagggtctcactctgtcacccaggctggagtgcagtggtgtgattttggctcactgcaacctccacttctggggttcaagtgatcctcccccctcagcctcctgagtagcagggactacaggcacacaccgccacactcaactaagttttgtattattattattttagtagagacggggtttcaccatgttgcccaggctggtctcaaactactgggctcaagcaatccacccacctcagccttccaaagtgctgggattacaggcacgagccaccatgcccgaccactaggtttgtcttgaacaatctggtactgaaatctttacccacatccatggctattttcttagcataaatgtctagacatagaatagctggattagagggatgtgcatcttaaattcctggtacatagagccaaattagccttcagaaagcttatgctaattttcctgtcagcaatgctgtttctccaaactctagataaccctggctagtatcagtttttttttctgttattaattttctttggttttgagacagagtcttgctctgttgcccatgctggagtgcaatggcacgttctcagctcactgtaacctctgcctcttgggttcaagtgattctcatgcctcagcctcctgaatagctgggattactaaaaaaagtacaaaaattagccaggcacatctctactaaaaaaaaaaaaatacaaaaattagccaggcatgtaccatcatggctggctaatttctctatttttttaggagaggcagggttttgccatgtcaaactcttggcctcatgcaatccacccgcctcagcctcccaaagcgctgagattacaggagtgaaccaccacgtctggcctattaatttttaatgtaattctattgagatcagaaaatatactttgtatgaatttaatcattttaaatttattgagatctagtttacaggccagaatgtagtctgttttggtgaatgtcccatgagcacctgaaaagaatttgcattttgccattgttggatgaagtgttctatatatgtcaattaggttaagttggttgctaatgttattgaaatcttctatatcctttctgattttctgtgtacttattccatcaattaataagagagagatgttggaatctcccattataattttgaatttgtctattttctctttctactagtttttccttcctgtgttttaatgctctgttataaggggcacacacatttaatcttgctatgtcttcttgaagaattgacctgctcgtcataataggatgttcatctttatccctggtaatattctctgtcctgaatactactctgtctgctataaatacagcctctttagcttttttcaattagtgtgtgtatggcatatcttttcccagcctttcacttttaaactatttatgtctttatatttaaagtgggtttcttatagacagcatagactgagtcttgcttttttgttttttgacgctaacctgacaattctgctttttactttaatttttaattttttttttttgacagagtctcactctgtcacacaggctgaagtgcagtggtgtggtaatagctcactgcagcctcaaactcctgggctcagtggctcctcctgccttagcctcctgagtatttgggactacaggtacatgcctctgtgccaacctaattgttgctttttaattggaatgtttagaccatttatttgatgtaattcttgatacaactgggttccatctactatcctgcatttgtaccccaaccccatgtttgtcccatcttctttcttttctcgtgccttcttttggaataattgagtattttttctaattatactttatctcagctcttagcttattagctatgcctctttgttctatttctattttttactggttactctagggtctacatatacatctttaacttaccccagtctttcttcctgtatagcgtaagaactgtgcaggggtacacctccatttctgctttccttctttgtgctgttgttgtcatatgtctacatgcatcataaatcccacaatacattgattttttattttatttttttgagatggagtcttactctgttgcacaggctggagtacagtggtacaatctcagctcactgcaacctctgcctcccgggttcaatcaattttcctgcctcagcctcctcattagctgagattacaggcatgcgccaccacgccaggctaatttttgtatttttagtagagagggggtttcaccatgttggccaggctggtctcgaattcctgacctcaggtgatccacccgccttggcctcccaaagtgttggcattacaggcatgagccaccgcactcagcccccacaatacatttagaccagaggttggcaaactttctgagctagatagtaaatatttttcactctatacagtctctattgcaactacttaaccttactcttatagcacaaaagcagccatagataagacggaaataagtgagcatggctgtgttccaaaatatttttatttacaaaaataggcagcaggcaggatttatcctgtgggctgtagtttatgatccctgctttaggtaacaaaaaattatatctggaagaacacgatgttgtcttttttttttttttcatttacctatgtatttatcacattgggcactctttttcttccttttttcttctttttgagatcccacattctacttggtatcatttttcttctccctgaagaactttattgtgagggaggagagagaccctctcatattgttttatattgttttatactcagtacctgttttaagaaaaaagaaaaaaaacaaggaagtgaaatcaaagacaggcagcccagcgccagtcccaaaaccaggcctgggcctgcctggcctaaacctagtagttaaaaatcaactcatgacttagaacccgatgttacccatagatttcaggtattgtataaaagaacattgtgaaactccctgctctgttctgtttctctctgactaccagtgtatgaaacccctgtcacgtatcccctagattgctcaatcaatcatgaccctttcatgtgaaatctttagtgttgtgagcccttaaaagggacagaaattgtgcactcgagaagctcggattttaaggcagtagcttgccaatgctcccagctgaataaagcccttccttctacaacttggtgtctgacaggttttgtctgcggctcgtcctgctacaattgaacatttctgtagagcatgacagcaatacattatctcagcttttgattgtttgaaaaaaatctttattttgccttcatttttaaaagacatttttgcttggtatagaattctaggttgacaggattttctcttacagtcttgtaaagctctctctccattgcctactggcttccatgatttctgccaataaggcaactataattattatccctttttatcctatataagtaatttttttctggctgcctggaagatttctctttatctttgagttctcagcactttgactctaatgttcgggtgtatttttctttgtgttgatcctacttagggttttctgaactaggacctatggttttgttgtttttgtctaatgttagaaaattcttgagtactatgtctcagatatttctcctgtcctatttcttttttctccccctggaattactgagcttcaacctattcttcgttttttattcttcctgggactccaattgcatgtatgttagactttttgaaattgttttatggtgcttggattttatcaccactaccactgccaatacaattacaaccatcgccttcaccaccttcattaccaccatcaccacctcccctctgccttaaccaccacctttactaccaccaccattatcatcatatccacctatatgatggttacagtagggcaggtattatcctacgcaccctatatatgttaactctttaaatcatcgcatcaacactgtaatataattatacacatattatgttattctaattttacaggacttgggagagggatctggactgaagtggaggaatccagtacaagtagtggagccgtctgaaatcttggtttgtgtctacaaatgctattccaatatttgaagctaataagtcaatttaagtttgcgcagggaaatacattcaatcaatcattcattcatccaacatttataagctgtctcctgtatgacagaaagatgaatagccaacaaaggctaatgataaccctcccctcctgtctccctccttcctctctctgccaaagcatgagaggtatttgaataatcagtttccactgttccaccttttcatggaagaacacaggctttgagatctgggcctggtctccccatttaggccagattctctgtggctttcagagcacctttggctataggtattgcttcccacctcccttccctttcctcctcagaactcttcctgctttggccctaatgacaagttgataagctaatagctttgaggccccaggactagaggtgggcagctcagctgcttcctagaattctgagcttgtgaagtttctttttttctttttctttttagagatggggtcttgctctgtcatccacgctggagtgcagtggcacaatcatagctcactgcagcctcaagattcctaactcaagcagttctcttgcctcagtctaccaaatagctgggactacaggtgcatgccaccatgcctggctaggcttgtgaaatttctatacaacaacctcatttctctgtttcttacattctaaactcccacgaagtaagtttgtggatatttgacttgctgaaaatcatacaaatgaactttcctaattctattttctctgtggaacacagattattaaagtgagaattaatgtgtgcctgggacagttttggcttccacctgttgtccaagtgtaattattaattgcaccctcccctatttgctcacaaaaggagcactggttattagatgaaaaatcatatggtcatctgaagttaagaaacctcaaatccaattttgttgtagtttatcctgttttctcatctgttaaatgagaacagttctcataaattttatataagtagatgagagattagaaggaaaggctttgaacttactggaagaaaagacctatagaaatccaaggtgacttactattgttattctaatttttatatgcctgttggcctgtaacagatgtgttctgatttaagcattagctaaaactttatgttagaatcgtaattttttatatctaattatatatgcttataaatttatgcattttttgagatgctttctctctttcttttcttttcattcttgttgtcatcttacccttctctttttctgaagactttaaattgccttcatctctgtctcacttgttcctccaataagtccccctctcccacattcctaacctctccatacctctcctcaaaaagcagcagacagctttggtgatgtgaatgttagggaaactactggggcctacatcagggcaacagataggccctagcagcctgccgctgtctagagcaaggattggtgacctttgtctgtaaagagcaagacagaaaatatttttaccttttgtattagtctgttctcacactgttataaagacatacccgagactgggtaattaatgaaggaaagaggtttacttgagtcacagttctgcaggctgaacagaaggcatgactagggaggcctcaggaagcttacaatcacggcggaaggcgaaggggaggcaggcacatcttcacatggcagagcaggaggtgggggtgggaggtgctgcacactttcaaaccaccaggtctaatgagaatgctatcacgagaatagcaagtgggaagtccgctcccattgtccagtcacctccctccttcaacactaaggatcacaacttgagatgggatgtgggtggggacatggagccaaaccttatcaactttgcaggtcatgtgacctttttcacaactcctcgcatctgctactgtggcacaaaagcagccatagacaatagttaacaaatgggagtgtctgcgtttcaataaaactttatttataaaaaggcccttgggccatagtttgttgggccccctagtctaggggactgttcagggccctgatttggcctgggatcttatctcaataaaccactcaaaaccaggtataggagacaagttaatacttaaagggggcttcaggagttccttctttaggggacgaataatcacccccttctctcttttggtaaagtggtgttttctaaggatgatgatgggtaggtacaggtatgttcattatcaagcatttaaagaaaagatatcctaggtattgaccaatcatggtcacttgggaaacaaaatggaagtgcctagactccagggccctgccaaacacttgcagtgggtggacagctctaagcacaggcctctagtcgttcatcatttttccttttggaccactgcccacttttcacatccatatttacctactttggggaaaaaagaaaaatttctttgtttttatgtgggtaagcagtccctaaaggagtcagttgaggggggtgggtgggagggtagtttcagagccagcagcagggggtgactgtcacaacccttcaagagtgactgggggctggagggggctgacagcctcgctgaacttccccacagtattgttagctgaggccgggccccctctgcttctggttttggccctgaccttaggatggctttactggccaagatacaaagccccacagacagcagccccaggggtccccatggtgtcattgttgtagttagtgactctgaccaggtgctggctggagcagggttgatgggcccctatgtccactcaccctaaagagcaagtaaggtcagtgcatgctcaccaagtccattataatgtagccacgatctttttttttggctctctgtttccatcatgggattgctactgcaggacaatagcaaaaaggggctcttcacaatggaaactttgagaacagctcttctttgaggaatcctcattgctggctgtgattaaacaatttcaatgtactgaaagctgtgtaaaggcaattctcaattacctgtatgttaggtgctgaaagtgtctaattaagccaactgtttggatcctggaatgtactctcctagaaacaattgcggtcaggtctcacccagctcacatatacctatttaacccacagtggactgaagtattaatactgtaggttagcacctgacgagcatatggagggaacatcatgggttcagagatattggtaagatctcattgatagaaacaggaggcagagaaattctaagcagacagggatgggtcccaggtgaaaccccaccttcaagccaaagtagcctgaaacccacagcccaaagtgataactttttttttttttgaggcagtctcgtactgtttcccaggctggagtgcaatggcaccacctccgctcactgcaacctctgcctcctgggttcaagcgattctcctgtctcagcctcctaaatagctgggactacaggtgtgccccatcaagcctggctaatttttgtatttttagtagagatgaggtttcaccatgttggccaggctcatctcaaacagctgacctcaggtgatccacccactttggtttcccaaagtgctgggattatcggcataagccactgtgcccagcccaaagtgagaactattctcatttgcccactctctcctgattggttctttatgaataatgtctttttaccagttgaatgttgccttttccaaaactacctacggcccaccccactcccatcctgtgcctataaagactccagactcagttggtagagacagatggctgaactttgggggagatggccagacttcaagagagacggcttgactttggagagagatggcttgaattctgggaagagacaatctgactttgtggaaggtgacctgcccttcccatcccttttccagctcccctctccactgagagtcgttttcattgcttaataaaattctccgccttcaccatccttcagttcatccatgtgatctcattcttcttggacaccagacaagagcttgggacccaccaagtgtgggtacccagaaagtccatcacactggccctttgcccttgctggtgaagagcagctgccccgtgtggcaagacaaatggccaactgagctgctaacacataactgtctgcagatgggggaactaagagagcactgtaacactccctctggggttttggggttgtgggtgcccccacctaggcgctgccacaggccccacatggagcttgctcctgctggcacccagagcagccagctggatcccacactcatttactcatgcctggtctggccatgggccctgcatggagcttgctcctgctagtgcctggagcggccagctggatcctgcacttgcttgctcatgtgctccctcttgcaaggggctgagtacagtgggccaagtagatggggatccaccattgtgagtcccacaaaggggccaagaaaaatcctgcatcatgatcccacctgcctgggagaagcatcagaaactccatttgctccctgtctcttccttcagagactttcaagacttgtggctttcaaggtctgagaatcccagggcagggcgctcgggaggaggaagggctggctctgggcctgagggatgttggggaggagctcagcttgggacagtgtcctgcccgggcaactaccaagctgcatccagttctcagtttgctcctttgtgttattaaatataataatgtttattctttttcttaatccagcagtaatgagtattcatttttgaaaacttagaaaacatagataagcagaaggaagaaaatttaaatatcccatattcccaccagtttggtaatataggcttccagtgtttttctatcattaaacaaaaattatgagaggccattgtcttagactgagttcctgcactaggctccaatagaccagaccaaatcaaaatgaagttgctcatgctaaatgccacataatcagactaaaactttaaagaagcagatagatttccaaaacagaccaagttttcctgcaaacaggagattccagccttcctgagtcagcagtatataaggaagtcccctctgctttaacccttattacaaaagcaacctgaagtaacctgatgttaactaatcagttttttcctactgttctattccttgtttctaccttacaaaacccacggttctgccattgcctggtggaagctctcattctattttgtagaatggaggctgccctgattcatcgccaataaaagtcaatgagatctataacaaaatttgttgtaattctgtctttgacattacacatatgtgtgcacatgtacagtacctatatattcacacactttgcatattgtttataatttgttcttcattaaacaatgggttgtgaacatttttcatgccattaaatactttttttttttttttttttacagcatttcagaatggatgggtatatcataccttatttaaccagcatcctattgttggactgttaggtttttctatcaaaaataaccctgtgatgagcctcttgaaattgctgtctttgcatggatccactatatttcctttggataattccaaaaacgaacaatgggtgtgtgtgagttaaagcgtttaacttatttccaaagtaacttccatccccagtgtgtgagaaggctcacctgcgcctttccaccactggctgttaaaaaattttgaaactctttgccagactgataaatgaaaaatgttattgagctgtgttttttttttttttctgtattggtgagcttggacatttgtatatgtttattcactcttttgtgaattggctgcttcctttcttaagtcacagcacttaacaatccctggattgttttggccattcaaaaccaaagtgaatggatccaggttttattactctttgaaaggtaaacacctcgctccaggcagataaacctgcagagaccttcccagggcaattaattctctaaccctcaaggtttgtccatcctttgacccagctgcccgaatgtgcagagtccctaacatatttccttgtcacatccagtggggaccaaggaatctcacctgtttggaactgtgagcttttaggtaataggaacaagaaataaaattggtcagaaaacaataggaaatcatggaaggctttaaaagccaagagaccgaaaatatctacctatggttaacaggtaattgacttattttggtttttgactattgtaaatacacttggtgtgaatgcgcaggtgtgtgtccttccgtggacacatgcattcattttgttttgagtatttacctaggggtgggattattgggtcagagtataggtgtatgtttagtttgagtaggtaacgtcaaatagtttctcaaggaaacaacaaaaaaatttacactccaatcagcggtgtatcacagctccagttgctttaaactccactgacatatggtatttctgtcctctaattttagtttttctgttaggttttatatttcttttaataagttaatatgattttagattttatatttcttttaataagctaatttgacaccacatataatattaatgttgcttttccattttcattttgtttagttttaaaaatatgtctttttatatcttctcttactgatctatagataatacattttatagaactattctactttcaagattttatacaacactttctaataaaaaaactctgggtatattccttttataattattttttaacctttttttttttttttttttgagaaggagtctcactctttcctccaagctggagtgcagtggtgcgatctcagctcactgcaacctccgcctccccaattcaagcgattctcccgccttagcctcctgagtagctggaactacaggcatgcaccaccacgtccagctaatttttgtatttgtagtagagccagggtttcaccatgttggccaggctggtctcaaactcctgaccttgtgatctgcccacctcggcctcccaaagtgctgggattacaggcgtgagccaccgcgcccggcctattttttacccttttatgtaccacctacaaatgttcctcttcgtgtgtacgtggtgcatttctctttgacggtgtcttaccaatactccttcaacagggaaaatggtatccaataccttctaagttttgtcctatcctattctattaaaataatatggcaatccaggtgtggtggctcatgcctgtaatcccagcactttgggaggccaaggtgggcagatcgcctgaggtcaggagttcaagaccagcctggccaacccggtgaaaccttgtctctactaaaaatacaaaaattagccaggcatggtggtgggcgcccataatcccagctactcaggaggctgagacaggagaatggcttgaacccaggaggtggaggttgcagtgagccgagattacgcccctgcactccagcctgggcaacagagtaagactccgtctcaaaataataataataataataaggcacacatatcaagctgatacaaattctgcatggattatttttaagcctccttccttcaggagtaagttacagtgtaaagaacatagctttgcagccagactgggcttatatcctgcccacacaacttgctaactgtgtgaccttgggcaagttagttaactctcagagccttgggttcttcaataacaaaacccaggttttaggattgttgggatgttaaatgaaatagtgtatataaagtgtcaagcatgtaatagcatgctcaagaaatatgttttcttgtatgctagaagcaggtacatcagatgcctctttatcacatttgccttagttcacaaagcaattaaaaatagatacagggtgggaggggataaaggataaaaaaactacatattagatacaatgtacactactggggtcactcgggtgaagagtgtagcaaaatctcagacttcaccactagacaattcatccatgtaaccaaaaaccacttgtatcccaaaagctgttgaaataaaacatatatttaaaaaaataggtacagctagaagataagatgatggctttaaaaaagtaggcaccatctgctggtgatacggacaggagacagggaaacactgggtagaagagggcggttctccggcaaaggcccccaccctgaagcccagatacccgtgaccctaaaggaggacagggattcctgttttcacacccaaaaggttgccttttggccatcctgtacccatataaaccccaaaccccaggctccagaagcagacaaggagacaaggagacaagcagacgaatggcagaaaggcacggcagagaaagaggagaatgtctgagcactgagaggtattcggctgcggggcagtcgaagaggagtttggccactggatgtccaaattccaggggaagatcatcttcccactccgtcattggttctgtacgggaaggccggacaactcgaagtgaggagggggcttccaggttataggtagataagagacaaaatggttgcattcttttgagtttctgattagcctttccaaaggaggcaatcagatatgcatttatctcagtgagcagagggatgacttcgagttctgtctgtcctttgtccgtaaggaaatgccttgtgagggaggtttgtagcttttaaaaaagatcttagtagctatcattttcaggagtagaatgggaggcaggtttgccctaagcagctcccagcttgacttttccctttggcttagtgattttggggtcccaagatttcttttccttttacacccagcagccctggaatggggtgggggcagcattttatactctaaaatcaacttcactcctaaaagccagaaatctatctctacccccagggttaaggtgctggtgcccagtccacctaacccctgatcccacttattatgctaactctttagaaatgggtggctgaacaatgggggatgaaaacttcagggtgctggaaaatgctcttaacaacaactgccagagaaaaggtagccagcttgtgctgcagtgggtgacctggaattctcagcacttttctttttcctgtcttttcccctctgccccctaccagtgtgtacacattcgctaaaagggactgacatcaagaaggtgccagcttgcctagttaggagcagtcattgccaatcaagtcttcaaatacggacttgataggaaaaaggaacacgttttcacccaaggttaaacactagtgccattcagaacatggaatactactggagagcaggatttacagtgtctttggggagacagtttcagataatagccacagtactgtgacagtcccagataagccacatcctctcactgttggagggcatccctgctctctcccatcatgcctgccaccttggtttccaaatctgacttctcccctgagctaaagtgccagatctccaagccaatgtcccttcagaggtccatttagcattctgaaatgaatcatccaatttcagttgctggctcccctccccattcctcttgtttctgataatgatattgtaatcacctgatgggttcttcctgccgacggcacagacaaaaccaattcaatgacaccatggcattgcaataaagaaagagtttaattgacatgaggctggccacaccatgtgggagatgaagatattactcaagtcgacctcccggaaaattctgaggctaggtttttcaagggttatttggctggcagggggcgaggggaacagatgcggctgattggttggggatgcaatcatagggatgtggaaaatggtccttgtgcactaagtctgcttctgggtgggtccgcaggactggttgggccaagagtcaaggtccggtcatctggtcatgagaaatgcaaaatcctgaaaggacatctccaaagaccaattttaggttctttaagagggatgtgccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcaagactccgtctcaaaaaaaaaaaaaaaaaaaaaagagggatgttatcctcaggagtaactggggaagttgcaaatcttgtgacctacagaataatggctggtaattgttcacacctacatcttagcagaattcaggcttctctcatcctcctaaccgggtggtcctttattcattttacaaaggcagttcagttttggggaaggactattatcatttaaactgtaaactaaagtttgtaactccccaagttagcttggcccaagcccaggaatgaccaaggcagtttggaggttaaagacaagatggggattggttagatcagatctctttcactgtcataattttctcactgttataatttttgcaaaggtggtttttcaatactatcattatcttgggccattctttgtacactgcttgaaaatgatgtgatgtgttgttttaagtgaggtgctatgggtagtggttactgcctggtggagccccaatatccatccattccttctttgatagtgataggatttgcatttgggtggcctaggatcaagactctatttcctagatgcccctgtctctgggtgtggtaacacactcagttctggccaaaagactgtgagtgaaatcattggatgtaacttctagatcatatccttaacaggaaggggtgtgatctttttctatcccatcctccatcctgttgcctagaacattgtggggacggggaagccagtttggagaatgccaacaagggcagcaccgtagagatggcagagcaactggaaaagaggaaccagggtcttagatcctgtgcagctgccattccagccttgacttactatttgcctggacgactgggagacagagcaatagacatctatcttgtttaagccacgattcttgtgagtctctgttagagcacttgaaacttatcctaaagaaaaaagccatcagagaggccccattttccccaagctgtccagtggcttagtctaagaggccggtctacctgtgatagaggcaggagagagccaaatgcctaggcaaatagagaagggtccctggagagcctcccacctgcccaggtcattgtggacagcgggcttcacctaaacatgcccatggtgaaaacttccgtgccttaacataggtacagtaagggaaagaaatcaatgtggaggggctcaagactaagagcccacgtgtggactggcagtggtgcctttgctgctggtgtattttcctgaccaaaatcaccacccaccccgccccacagagggccaagcttgtgcctcctcacacagacctctctctgctttgtctgaagtcccacactgcccacagctggtcatttaattactcttggtttgatgagtctcttactaattccaatagttcacagaatcattagaattttgaagctgtcaatgatttaaatgcatattttcccaagtagaaatagaatttaaattcagatagtcctaatctgatgcctccttttcagaatgctccccaccccaactactgctttgatcatgttagaataaaactcagaatcaaactccccgggaggcaatgcctgcagcctgctttccaggcagtgtggctccccgctgtgccctttgaaattagtcacaacccttacttcccgtctggagtttttgagagaacagtgacatgacagcccattgtacatgaagcaagttagggcacgtcctggccaagatcccagggtcctgagtatcttgtttgatcccgagttgaatttatggatcacagtacatctctggcccccttgtttcaaagacagaatcccttacgtcacaagaagcaggacaggaaaagccacatagcagactggataatttaaatgtataatggtggatctgtttttctagaagagcttaggtaaactcggaggtgacctctaattccaaatacaaggccaggtgtgtactgggagcataatagatgcttactggctgacaattgcagggctcaccttaactttggctgtggagcacagctctgatctcagagaaaaatatctttctcaagtttcccttttccttgtcacattgctttggaaagcctttctccaatttctcgccagcttggtctttatttcccgcctaatttctgcttctacctgctctgttttttgtgcttttgactatagctaccacacagagagtgaactactgtggtgttcctcagaaataatcaggctttttagtgtgtgtggtttttatttttatttttttgcaagaggcagtatacttcaaaggtttggtctcacatttaaaggtaggttggaaataacagcactcaagatgctttgggcgatcagaaaattcctccagcccagcaagacagcagtggtgtggcagaatttgtttaacaaaagatcttagtgatttagcatttattcagtttacagtagcaggtgtttacttcgaagcttagcaatagtaggaggtaggggtgagtcataatgtcaattatttttttctaacttctgcaattttttcagttgagagagcttctacatcagtgaaaggaaggtcatttctccgtggattatcggattgagcagagggcctgagagcagcaggagttgggatgtatttggggcaggtgggggtgtaacctgcagtgcggctgtggggtgctctggcccgcagggccctggaagccctcaactgatcagagcgcctggtggggctgtcaccatgatttaaagctctgagaatatgaattagcaggaggtaggcggatggtgtcattctggccctgaaaggcttccataaatcagtgacacagtggagccccagcaaacttcctccccgccggtttctggaggctctccttcccactctgcccagacaagtggaaaggagcgatcccttgagtgggtgggttacggccaaatggcctgccctccccacagcttgcagatctgggcagttgggttttcgctggagctttgggcttcacccactgactgcagagctgcagaatccttgcagcacattggggcttgggttctggcttttggagggatttggctttgacagtggtggtgaggagggagtctttaatgaaacaaattctgtcatgttggatcaacacaatggagctcagtctgcacagtggacaagaatggcttgttccttccttctaccctttgtgctttgttaacagaatgtccctggcacttctgtgctcctgcctgctgccaaaagcttaactctgcccttgcataatactggaggacactgtcagaggtcagctggaagtccctcattcgaaggcagatgtgagggctaaaaccctgccaagatccccaggctgtttttcagtgttgaggttgaaactttttctctgccgcctcccccagtttaccaactcctccctctaactggggtggagacttgcgtccagggagtcttcagctcccctctatacagtaagaacacctgccactgacacccaaagccacgcagtgatttctcttcactctcttcagccccatgctctagcaggctttatgttttagggaggagctggagtcacacggaggtccgctgtaggaaacgttgctgccttcactcacccacttctgttaggcaaggagttacagcggaatcttacagcagaaaacaaagcaggaaatatgacctcccagcgtctctctgggtctgaggaacaggattcaggtgtctctgtaccttggccagtttgcattcttgtctgcctaggaatgccagattccttttaaaaaccacaggtataggaaacagccccaagcctaaggttctttcccttccttaccctctttgtctctgtggctactcagctcaggaggtgagatgttttcatggtacaggggacagaaattccagttctgggagggggagctggttgggcttcttctttactgtggccagacatgagcaaccttagccttcgggcttacacatgcctagctggtttgtttgtttgttttggttacaaggggaatgggaataaggaaggagcaacaggcagctcaaatacctcatcactcctggaaaacactatcacttcccacgcgtgggaagccggcatatttgttcccgcagtctaggcaggtggagtatccctaatccgaaaatccaaaatcaaaaatgctttaaaatccaaagctttttgagcagcaatatgatgccacaagtagaaaattccacacttaacttcacgtgacagatcacagtcaaaacacattcaagactttgtcatgcacaacattattaaaaatattgcataaaattacttggaagctgtgtttataagggtttatatataaaacataaatgaattttgtcttaagatttggggttcatcttcaagatacctcattatatatctttttaaaaatgttgactttggaatatatcttatatattccaaaaaattcccgaattggaaacatttctggtctcaagcatttttatttatttatttatttatttatttatttatttatttttgagacagggtctcactctgtcaccaaggctgaatgcagtggcgtgatcactgcagcctcaacctcctggtctcaagtgattctcccccctcagtctcctgaagctggggctacaggagcaccaccatgcctggctaatttttaaaaatttttttgtacatataggggtggggagaggtcttgctatgttgcccaggctggtcttgaattcttgggctcaagtaattctccagtctcggccttccaaagtgtagggattacaggtgtgagccaccacgcctgacattttttattttttagatatggcggcggcgggggggtgggaagggggagggcgtctaagctatattgcccaggctggattcaaactcctgagctcaaaaggtcctcctgtctcagcctctcaagtagctggggttacaggcacatgctactgcacctggctgcaaccactctggataagagcaacctgtaatccctcttccacctgccttttgtttactgtatctatccctgtaaagtactgctactttctagctgtttggccttatacaagttgctttacatctgtatgccctattttccacatctgataaatcagtattatttcatagaattgctatgaagattagatgagataataaaggcaaagctcttagaatggtacttggctcatagtaagcactcaaatattgtttttgtcaacattttctatatatctatgtatggcttttgtgattgtttttatttttagtcaaggattacatctcatttcttgccttttctttgtattctgaattcaggttgtgtgaatctacctgccactgcaaattttcaagctgaaaggccatttgcattttacaaccactctctcaaacattcctctagggaactagccgttttgaattactcctctcttttctctcttgtctccagaattgcatattccaaatccagaacagtctcagcatggctgccgttttctcgtttctttgtgaagcatcccggtccaggctgccagcctcacgttatttgattgttttcggaacagccggcagggggcgcgcatcagccgttcccagcactcaggcgaggggttctgactccccaggtacttctgttaatgagttcggtgcctgtaggtctttcagttaggatgatagaaagcttccttggcatggagattcaccgtgtacttctacaaatagaagtttaaaagacagaaagctgtatattatcgctgctgagagctttgcagtcacgcctccctgtgatgagactgactgctgtgttactgtgggtaaattgctcagcttctctgaggcagtttctttttatgtaaaaatgggacagaagccagcctggcttctagagttgttggaggagtcagcatgtggctgatagatgtagagctcttagccactgcggtatttaggaattggtaagcatctttactcagggcactgaggcaagtttggggccctgtcttttctctccttacccatccacctccttttcttctcccttcctgctcactttttctccatgctcttcatttccctgtatccaggcctgagaccaacgcctgtgggtacaagggagcctctgtaggcatagggctgggatatacagaggggaggctgagccacccacagggtgaaaagaaggccagcggaaaccccattccacttccctcagctttttacgtgcattctataaacctcatctagtctcttggtcagcagaagcaaaattagccacaatttgctcacactgcacccatccccaaccccactccaccctaccagggctaagagatgtcagcaaaaataaaccccacgagagtgttcttcatagcccgatgcacagaactggcagtgccatgtgggcatcaccctggatggtgtgcatcctcaccatacccaggcacctacctggtcagatgtgacaagagttgctctagggacctgggatcccagagagggtgggtgggtgggatggggacacaacctcagctggctcagaggagggtacagctcagtgcccaggctcggctcagcctggcttaggggaccattcaggcctggattggcaccagtggtttggttggggactagtctggaaggttccacacctctaatcttcaaatgatgctgggtctgtcttccaactggggggctggtctaggtgccttctgtccacaggggtagcttagtttgtttcctttgaaggcctgggtctctttctggagggataagggtcatgtgggtaggggaccagtttgttctggctttagccctgaaagtcctgcatcccaggaagccactcaatcctgggcacactggaaggggtgtccaccttgtgggatgcagcacgtcatgtgttaatcttggtctagatccccgcaggagagctgtgtggctctaggatgtgatagggcactttgggacgcagaattgctggggaaaaaaagaactaactatctcccaccaccagattagatatgggctacttagaagtttctttcttttcttttctttttcttttcttttttcttttttttttttggtgcagagttttgctctggttgcccagactggagtgcaatggcgtcatctcagctcaccgcaacctctgcctcccgggttcaagcaattctcctgcctcagcctcccgagtagctgggattacaggcatgtgccaccatgcctggctaattttttgtatttttagtagagttggggtttctccatgttggtcaggctggtctcgaactcctgacctcaggtgatctgcccaccttgacctcccaaagtgctgggattataggcgtcagccaccgtgcctggcctgcttagacattcctaacaacactggatgaatggggagctggaccaagccactgtcttccagagtactgtggcaagtggggtcaaagtggattcatcccaaatggggataccttgaagtggcttcctgcctttgtccaggagctcctccccgcacccagatcccacagcaggagggcactagagccttggcccacaccccatccatccccgacaggctgcagcatgccctgcctggtgagcagtttgccgacctttgcctctaattgctctcctctgcacacagccacttcctctgcctgcagcagaactcataaaaagggaggctttccttcatacctctgaaaagttcaaaagaacccatttcctaggggagacctggtcacgccatcactgggatcagaggctgctgaggacgccagccatgagctgctgctggccgggcccagctgccctgaactgcaccccagccctgtcactgcttttcagtgccagcatcctgtgctctaaggcggtccaacctctatcaagaccagctctgttctcttttgggatcaatccgcaccccttaaccctgcactgcatcttacagagcgagcccccattgctgtgaattggccatgaaacgtcaagcctaacctagaatggtgggtgacaaagccacacccagctttggcgaggtgcgcaccctgccccatcagatgctcgctccactgctctgcacccaccgcccctgctattccatggggccccaaccctggctttgattgggagttagagcgatgtcagtttatctgagcccaaagcacaggcgtgttcagattgggagtagggcttctggttctttggcatggctcttgggcatggaccaaactccgttcttccccagcatccaagttggtaatgtatgttcatgaacatctcagacaggatcctagacgccaaccaatagggagtttctgggagaaaatgaaacagttttgtgctgtctgtcccagctgaaggtgctcaggcaatgcttgttgaacaaatacataaattctacttatagaataggaaacagatctctaaagggaacctgctttaataacttagaggtatctagaaacaggatagggctagattggaaaggaaaacactcatttctaatatactttcctctcctaatgacctccactctcctctaccacccaacaagccaagtggtggatgagtcagatatgcttattaaatagcatgtgcagtggaaggctggccagcaccttcaccattccatgcatcctaaccctttccccggctgctgttgcagcacacacacacacacacacagaatctcacacacactcaaacacacatataaacataaacacactcatatactcaaacacacacaaacacatactacacagacaaacatacacaaacacaatacaagcatgcacacaaatatacacaaacacgcatatgcacaaagacacatacaacatatacacaaaacatacaaatacatacatacaaatatatgcatatacatacttatacctacaaaccaaacacatatacataaacacacactacacacactcacacacaaacatgcccatatatacataaacatacatatatgcaaacacactacacacaaacacacacagacatgcgcgcgcacacacacacacccctttccacccgttgaggggttgggatatgagagaaaacatgaacttttcatctgcacttcattataacatgctgtacaattaattgttctgtaggattttttgatgcatgtcactgaaattgctctaattttcacttgacaacaatagtttaatgctataaaaatatccatatatgcatgtgatggtttgcagcttctgaaatatggtcatctgttccaggttaaaagaattcgaggcagcattcttcctgaaggccttttgttattagtttgcttctcaaagtcatcttccgaatcctgctgtgctaagcatcaccccagctcagcccagttatgaatttcattgctgagctctgagcccaggttgtctggcagcatttctgattgtaatcagttttgtgcagtgagatcaccttgctgaccacgagcggtggctcccagcactgcaaagatatgtgtggggccggcctgcttttgtgactgcagcattcacccttcaggggacagacagcggctcttgctgtctcaatgccactggaagaactccaaagggtgcctggaggaccagcttggactttcagttctgttgcttacgagtgtgtgaccttggacatgttgtgcgtctctctgcctctcggttctgtgacctgggcatagttaacacctgcttttgaggtcttgtgaggaataaatgagacattttattgaaacagctacattgattttacaattctcaattctgacccatgaaagaaatagatttcatttcattatgactgacattaaaaaaattagaatagatattgggtataaagtttctttatggggtgaggtaaatgttctaaattagattgtgataataattgtacaactctggaaacgtacgaaaatctactgagctgtgtacactttaagtgggtgaattttgtggtatataaatcacatatacatatttttgagacagagtctcgctctgtcaccactctgtagtgcagtggcacaatctctgcgtactgcaacctctgcctcctgggttcaagcaattctgcctcagcctcccaagtagctgggattacaggcatgtgccaccatgcctggctaattttttgtatttttagtagagacggggtttcaccatgtaggccaggatgatctcgatctcttgaccttgtgatccgcccaccttggcctcccaaagtgctaggattacaggcatgagccactgcgcctggcctataaatcatatcttaataaagttggttatacaataaaatgcccttaaaaatccatcaacctctacacttgggattcatgaactttagtatatatgttagacttcaattaaaaaatttggctgggcgtggtggctcacacctgtaatcccagcactttgggaagccgagggggcagatcccttgaggtcaggagttgggagagtagcctggccaacatggtgaaaccctgtctctgctaaaaacacaaaaaattagccaggcgtggtggtacgtgcctgtaatcccagctacttgagaggctgactgggagaattgcttgaacccaggaggcagagattgcagtgagctgagattgtgccactgtactccagtctatgtgacagagtgagacttcatctcaattaaaaaaaatagatataggctggatgtagtggtgcacacctgcaacaccagcactttgggaggctgaggtgggaagatctcttgaggccaggagtttgagaccagcctggataacatagcgagactctgtagctacaaaaaaaaaaaaaagataaaaaataaaaaaattaattgagtgtagtggtgcatagtgcacacatgtagtcctacctatttgggaggctgagacaggaggatcgcttgagcccgggagtttgagtttgcagtgagctatgatcacaccattgcacactagtctgggagatggagcaaaaacctgtctctaaaaaatgaaaaaaaaaaaaaaaaagacataagaaatagaatagaaaatagcagagtgcctcacatgtagtaatagttaatatcattttcatgaactatatgtgtaaatgtgtgtgtatgcatgtgtgtgtgtgtatgtgtgtacggggctgcaatagaaatgtgtttctaacagagggctgttgctgtaaacatccactggcctagcgtctatccagtcagagcagacatttaacaatgattacttataccccttctccccttcctttccagaaatgcaaataaagaggaagagcacacccatgttcagtaattgactttgacttcagagtgttggcctgttttctgacataagagagcagaaactctgactagctggaggagccccgttaccaccccccttccgtgtgtgtatgtacacacacgtgcatgcacacaattaaatcaggctctctttttctagttaaataaaccccacacttgccaaaggaacaaatagttggcctattgccaaagaaaatgtgcctctgggcttctggttttggaggttttgcagtgtttactttccagtgatctccacttgactccttacctctttcatttggttgtaaataccacaatttaaactagctacctgctgctgtgaccctggatgggaggttgtcttgacagatgtggcaggcttccctggccccttcctcctctaggtgagtgtggggtggaggagggtgggcatgagcaggaacatggctgtcgtgggggtgagtgtggggcagggacggcagccactgccacaagcaggacatggactttgtgctcaatcaaggtaaatagatgaagtcatccagtgcctggtgaccttttgaagatgacgcagtataaatagccttgggaagactatttcatcagggttgaaacacttgtgtttctgttgctttctgatgattattttcctttggttgtttgcccctgtgacacatttcagtaactaccagatgggccttgggtggatgtatccaatgggaaaaccaatttggaaatgacagggctggcagctgcctcctcactgaaatctgggaaatcagagaatcgaatcaattgaagaactcttagactttactttggttttgtaagttctgggttcaaattccctttcatattgtagatagagttagacaactactaatttgtggccatattacaactgattagggtagagggttagtctctgattgtaaccagctaccttggaaaggccacgccaactcttttaggtcacttagctttcatcagtgcccgaaggggaagtttctaccaagcagatggcatatggtatgtagcagatggtagatggtatatggtagatagtggatggtagatattagatggttgatagtatatggtagatggtggatgacagagagtagatggtatatgctggatggtacatggtatatggtagatggtggatggtgaatggcatatgacagatggtagatgaagaatggtggatagtacatgatagatggttgatgatagacaattgatggtagatggtagatggtgggtggtatgtgatggatggtggatggcagatggcagtggtatgtggtagatggcagatggtgcatcgtaaatggtgcatgatggtggatggtggatggtagatggtagatggtagatgatggatgatacatggtatgtggtaaatggtatatggaatatggtagatggtgcatggtaaatggtggaggatggtggatggtagatggcagatggtagatggtggatgataggtggtatatgatgaatggcatatggaatatggtagatggtggatggtagatagtacatggtgaatggtagatggtggatggtggatggtagatggtagatgatatatgatgaatggtatatggaatatggtggataatagtggatggtagatgacagatggcatatggtgggtggtgtatgatggatggtggatggtagatgggagatgatatatggtatatgatgaatggtagataatggatggcagatggtatatggcatatggcaggtggtatatgtggtatatgatgaatggcatatggaatacagtgaatggtagatggtggatggtagacggctgatgattgatagcataaggtatatgataatagatagggcccagattttaaagtccagctgcccagtgagaatgctttttctgcttctcacttgcaccacaatctttgtgccttggttgctacagctgcaaaataatagcacctcacttgtgggatttgttttgttaaggcaaaatttttataacacaaaattttctattttcacactaagtgcaccgttcggtaggattaagtacattcacattattgtaaaccatcatcatcatccatccacagaactcttcgtcttccaaaactgaaactctgtacccattaaatggtaacacctcatttcccactctccccagtccctgacaaccaccattctactttgaatctctatgaatttgactactctaggtacctcatgtaagtggaatcttacagtatttgttattttgtgactagcttatttcacttaacataacgtttttaacactcacccaggttgtagcatgtatcagaatgtcctttttaaaggctgaataatattccattgtatggacataacaattttatttatccatttatctgctgatggacatgtggttgtttccccttttggttgttgtgaataatgctgctataaacatgagtgtacaaatacgtgttcaagtccctgttttcaattcctttggatgtctactcaggatatccaaacttgatggagtaattctatgtttaattttttaaagaactaacatactgttttctacagtgactgcactattttatattttcactaacaacacacaaggtttccagttttctccacacctttgtcgacacttgttattgtctggggctttaaaaaatttatttataatagcctctgtgattttggttttgaaggctagatgacagaatgtacagaaaacacttagcctgtagtcccagctactcgtgaggctgaggtgggaggatcgcttgagcctgggaggcagaggttgcaatgagctcagatggagccactgcactccagcctgcataacagagtaagaccctgtctcaaaaaagttaaaaaaaagaaagaaagtagaaaaaaaaaagtagaaagaaagagagagagagaaggaaggaagaaaggatgaaggaaggaactaatgaaggaaggagaaagaaagaaaacacttaacaaacttagtgcctggctcagtaaatgatagttgaccttgctgtttcgggtgctgcttctctttctgtagaagtaacttaactgttaatcttcattatagattaacttctccctctcctctctcatacaaagactgtatgctgttacattgtcaaagacaggatgctatatgctcttttaaattggaaaggaaaacaagctatacagaaaagaaaacaaactgtaactaattaaattgttgtaactcataaatccagccttgtatggaaaatgtcatagtcctactaaactttgttttgcctatataagcaagacagcttttaacttcagagagctcaccccgtttctgtggggtctatttctgttttgttcagttacctgaatggccattctcagctttgcgcttgaataaactctttaaaactggattctgatccctttgattatttcatgttgactatatatatataatatatatatataagactatatatatataataatatgtatatgtatttggagagagaggaagcaaattcggcaaaatgtcaataattggtgagtgaaggggatacgggagtcctttgtactattcctgaatctcttctctaaagtttaaaattatctcaaaataaaaaatgacaaaagatatggacttcttagggacatgtttcttggggtgtatttcccagctgtctgtgttagaatttcccgggagtttaaaacacagacacaggggttccactgtggcagtccgctccaggaggtatggggtgaagcctgaggatctgcattttccacaagcgcctcagggaattctgagtcagatggtcggtagatgtgacttcaggaagtagcatctccactgcctcctccaggcagtggactgtttgtacacagtctcggcgagtggtaggatgacagttgttcctggctggtcttggtcatgcttgtcccgtgcagactcgatgctgagtcaaccctgctgaggcaggaactgagtctggtttaggattaagtcacctacttagacccagtgacagtcccatgtttgctaaactcccctgctcttccctgggtctcttcactgacacagcaggcatggtgtcctcagagatggtctggtagtcattcgatcttcccaggaatccaaagtaatgttactgacaacaagggagtgatccagaggtggtggaggtgacgatggtgatgccgctgctgctgccgacctggtataaccatccctaaatgatgtgtttggcaaggaaagacccaggaatcagggcattcacataaagagtacgaagtaaagggaaagatgggaatgaggtgggagagaggagcacgcaaggtatttgaagttattcttctgtttgttcaaccagcattttatgaatgccatgtgtgtaccaggcactttgcagggcatggagaataagattaagtacaagaacagatagagccccccttgttttatggagctcagcccaggtctggatctcacagttgactaggagaatgggaaacagagccttgacttgtcataaagccttcttgaagggaagaagtgaatgggaaatagcgtttagaaagtttggctccagatggcgaggttggggagggaattcctgactatcagagaatgtatttttctgcagataaaaatcaaactgtgggtcccaataataatagtaataatagtactactaataaaataactcaaagcttttatctcaaggcctcacgagagaaatagttggaaatccactctcaggtccctcccatctcacctttggaatcatcaggtttccagaacagctacagccttcctctttttgttccctggtggtcactgtctgtggctgggtgggggacgcctcttcactgtcacctccaggcttcctcttctggctccatgcaaagtctcaattcttcctcctctcttctccagaagggactgcatttacttctttcttatttgtttatttttctctaacacttacttgttgggtagataatgcacttgtatagttgaaaaatcaggctggggtcggtggctcatacctgtaatcccagcacgttgggaggccgaggcgggcggctcacctgaggtcaggagttcgagaccagcctggccaatatggtgaaaccccatctcttctaaaagtacaaaaattagccaggcatggtggcacatgcctgtagtcccacctactcgggaggctgaggcagaagaatcacttgaacctgggaggcggaggctgcagtgagccaagatcgtgccgctgcactcccgcctgggcgacagagtgatactccatctcaaaaaaaaaaaaaaaaaaagaaaaatcaatgttatccaagaggacccaaggaatagtgcgcctgccattcctgcctcccagtcatgacttctcccagaggcaaccaatgcttctcatttcttctgtgtctttccagagatagtctctattaaggcatatatttttcttcatttttttaaaaaagattctagtgtattttagataccgtttagtactttgcttctttcatcaatttaaaaatatctcttggagatcattccctatcatgagggatcttgttcttctgtgactgcatggtatccatggtgtatatacagctataatttagttaattgattaatggtcatttaggtcatttccaaacttttccctttgtaacgtacatacgagtataactgcaggttacattcctagaagtagaactattgggtgcaggaggatatgagctttggtcttttttttttttgagacacagtctcgctctgtcacccaggctggaatgtagtggcaccatctcagctcactgtaacctctgcttcctgggttcaagtggttctcctgcctcagcctcctgagtagctgagattacaggggctcaccatcactcccagctaatttttgtagatttggtagagacggggtttcaccacgttggtcaggctggtctcgaactcctgacctcaggtgatccacctgtctcggccccccaaagtgctgagattacagggggagcttggtagttttgatgaatattgccagattgtccaccatggaggtactaactgacacgtccatcaacaatctatgtgttcacattttacaaacccttgccaccataataatcattttttatgtttgcaatcttgcaggtaaaaaaagaggagtcccattgaaattttaactttcattcctcttattacaagtggatttcaacattctttcttatgtttaaaatctattttcattttcttttgaaggaactgtttttcccccatatccattcctatttgttctattgggttctagttttttttttttttttctttttgtttactttactttttatatattaggccaaattagctctctgttaatgacgtgaatgcaaatgtattttctagtttgtcatttgtcttttagatttacttatgttggtttgccctacaaacttaaaaaaaaatgtatatagttgattggatcagtcttttttttgtggcttctgttgtgttttgcacttagattttttttatagcaagattattttaaaaatatcccatcaagtcttctaacacttctgatttaattttttatattaaaaatttaaatccgtattaaatttatcctggtgtaagatgtgaggtgtgaattcaacttcatttttacccctcaatggttatccaattgttctaacaccatcttttatgcactgatttgaagtgctacccttttcatatactaaattatctcttatgcttgtgtttatttatgggctttttattctgttccatttatctgcctgtgtgtttctcatgaataccatttcaatgatcagttgtataatgtcaatgtttgtccgggatgacccattattactcttctttttcagaaatttcctgactactttgcttgtttatttctacatatgatttttagtatcagcttatctagttaaaaaatctcattattttatagggatagtttatttatgggctattaacttatggagtaagttagggagaaatgacatttatggtgttttccactctatgaatatgatatgtcttattatttgctcaggattttttttatgtgtccagtagtaactttttatatttatttatttatttattttgagacagagtctccgtctgtcacccagactggagtgcaatggcacaatcttggctcactacaacctccacctcccaggttcaagcgattcttctgcctcagcctcccaagtagctgggattacaggcacccacaatcatgccaggctaatttttgtatttttagtagagacggggtttcaccatgttggccaggctggtcctgaactcctgacctcaggtgatccgcctgcctcggcctctcaaagtgctgggattacaggcgtgagccactgcacgtggccccaatagtaacattttaaagtttttatttcatatagatcttaatattttcttgttgagtttatttctaagtattttttccttctttttttaaattgtgaattactctttatcttctaactggttgcgatttgcattcattgaaggatattgaattaattatttctccatattaattttaaaagcagtcaccttactgaatttcttatttgtgaaataagcacactgagtgagcatttgaatcattagaaattaattttttctgttttaatatttattcatacagtaaattctttatactggtcagtttgagttttcttgtgcagtggctaatgttgagtactttttattttggcagaacttattaaccaatttgtcatggatatctctctagttgtatgatgtgttaggagttttatgttattttcatcaatgccattattttgtgtcaaatcagcacaaaatttaaatatttttccagtgagttcagtgatgcattctttttttaccagttgaattataaaataacacaagaacctattcattatagtccgttacttatattagagatctatttcttcctatttaatgaattattgcatttcgtatagtctgaattattatactttttatatgcctgttggcctggggccttggcagaggagaacacatttgatgactttcttaaaccatgggatcagtttctcattgtcagaaccaatagattccttctttcctccttgcccacagctcactgcaggccacagccagaatcaagcttccccaaagggtactctcatcacaccatatcacttccctagccataggcttccactgtcatcaaaacagggctcaccagctagtttccagatctctctataattaggcaatgctaacctgtctataattcctcaatactgtagttaaatgtcttagtgtagtgcccagcatatagcacatgaatacatgcagatatgtgtgtgagtgtatatacatcaatcccctttaatgtagttattgctccagaaagctctggcataggtttgggccgttgtgaagctgacgtgggcttcaaggctctttttaagtcaagttccgagtgtttctggtagctttggggctgtcctgaagatgtccaaggagaaagtgtgagccagcggcagctaatctgcagagcagttgggtgagctcctacgtagctgatgtggaaatgtgttaattcacctccaccaaggcctgtcctttacagccattccagactcaccaaaggaggagacttaggcacttctgcatttggcaatcagcagagtgaatttaaatatatgtatttaaattatatatttaatttatatatattcagattatacctgcaagacattgtcagatatcaggttgaatcagaacattgcatgcagttacagagctggcaacaatagcatatttttaaaatagtgctttcatttatagaagtaatttgtgcttatcataaacattaatagtcaaaagttattaagtggttgggtgcagtggctcacacccataatcccagcactttgggaggccgaagtgggaagactgcttgggctcaggagttcaagagcagcctgggcaagatagtgagacttcatctttacttaaaaaaaaaaaagttaactgggcatggtgacatgcacctgtggtcttagctacttgggaagctgaggcaggagaatcacttgagcccctgaggtcgaggctgcagtgagccatgatcacgctgctacactccagcctgagtgacaaagcaagaccctgtctcaaaaaaaaaaaagttattaagtaagaatttctcctgatcctactcttcagaattgtctactttttaatgctttcttgggaatgctttcaaatactttgtatgcatatatatgcatatacttccttttttttgcacaaatgaaataatgtcatatataattgcttttttccacttatccacatgcagcatacattttccctgttggcatgtagagacagctcacactattattattattattatttttcgagacggagtcctcgctctgtcactcaggctggagtgcagtggcctgatcttggctcactgcaagctccacctcctgggttcacaccattctcctgcctcagcctcctgagtagctgggactacaggtgcctgccaccatgccccactatttttaaatttttttttagtagagatggggtttcaccatgtcagccaggatggtcttgatctcctgaccttgtgatttgaccgcctcggcctcccaaagtgctgggattacaggcatgagccactgtccctggccatctcacattatttttaagggggcattgtttttgttgtattttactaaatggatgtttcagcatttattttaggagtctcctcttttcagacttttttttttcagttcttttgctgttacagacaatacttcaatcaatatttttatgcaaaatgtcattttacacttttgaaaatttatctgtaggagaatttcctggaaatataattgctagttcaaaaatatgcacatttataattttcatagatattaacaagcttctctctaaagacattttgctaatttataccctcacttatagcatttgagagaatagcaacatccttggctacaagctggggaggatacatctgtctatctttactctcacatagtagaatggagtagtgaaaagaatactaagataggagtcaagaaattcatgtagagcacatttggtgtggtacgaagaacagagagttgtggagacctaaatacttcaaatgtatgtatgtatgtatgtatgtatgtattgagacggagtctggttctgtcacccaggccggagtgcagtggtgtgatcttggcttattgcaacctctgcctcctgggttcagaggttctgaacttgaacctcctgggttcaagtgattctcctacctcagcctcctgagtatctgggattataggtgcctgccactgtgcctggctaatttttgtattttcagtagagataaggtttcgccatgttggccaggctggactggaactcctggtctcaagtgatccacttgcctcggcctcccaaagtgctggaattacaggtatgagccaccacacccagtcccaagacttcaattttaattgtgactccactatccactaatatggtgaagatggggcagtttatttaatcaccctgagcttcagttttctcaactatacaagtggggataatgctcccctacagtgctacaaaggtttaatgagataatgtatataaagggcagactgttaagtgtttgccaattctcatttcagtttactcttcctagcctacatttcccagcctcccttgcagtaaggtgagaccatgtgactgggctctggccagttggatgtgggcagagaatccacagggttgaacccattcccaggctccattccttcatctggagcaacagggaccatgtgttgagatggtggagggcagaggaacccaggctgtgccgtgtgtggaggagctcttctctgcactctgcctacatttggacttggattatactcgatcaaaaaatatttatttatttatttatttatttattttttgagacagagtcttgctctgtcacccaggctggagtgcaatggcactacctcggctcactgcaacctccacctcctgggttcaagcgattctcctgcctcagcctcccaaatagctgggattacaggtgcccatcaccacaccctgctaattattgtatttttagtagagatggggtttcaccatgttgaccaggctggtcttgaactcctgacctcaggtgatctgctcaccttggctgcccaaagtgctgggattacaggcgtgagccactgtgcctgacccaagaagtagactcttgttgtgttaagccattgaggttccagaactggtggtcagtgcactatagccaagcccacctcaccagtacaagggtttcatcagcattgcaggtgttctgcaagcatatgtgctctttctaggatctaaactggatctgtggctatgtagtgacctcggggaagttcctttctgaaggcctcagcttcctcatcaattaaatgcgaatgctgagcttgatgaaccaatccagccatccttcccagctctcatacctgatggcttagaatcactggagagcagggtagagtctaagtccttggtgccttgggcatggtgagacaaagtagcaagcgtaagaagccatgtttgctagtttctgcttgccagcagaatttctcaaagcccctggctctgtgacgaggttcagttctctggaaagattctttaaagacaaaacaggatagagcacacagtcccccacccctcttgcctgaatcactacattccttaaaagataaatgaccctagtccttgccttttcctccacataagataaggagtgacgaggctagtggttacgcttctgtaatttgtaaccagatgtacttttacacccagactttgatgtgattttgcttcaatgtaacttctgagcaaatctgatgcaattttgcatgtcctgaacccccaggacctgtatataagcagtgggccgaaatactgtaccggagcagtctgatgggccagtctgacaggccttggtctgttgttctcagcaatacctctcaatataataaaactaattctttaaaagcttgacttttttgtttcatggacagcataaatacctataaacctcaccagcaaggcagcatggtatggggttataaccacggatgtcagagtcaggctctgtagtttcatatcctacccacccaccccttccctgatagaagctgtgtgaacttaggcaagtgactcaacctctcgttgccttatttttccatttttttttcttgagaaggagtctcgctgtgttgctcaggctggagtgcagtggcgctatcttggctcactgcaagctccacctcctgggttcatgctgttctcctgcctcagccttctgagtatctgggactacaggtgcccgccaccacgcccagctagtatttttgtatttttagtagagatggggtttcaccatgttagccaggatggtcttgatcctctgacctcatgatctgcctgccttggtctcccaaagtgctgggattacacgcatgagccaccgagcttggcctcacttttccatttttttttttgtagttttcctcagatagatcttgcacatattttgttagatttgtacctaagtgttacattttggagggtgctaattgctgggaagtttttcacatggcctcagactgacccagttcttccccctttcttgtttggagttctcaatgctgggagttcttatgctgggagtacaacatgccaagatgaggaggagctggttggaacagtcaggcttcgttcctgttccccctaagagcaggatgtccttcagtgccttagtctagcatgttgtgttcccttggggaggataaaacccaaggtaggctgctttctggggttccttggctgtggtgcaagtggggtcacgtgcagtcgagtcttcatctaccctgggcagcttttctgagctttgggggactggcttgtcatgaatcctaggcttctgttgtcccttactgcctatctgtgagtaataaacctgttttgtgtaacttgcatgcatgagtgttctgtctcactggacttgggcaaataatcattgcacagtaaacttgcttcacagtactataaacagtattatgtttttaatatcaaattccacttgtttattgctgagtcataggaaagcaattgacttttgtatattaatcttgtatcttgcaaccttgctatagttgggttttagtttcagatttttgttgtttctgttctttcagattttctacacagacatcacgtcatctgcaagcaaaaccagttttatttctttcttcttattcttatactttttatttccttttttttcttgttgcattaactaggacttccagtatgatattgaaaaggagtggtgacaggagatccattatttttaaaatgaagactatgataggctctacctaataagactcttttgaggctcaaggaactagcacatgtaaagtgcttagatgagacctggaacttagtaagtgttaggtaaatgtttgttaaataaataaattacttagaactccctgtgtctagataattcctagacttggtgacttcactatgtccaactgcaggcagggtgctccagtcaggtaagagagctggggacaagggagttaggtctgataagctatcctgcccaactggttccttgctagacctatgcgccacaaggaggggaaatgacccagactcattatggaaactctcttcgttgtttccaattagaggtgagaatggaagccagagctcctttcttcacttaattttattttcttttcttttcattttttcgagatggggtctttctctgttgcccaggctggagtgcagtggcacaattatagctcactgcagcctcaaactcctgacgtcaagcaatcttcccaccttggcttcctggaatttgtcttttggccacaatcaagagacttggaaagtggttgaagagtcttgctcatttaaggaaaactctttaggaaggacttgtagatgacatggtagaatctttagaaggctggagttcatccttaatttgcattgtcactgggcaaccatcagcattgcattgacactcggcaagtgtgtgccacctctgctgctggggaattgagagtgtaataaattagaattattatgtgtagaaccatatagaattcagcaaaatacctttacatgagtgccattcacagtccagtacactgaagatggcagtgatttcctgtggttttagtaggggtctgaccaggaattaattgctgcagcatctccatagaaaaaacatcatgacctagatccttggcacttccagtgcctgctggctggatccgacagtccatgatgaagttccttccagaggctgaagtggagccaacattgagaacagaattgaattatcctggtcaaggagaggacaagatcaatgtttgatattcatgctctgatagatgggagggaaaggctgttcttctgtggcacccagcatgcaacattctgccctgggaaaagctgtaacgtggtgatcttgcactgtgtgttgttattctctgcagcagaaactaatgtctgcctagagggaggagcagggccacagctgagtgtctgaggagacttgctgctcattcagccagtctaccttggaagttcacctggtgggctgcagagctcctgtccacatgcgcttagtgatttgcatcctccctctctctctctctctttctctcgctctcactcttttagagacagagtcttgctccatcacccaggccggagtgtagtggtacaatcatagctctctgtcatcttgaactcctggattcaagtgattctactgcctcagccttctgagtagctgacactacaggcatatgccaccacgcctggccgattttctagattttttgtagagatgagagtcttgctatgttgcccaggctggtttcgaactcctggcctcacgcaattctcctgccttggcctacatgttctcttaaattcaggttaacaggccagctgagggtcagtgtacctcctatgcagcattgagtctgtgattgatgctcagtgaaggggtgaaggttggttgtttgaaatgataaaccctggctgttcctggcaatggttccagtgagagctgctcagggtccagagagaagaggggcagatgccctgtaagaaatctgcactgctgccaggcctgcactgtgagagcctctcatgccccatctcttggtgtaggaagcatctcactggcttccttcttcagctcatcaaggtggagggcctggtgggcacttatgtcaaccacagaatgctgaggagggctgtccacctaccttttgagttatggaattcagagccaggctcaagacttggcgaagggtctgagcatattggccactgcaggagtgtgccaggaggggatgcttagggttgggggttgaggtgagtgaagaccttggggaaattcagccaaagacgataaggaggagggaaggggacacttggttcagaccatctaaagggctctctcctgctgctgatgcagaggccaggggacgcaccagcgactgcagctcgcccagctggccctctggttggtgcatggccgccactcacatgtcagcaacagtgacagaagtgtggaaggggagctgttcgcaagtcatggtttacccataattgctgcaaagtgggagagccctgagtggctctccatccagtcccagcctggcttggaaacaggatttgtgctccccagggaggctgggtgatagagcgttaaggagcaaccgttgctccatctctggatttgaggtaatgtagcagaaaagaagccagacaggcccaagctgaaatcgcaattccagcactgagcatttgtgttgtcttgaaagttcttctccagctatcagaatcctcatctgtgggaaaaaaaagaggcactacttcattgcttgggtgacggctatgacagagcctgtgtgctcaggacagtggggagtaaacggggctcttacggtggaggagagcccctaagccggctgccagcatttctgtgtctccactgagcaaggagttaagcttctcaagtagtaagcctctaagagacacatttatagaggcagaaggtactcagatatacacgtgccaaatgtgagggcatgcttgagtgtgagcagcgctgtaaattgaaaacagccttgcagcaaagcatgactaattataggacttgggaaccttaccaaagctccttcgtagcattcagatgattgtgttaaagagagcattctagaattttcagctgagtttcagaggctgagtgcgacatgccgtcactttgtccttatggtttgtacccgcccggcctgagaggtgctgtatttgcacatttcagccccctgagcactgacgggtggtgaatatggagcagtggggcccaggctgcactctctacttcgtttctccttcaccctgggcaaaaagctagcaggctttcctgtttccgagctgactgtgtgatctgagctgactctgtgagcattgttttgttcctttgagtggcataagctggtggggggctggcaggggagttgtactggtgactgggtaaggggctcagagggaggggaaaggcagagagagtgggagaactgcagtgtttgatcatggagccccttcgtcacccaccaggcagtgccccccctccacccactccttcctctcccaaaaggccctggctggggcttatctctgcactgcttctctggaatgacgttgcctcgttttgtcctcaagttaaatgaaaggtacacatccagcacacatatccctggtgggttttctggtgtccagacctaatgccacactaaacagaagtatattttttggttataaaagtccaggaatttttttctttactcctttcccacttctctcaagtgtagggagcccccatatgtgccagagaagagaaatgtctccagttccccaggccgctggctcagtgaagttctggctggcacattgcttggatggaaaacagtgtgttccacatacaacctttgtaagaagtgtgacccccacgctggtggggccccactgtcctggagaaacttatgacgttcacatgggcaattctgagtctgtgttcttggataagtggtcctccgctctgcccgaggccagcaccaggaagccacctcgccacagtctcctgcaggcactctctgctgtcctgttatggactggaggaaccctcagcacccctgaagagcatttgtctgggacagacaccaccctgaagccagttgctgtttattgagcaccaactttgtgcttgggactcaggcaagtgacctcctctagtcctggcaaccgctttgtcagggagaccctgttaggctcattttacagtgtggaagctggagttcacacaggcatgctaacttgctccagatcatgcaactggccctaaaacacgcttctcctgcaatactgtcctgcacacaggcccctgtcgggggcacaggcctgggtggggcagcaggccgcagagttaatgcacaacgtgaagtgggagtcgttggatcagcagcccagaaaatactggaagagccacagcttagacctgtgtgcctcctttttttgctttctgcttttaaaatctgtatcctgaggctcacagttctcaccctagaatcaatgcgactgggaagtttttctgctccaggctgtcctttctcacggacaaaatgggggtaataaaaacaacagcaggaatctctgaaagttatgcagcattaatgtccagaaaatatttactgttttggcaagactactaattgaggggcttttatatgctggtaaaagtaaaatgcacaaaaccccaagatacccacaagctgtgtgtataattcagaactgagctgtaggagagaaaaacagcagccaaattcaaccagggattaagggagcctcccattatgtgagaaaaccttggactccacagaattccatccctgtaaagcattggtgagtgagtgacaagcccttcagccaatgagattccacattggaagcaatgacatcatggaggtaaaggcttattcgttgttggcctctgagacccaaccccaagctactggcatgtgtaaaaactgcttctcattggcctggaggagacagtgcactccagaacaatgctttatccggcctctagcaaccaactgcttccaaagacccttgtgtgctttctgctctacccagatgggggttgtgtgtattccaccctggggcagttgacaacacctgagatgaacaatgcagctcatgcattttgcagttgggtttccccaagaatcctgctccacctgttgtggtttttctagtgtcgctgcaggacatagtctgttggagcaggagctgagaaagaccaggaccagaagcagattgctcatttgcttagtgatgggaagttatgtatatattcacctctcaaagcagctgtgatccaggcttttgcagtttgaagtctcttctcctcctcagggaaatgggcctcccctgggcataacagaggtgcaaagagcactgtagattctacagatagcggaagtggggggtgcatttgtcctcatgggcaattccaatgagagaggctcttcattcctgctccgagacagcatttccagctgggaatggaatcttctttggctgagagggtctggttagaactacgaaaaagggagatatgatgcatggttggttcattttgaggtcatgtggcagtaagacttatgagagaaagaaattcaaggccacagacgttttttcctccatgtattatgtgagaaaaaggctgctggatttgaagtcagaatttgtgtctaaaacaagctccaaagttaccagatgtatgactgggcaaggccccaggcctctttgggccttaggtttctcagatataacaaactgttgataagaacacccatcctacatggttgacatgaggatcaagtacagccatttgtatgaaagtattttgtaagatatagcagactttagtaatgttattagatcaaatcatatacgattgcctattttggaggtaaaaccagttgaacacgagcaatttcgtataattcaacctactagttattatatagtgcctgatgcctagatgggattctagtggattctgcggtatgccatgcagcaccctcctttaggactgaacattgattcccacagctaatggaactctgtgtagctgacagctctggctcaaggcttttaactgaagctctttctaggagttgccctt

SEQ ID NO: 15166 - DNA, 48480 bp, Human
  misc_feature (1)...(48480): n = A,T,C or G
tgaaagaaaacaaggtgttttaccatatgcatttttaaatttagcgtagtggatactttgttttaaaaatacataatttgtagaattactgcccagtttgtgtttgaaacataaatcctggggtggacggcattaaattgaaaaaaaacgtgggcatacagtatattttaatttttcatactgaatcgtacatttgcactgtgccttatttctaccgtgttcttcctactgttggacatataaaaagattttccttggaactgtgacttgattagatgctgcagtatgctggatccgggtcggtggaccgcagagcgctcgagatgcggagaagcaaagctggccgctagtgggcgctgtggctccgtggaagtcacggacgagcgtcagcaccggcgctcgaccgggaaagtagcgaggagttcctgccagctctgctctggggtcttgcagacgccgagtgagaagcacatgccttgacttttccatctcacaccctctaaatctctggtcactttgggaagcgcgcgtgtctcctagaggctagtgagacggtccccgcgtcgtgcctgtgccggcgacacgcggggaaagctccaggggcgccaccttcccggggggccaggagggaagggagacgcccgcagagaaggcgggaggcgacgatgctcaggccctgattagagctgcaaattccggcgccgcgtcgcaggaatcgtcttgcaattcccggccccactgactgaaactgagccgtaggcgattggtaccaaaatcaagtgagaagccctcgccgagaggcgtcgggagaagcgcgcagaagccgggagctctaagggtgcgcgcggagtgcaagtcttgcacgcggggcagcgccgcatctgcggagaagggacgccgagcggagcctgctgccttccgcactgctcgagggaaagccgcgccctctgattccgccgagggggaaggcgcccccgggcgcggagacaggtggcccgctactcggccgtcgctgtttccacgtctgcaccgcgcccagaaggcctctcgccgccccgggggcgccctgtgcacgcgctgagcgcttctcctgcccggcttctgctccgctcccgccgcccgcgggagccaggggcggggctcacctgtcagcccgagccccgcctcgcggcacccaatgtcgggaggggatggcggacggacggaccggccgtccaaccagcgcgcggccgcggagccgcgggccaatgggcttcgcgcggcggggcggggccccgcgtttatagcgctctgacagcgcggcggccgcgctgactctcctcggcggggaccgcggcgccggccggagcgaggagctgcgcacgcagcgggtcccggcgccctccccgcacacaaaggcccgcgcgcgtccggagcccgcggcggggaccgagctccctctttcctgccctgggggccgggagccgcgcggactgagaaggctcctgcgcgcccggaggcgccctactccgctccgtgctccgggacatggaaccgcgccgacgcggcgcccgcgcgctcgggccgctgcccgctgcactggatctatagtcacaggcggccccgctcggggcgcagcgcccgccgcccgcgccggtcgtctccgctccgggtctttgtgtcccagcccgcacccgccccgcgcccacccgccagccgcggccggcccggcaccctggagccgcacgggagtcggccgtccgagctgcgtccggcgcggcgccccggaaccccgagtccgccgcgccgccgcgccccgcgcgtgcgctcccgccccgcgccctgagggccccggagagcgagcgcacctggcccggcgaccgctggagctgcgcagcgcgcctcggagctgcctgcgggcgcacgccgtcttccccgccagtctgccccggaggattgggggtcccagcctgcgtcccgtcagtcccttcttggcccggagtgcgcggagctgggagtggcttcgccatggctgtgagaagggactccgtgtggaagtactgctggggtgttttgatggttttatgcagaactgcgatttccaaatcgatagttttagagcctatctattggaattccctcgaactccaagtaagtggcgtccgcgatccccctatgtccccgccccggggtccgccgcgccgtccgggcgggaggaggggtcagtccgcggggcctcggagcctgtttctggaacctcggttccccgtcccccacccccaacccccgccccatttaacttaggtggagactcctcgctcggctttccaacccgagccccgctggaacggacggtctctccgcctttcctcccccgaacgctcccaggcgctaaaagctactatcggctcgggtgtcaagtccgggaaggtgtccgatggcgatacctgaccctctcctgttttcgaggacgaaggacatggccacaatctaggctggccggcacgcggggactggtgggctctggagagaggcggagatgctgcattcgcggggagcgcgggcggcgtggtccggggcccgcgggcgggcgaccggggtggcaggacgctggcagcgaagcgcgttctggagaggggagcctggagtcgctacgctgcccgcagagccctggagccggggcgccttggcaccgcgccgccagcccgagggtgcgcggggagctcgcctgcttcgcaggagaactcgggcgtcgagccctttcctccgcgccggggagacgggccttaggcttctccctgagggcccgccgcacctcggcctcccgcttcgttcataagccggtagccccggagtatgcggtctcgatggccgacctgattgtaatgcacttcctataaaagcttagggccctgcccagtcgacactgctcctgaagccttctccctcgggaccctggtaggaatgggatccttaggatcagatttgctcttaccggactctacagccgggagcgagccaggccttgtggagagtaactttcagtttgggccaccagagtgcattcagaatttagaaaatcccatccatccctaaatctgtgtggtcataactcgtagtcatctgggtattcagtactgtgtatccccttatttcgaatcacagccaaaacatattttacagaatcttggaattgtagtctcgggaaacttggagaagaagtatgcagacattagctggtttctggagaaaacgtttgagatcagaagcaaaatcaatggcctaattgaagttgagcaagttgggcctggttttaggagaaaagaaatgggggattgatttagaaatcacgtcttaaaggagtgtgtccattctcttaaaagtgtcaaatttcaaattcactaacatgttaaccaagaatcccttcatgaaaagggcgaaaacgtcggttacaaatcggtttaaacaaatgtttgtatgatgctagaaggcactttcaacaccgctcatacggagaagttacttagctctgcctccttccatgtagtctgctcttgcatggattatatttttaatgtaaattgttgtatttgctgatgaagtactggcggcggcatctttgcatcgatgccggctcgggaggcgccaggtggtgccggaaggagccgggctaggacctcgcgcagcagcgggtcccggagtccgggagaggcgggcgggcgggcgaggcggtcgcggggaggatnnnnnnnnnnnnnnnnnnnngtcactcttccatgcggaatcgcgcagcgccaggcctcgcccctcccccaggccgcctgctccagccactctgcactttcactgaccggttctctttgaggctgttttttttttttcttatgaggatttaatatttctgtttaaatctagttgaaagcaattccgttagcctcttcagcgtttagttcggtgtgtgtatctttatctttgcgctatattaactattagtttgtgtgtatccggtaggagaattagaaatacctagttgggagaaaaagaaaagtagaacaatagttatttcaacctaaggtttagacgttaataacttctttttgtaatgtgtcgagatggggggtcctggggggaggtgacaggtactcaccactccccccccccattctgatgatgaagatgagtctgtctttccagctatgtccagacctgcgagggccctgcgtttctggaagcctgccgtttgcgcggttgaggttgctgctgctgtcttgtcctccacagcagcatttcttttaaaattctcctgataacggcctgcctggatgactggataatgtgtgcctggaaaaggtctcccttgcagctgaatgctagctccagagatcagaaagatttcttcctgtaggagccataggaaagagtcctctctaagtttttgagaatgcatacaaccccctgatgacagggggtcgctttccttggggaagttttatatttatttccagaggaaagtttgaatcggtaaatatgatgtggcaggaaggtaatcaaatgcattgaagtttcacatcagttcctatgaactgtggaacaattcatttgtaatgaagccgccatcagtaattagatttgtttcattcagaggtcagcttttttagcaggtggtcgacacagggagcatgcagcagctgtttggatacagggtccagaaaaccctttgtaaattcagcgtctccgtaactactttaatcacattgtcggctctcccgtccctgactgtatgtaataatggaaagatgtcctgcgtgctgaaacagtagctgccctgttaggttattcacattgctttgatacgttctggtagagttgggtccgttgtagccattttggttgtttaaagttttggttttttttttgttttttttttaattcagcagagaacagtaatgcctagcttccgtttttaacttaacacttcagtagaacattttcttccaagagggagattttggcctaagtaaagtagtgggctcttttttaaaaaaaaattaattttactttaatgtgagcaaatctgtattggtatggtgttctgcaatgcattacactgactttgaaaatttcgagtactaatgccttatgtctggggttaccattccctgtgcatcacatactagttagttaacatagcattttgcttttcccatgtaattttttccctatataatactggattcctgatactaattgacttgatacaaaagaatggctggatgatatccagataacgtataatacatgggcttcaccacaatcaggctctgaataaatacagacctgtcagagattgataaaataaactacaatggatagtgctgtttaaacagtccattcaataacatatataagccagcctgccttccattgtgtctgaaattcttatttttgtaggtaaacaaatgcacattcagcactgattgaatagccccttgaactatgctccacagtttgcgtttgggttaatcttgtcggttttaatatagagagaaaaaagctcaaagcaccaggggtggaattgttagtgctttcacatccacattcctcacattttgtcaggatgataaactgtaggtaatggactgtcgttgttctgcaggacaactgagccaggcagagcacaaagactaagctaaagcgatacctcacaacatgcttggtagccttcttttcagatgagaatttatttgagaatcatgtgtctagggactgcacatcttaacctcaacagttacagcttcaagccccagaaacaggagctggaggttaagatgatttgctaagcacctggttctaaatcttttacaaagcataagctgttgacgctggttctgccgacgcaaagacatgcagatgactccaacatttccagaggcttctgacttaagctaaagtgtgtggacaggtgaattcgccatgggcctggagaccagcttgctaaaaactatgtgtttgaatggttcctccagacagagtcagctgaagaacaattggtggatttatattaaaacctcttgtctgtaaacttactgaggtgcatccttcggttggtggatcagtgagataattgccttcagatggacattgcaactggagcaactaaatccttgctgtctttccttcctctgaaatcttccaggtagctcccgagagcttcagtatgacaccaaacttcgggcgacgttttagagtgcgttcacctaatgggaaactattcgagatcccagcgtgactgcagtaatgcgtcataggaatgggagtggcaggggaaaaggaaatacagattgtagaccctaataaaaaaatttttaggaaagatatttctttaacgttttatgagaacttcattcttaaaatacttaattgcaaattagacaaatagaagtgctcttctaaggaaggtgattaaactggtcctcctatcagcctaatctctgcctgcctttgctgctgacataaagaacctgtttttcaggtcacttaatatacatctacatagatttgcttatgagctcaccctttgtgtagcggagtagagccttaaagaggagtgctcaactgtttaaaatattttgattaaaatatgcagaacccatagaactataagcttctagtcaggaattagctctttcagggaacagctccccccttctttttaaggggggaattagaaggaggctgggggaggaatataagaacagcaaagaaggaaggatagcaaatgggacatgttccgaacagcttggaaaaactcctgtggcttcattgtctctataaagccaaagaatacaaagacataagcaattcagcccttctcccatgatggaagatgtaaaccgttgacatgcctcccctgtttaacttgtttaattctcattttaaattcagcacgatactagccgtgtgaactctgaagatttctttagtaatccattttgtagttccgaatcaaaaacaaagtgaaagggtctgacacaatttgcttttatttttaggcaaatcaaccctggtcatagttaataaggggattacaactcagactaggtctttacagatgtgatgtaaatcaagggcagagtataaagaaactgatcccttttgattgaagtatagtaaaaaggcatagagaaactagcagcagtaatctgattgtatggcaataaaaccaccattttctgtctttcagataaaaataatgtggtaaatccatgcagttcataagatgtaaaggcagataaagggtgaagccatggcaacatatagattagcttgatgttagaaatgacacgtctctgaaaagggcgcgggacgaaggcccttgcctccaggctgttgggcattatgtgagaaccacacagacttggaaactgggattaggaagtatgaaagctctacttgtggtctgggatggctgaggcagtaaagaaaagctgctcagttcttgctcattggtggtggataatatggcaaaggtagatttcattgactgccttttttatagattgagattggggctgattaaaacttcagatcactgcagttgttagggcctgggagattttcctttttaactcctggcctaacagcagcagccgttctgtaggattaactgcacttcgcggtcgttgccttaatctatttgggcttcaggcagggacatgctgggaaggaacagagaccagaggggataggtagggctggggttatctgaaaagaaaacagagaccttttgatttcagccatcttttcagacccagctccctctcccgctgcatgggagaagcaaaggtaaacaggacacattgtccctctccctcagccacagagctcttctgtgagttttgtctttcccaccctggaaaaaaagataaaatacaatttttaaaaggggagggaggaatttagttttaattcaaatgagtagtaatccaatatgccaaaagcagtgggctctacctagatgtaattttactcgtaaatgtgagtcttaaactttgagttgaatggggcaggctgttagaggtggtgtaaattacaggattataaaaatgttagtgctgcccagccttaaagtcaaaaacagaaaaatctctgtgctgttgagtcttcccgccctctctcctgaacaaccttgtaagtaagctagacttttgtttttgccttccatactttccatttcagccattaaacaaaataagccattgaaaccacgattgggttccatgcagagtgacatccgcaatcgggtcaagccagaaggaaatacttgctcgattgccccctatttggcattacaggaaagtctccacactttggaagagtctgaactctcaagacattgaaaatgccaaaggctgcaaacaccctgtgtctttcttgatggagtgcatcttggtgtgttttacaaaggggaattcagtgctgtttttttgttgttgttgttgttttttttttttaaagagcagcatagggcccttctagactcttggattctgtgtctgacaaaaatggtcattaaatgagcaatattataatttagacccatttcactgattttgttccaaattctcaactgacttgagcatctgtttggggctgtagatacattgcccttgttgactgtttttctcgtttctatgggaattactgtagccattactatgtagctttcatagactcaaaacatttttaaagtattgcatataggctggccatatccagtgcctgttactttaccttctttttctaacttaatgcagcagtctgtattaacagatccatttcatttgtctagcttcatcagagagaggctaccccctgatttacaggctgctcacatccaagcaccttgcattctacacttgacagtgattgctaatggcccattcaactaaagtatttgcttgttaacagggaacagaacatgataaatgtccagcaagcttgctgcctccttcagcttttcaaacgcagactggtgcatatttatggcaggcaaatgacaaaagaaaaagctgaattgccctggcctccagctttctatcagaaacagggttaaagtgattaaagcaatcattcaagaaagccctgccgtttgtttactaaccttcatccaacatttagctttgtagtctacctgtgagaagatatttcagaagtattagagataaggaaggaggatctagcaaaccagtgaaaagagtaggtgaccagttataaaatgctttccatgcacattgaatgccaggcgaacctatttctgttattccagcagacaatcagcagtggctctagattattaacatattttcctttcatgtataaattcaaatatgtaattctagtccaaagcattctgtggctggtaagcacatacttgctgatttcaaataagaaaacatagcaagggaaagctccattaaacaagttgtttctgcccttagtaattctctaaacaagataggaagaaaaagtggacagtagtggagtattaatagtgtgctcttttcattctctaaagcacgagtaagtaagcgttcaaactactctgtggtgggcatacatttagagcgctgtgaatgaaccactgctgttctgccatacttaatttatttatattattatttttattttattgttgtttttatgtattattataattatttatttatattactaatttattttctcaatttaaatcctgttgcatccaattttaattacagtttttgtatctgccttcccatacttgctacccacgtccccattgccactgcggccttatccatgttttctgtgtacaccactctcgtatcaccccagaataattatgagtgctacccagacttttgaaaccactagagtcaacatgtttgtctttgaggaaagccaatgatgctttagcatttttggcaggggtggatgtgtgtttaagtggggtgggtgcagctccttattgtctgcctattctactgttgttcccaatccacattccctgcggggcacctaacctgtgtgcatagcaaagaatttccgaccttcagagccagaagtgtttctcaattgatctcttccagcctagggttatagctgatgaattataatccttgctctttccacacctttacctgggcttaccatggccctaaaacatttgcccagaatcagaattgtctcatgagtgagtggggcaaggcaaatcctgttccagaccagctgagaatgtacctagctgcagaagaagttagaaagtgtcatcttttacttatctaccagaactatattcgaggtacattttagatttaaaaaaaaagcaagttctcgtaggccttgaatcccccccttgctatgggaaaatggatcattattataatggactgtccagtaaagttcatgatttctcctagacatgttctctctctttatgacctagatcaagagtgatctctttaagtcttttcttcataatcccacagcactttgtacttagatgtacttagaaagaaccatatacacggtacgtcatgattgatatgcaagccttcaccactctacctgtcctaaaagtcagggacacaccttcttcatttcatcagtccctacttctatccagcattggcatccagtaagtattagtggaatggacagacaacccgaatttgtgctgatggcagtttaccctgttttaactgtcatccttctgctactagacatggatgagacctgagacgatgggactgctcagaggtccctggctcttgaactttagggcaccagaatcccctgcagggcttgagaaaacaggggtttctgggccccacccccagagttcctgattcctgaggtctggggtggggcttgaagatggacatgtttaacaagctcccaggtgacgctggcaactgctgcctcagggccatgctgagaaccctcgccctacacaaacctttctgggaaaacaactcaacattaaagctgtttggggatctctgaagaaatctgtagtccttgccttgttgggggagcatcagggatctaaccattgatggtggagtatttgttgttaattcagcaagcaactattaagtgttaggcctgttactcggctctaacaatacaaggcagagtgacctgtaccctcgagatttaaagtctaagtcctgtagagagaagcccaggtgggagcaagcacatttagagttaggtgcttggtgcaaggtggggacacagaagaagggaatggcatttgcctctggaggggtccggaaacagcctagggaggaggagcttgagtcttgaaatactgtgggcatctctaagcaaagtcacagtagacagctgaaataaagaaaatagtaagcaagccaaagaaacagtatttcagccaagggcagcgtgtgtctatcacgtccacctgtgaacacgtcccaggattctctgcatccggccattgctcaagacagatccctcacaggaacagctaagccactgatttcagctacctgttcacgtgagaattatcagtacctactgcttttcaaaatgagtatgatcatggataggtgaggcaattcagtttcgcagagacagtagggcaagtgccactgtagtttagttaagggcacatgctttagagtttggctatgtgagtccaatcccagtttagccatttattagctgggtagctttaggagcagtagccttagtgtctctcagttgtcccatctctataatagggacaataacataatagtgctgaataaaagagtaacaaaattttggtcaacatttaatgtatttaaagagctaagctccgtgattggcacaatgaaccaatcaatcaaacaccagttgttattaataaaagtcagttgaatatgtactgtgtgcctggccgtggttcaatttgcctttgcatacaaggaaaaaattaaaatactctgttaataaagactatagcataatactttcaccttaaacttcttgatgttaatttattttgtttacctgccaaacttctactcattccttatgactttctgctacatgaaacaccctttgtaattcttttgtcctattaaattaagttctctctcctctgctttcctgcttttggtgctttctaataacacttttaaccctggactttctcattcagctgtgcaactgtggactgagaggaggctctttgaattcattttgtatattctagtagagagtactgtgagcagttgggttgttgaatgaatacattaattcaacctggagggatgggcagtattgcattttttacattgatattacatgatatttagaaaactgcttaactggtggacgttgttttattaacagcattttgtgtatagcactcactatgtgccagctgctattctaactgcctgacaaatactcctgaaaccttcatggtaaccatatgagggaagcacttttaatatatccataataccaacggggagactgtggccaaattggttaattaacttagccaaagtcatattgaactaataagtggatttaaacccagctagtctggggccagggtccctcttttaatcttctgcctcctgcttatgctgttgcatggagtagtctttatcatataactaaattaagcatgcatttgcttaaagcagtgcatacatgatggatcaaaaagtttgtggtataattggtttaattctgtcattatccattttgatttatagtcactttcttatgatggtcgtgtagttttaaatggaacctttgaatctttgatataataaggttatgtcaaatcttgggtataataaggttatacccaatggaaacagaataatgatcagcccatttaaaggatgactggagagttattacaatacataatagtcatgcatatattgagtagtattcctttggtaacattttccttttaaaaattgtaacatttgattgttccttgttgggagaaaaggaggtcagatttttgaggggagatccatttggtgagatgctgagtgtgtgtcaagctaaggagatagtatgacatcttttttagagtctagtcacaattaaatgccattttattttggattttgggatccgtgccagcttccagcttgtcagagctgagaagactcaaatcaagtccaggcttatttctacagcaaactgggattctggcttcttgccggtggattcattcagtacagcccatctggcttttgatgttctgcaagtttggagccatttgttgaaggaagccaggcggtgaatattggtggtcctggggttctcttgactccaagtggtgccccttggtttgcattttcaccatgcttagcatctgcttacctggagaccatgcagccgccggccagaggtctccaacaaccaaatcttcatgccttttagaactcagagtccccagcacatcctccttcctcctccttgtccaattactttcatgcagttctcagtagctgcttgtttgaatcacttatagtatttaacttctagggtgtttttgggttttggtcaaggtaattccaggctgaatgtggtgactaagcaggaaataaatgggtcgtcctcaaagttacagtggagcgctgtttctattttcctaaggtacacagttgtgggggcgatccgtatggaagtcaggaacccagtctgattttgcttccttttgatggtagcagtacagacctggctgttttgtagcctgctttgtttttcttccttttcttccctaacttcacgggctgtggcaaagccctgagacgtgcaggaaaatgtctcctgtcatacgcccacagcagacctagccctgaccctcctctgaagcccaggaaggaggtatctgtgaagcagcctgcttgtaaagcaattgcacacagccttgtaaactgtgttactgggctgattatacttgattggcaaggtgaatctcttatagcaaaagagaacttggagagttttatctcatcttatgccttattaatttgttcattctttaattacacagccacctattgagcaccctatttatgcaaggtacctggtcgggggtcagagggagggtcccatggtaaacgagacagactcaatcctggaggagcaggaatggcagcccctcgctgggctgttggccccaccaaaagggaaaggtttcattttaataatacatgggtgaatcatttttgtcaataggcaaaattctttgtagttaaaaaaaaatatgatggtaggaaggaaagggatgggcagagggttaaaacaaaagatatgctctccctaactctagattgtagtattgttatgcttgtcactgtagctgaattccatttctttgagttttttcaatgccaaggcattccctgtatgacttacgtgagcctttcatctccgcgatttttcccattcaggtaaatgagcaaatggatttgaacactcatatctaaaacaagagagaaccagctggaaatgccctttgaatttctttctctatgtaaaccatttttctttctggtgcctcacctataaataacaggagttccaccttcctttatagactcttgctgaaagcatggtttggaacaagaccgtacaggtgcacacaaattacagttgggaaagaagcctgcagtgcatcttgtctctgaaggttatgaaatcctccttttagtaatggagctggcgtgatcaagccagcaggatgaaatttggcatttgtgagatcaccccccttctcacttgcccactgtacatagcatcccagccttactcttcaaatctccacattttttcttatctagctacaaaattcataggctgatttttttggggtgcgtgtgtggttttttttttgtttttttggtaaataaagacctgcatttttattttgatataggtggttgagttttgtctttaatttcatgacagagatttaactagtctcaacttttgaaaagacaacaatgatatttggggatcacacacttaaagttagatttctagatgattaataccaaagtagatgattttttagcctcagccatttataggtatgcccttctgtgaattttttatgacagtgaaaatcatggcacagataaaaattaaataaatacttctgttattttcctgaagaaaaaaaaaaaaagcttaaactatgagaatactgtctttgagcactttaaaataaaattgacttcagccagcaggattttgagcattacatcacaaataaaaaacaagattaacatcaaaaggagtcagttttcattcaattgtgcagcactgtgggctgtgaaatttaatattattttgactcatatgctaattgtagactgacagaggaaaatggattgtgtttaaataaaaggatacacagcatcacacgcagctgtatcaaatacaagttgaggtctttgggccaggaactgggggccctctagctctgttattgcagattcaagtttgacaaataaaactttcctttagactgtagtttaattactttttttcaaaggtatgcgtgatgaagaggcacaaatacacctcaccttgaagagttgctaaactggtttgtgtgccgatcagttcaccgtgtgtttgaatttctgtgcttctcatctttccttttcttgaaaagattttgcttgtcattggtgtgaattgtaccccccacccccacccatctagtctttgctctcagatttataacactttaatggttccaaattgtatagcctgctcttagaccccttttcttttccttgaataaatcaggttcatgttgcagacgatatttgttttaggaaagtgtgaaagaaggggcacctgtgaaaacacgcaattgttccaacacacatatacatccaaattaaagcagaaaatgtcaaagcctccaatcactaccttatttcttggaggtttaaagccgctgagaagatagtggtgccctcgctggaagttttaaggtaattactttttactctaagcagtagtatctggtaacctaattccgtataaacctgacaccctatcgctacaccccagtatttctctgatttcagaataagtctgcgtagaaacttgttctgatgttaaagtgcaaaagggggcagtaaagtgctatccacaaaaaaggaaaaacattttccaagtatttcttattactgcctgtgtctttcgtaggccctgcctttatttattcattttataacaaaactcttatgtttggggcattcagagaataccttattaagctgttgcagcaatctagcattaaatggaagacatgcaagactgaagatcctgcctgtttatgaagtgtgccatcaaattcacatgctcatgatgcagagtccttctttgggagtattcgtattcccaagtgcacagagcacttcggaaaggagccttggtctttggtgttaatgctctcctagctccgtatagatgtggcaggcccaaagtacatggtggggtgaagggtcaagggtttgggcttatccagagcagcgtgcatcctttgtcaggaggtgactggaaacaccagccaattacagcagaactgcagactgctcatctgcattcggaattgcagatgaaccagtttgtactcgacttctcttcttcactgtaggctttgacatttaattaaaaattaaagccttttatggaaaaagtacatgttttccaaaatggggtaaattcgaagtatacttgatacagaacactggcttgggaataaacctgtgatattacatgacttttggtttgcaactgctaggctgagcctctttgtaaagctgggatttagaatctttgaaatgtttgtacagttcaatgattaagcataaattgtatatattccctttttttcacttatttgagtaaacaagtttgttactacagcttctgtggactcagagatttatgtattaaataggccacaacttcaactaggataattttatttatctgcttgttagggaattgcatcaaaagtttaagtctgtaggcattaaatattttaaatgcttatttttaaagtcaattatgaaagatagcacaaagtttttctgaaactacattaaaaaaataatgttttaatcttatcacaaaagcattgactatttattgcaaagaaaacacagaaagctaaaaatcattctaagtccaccattcagtagcccaaagtggtctcaggtaaaggcggtgtgtgtgaccatttgtttatggttgtctccgtgcagtcagcaaaataaacagaacaacatgccatatattattgatgtgtatattttcaactgaaattagccatctgcttacaatgatcatatacactaatggtataattttgaaatgaaaagaaaaataaaataattctttgtggagagtaatgcgaattgacttatgaatctcgccctgcttggcagtttgctctagaggtagaagagctttatgtgtgggcctcctccccccccacacatttattctgctcacacttgcaccagcatccatgtcaggactcaccttgtcctgttacatgagtaacatggccctgattctcaagtgcatgataactgccataattacacataaatattaaatatttaaatagatctttacgtgtgtaatattaggtagaagtggctctggatcgaatctgatgctttttaaatagaagctttcccacaacatttccaagcactgtcatcgtgtctgtctcgatttggggtttacctggcctagttatctgtctgggtgtagaaactggtagttcctgtttgtatcttttttgttctgatctctttattctgtgtcagctaaatattcttgcagtcagttactaacatattaactcatccttgtttggaaactttggcatatccttccatggtttccttccgtggacctgtcgcgtctctcaggagagccaccaggtatattgtcacacatttcgcatgtattttcagagactacagcagcatcaagtggccccccagcgatttgggttttcttctcggttaatctacactctttggccaaccgtgagaaaacttgtaagaaggcatcagatgtttgtgctaaggtgcgtgtagtatggtcagaggaagaaagaagcagggaaaatggagtggccgtgggtgggaggggaagcagggagtgcaatttcgggttcactacacagctctccataaacttctccactgctggcttcccacggatcctcctattacactgggcaaagtgcagaaatagatcaggcgaccactgcctccgtccatttcccaggcaccctgtgagacccgataatgcaatacaggtcagcagaaaagtccagacttgacatcccaacgtgccatggtctggtctgtgaatgaaaatcacatgaggtgacctctgaactctaagtggctggtttatgttttcagtgtattaggcccgtgttttaaacaagcatgtgctcgtagtgtaggttaaaactttctgttgtcttcattaattatgctgtgttctagtctattaatattaaagaatattgtgttgcataatgactaatttttttattttttggagacggagtcttgctctgtcacccaggctggagtgcagtagtgcgatctcggctcactgcaacctccgcctctcggattcaagcaattctctgtctcagcctccgagtaactaggactacaggcgcccgccaccatgcccagctaagtgttgtatttttaatagagacggggttttaccatcttggccaggctggtcttgaactcctgacctcgtgatccacccgcctcagcctcccaaagtgctgggattataggcgtgagccaccacgcctggcaacataaggactattttttaaagtttttacaattatgactgtgaagttgaaatgtctaaattattagagatccagtttagattactaaatatttatgtctaattgagatgattagacttagccaaagtatccatgtagaagtattagagtctagattggtgaaaaacttgaaaaagcttggcttaagttcaataggtaatccaagagtaaaaacagattccaatatcagatcttttcaccatagtcatgttaagtttggaagccctacttgagtgtttccagttttttccacattatattgtgtctatatttgattcaaaggcagggcatctattgtcttgcttaggactgattcactgggaaaagccactggagttgcctatttccactcagtatgcctcactcttagagtagcttcccatggttcccaggcaggccctccagtgagaatgcaccaagccacacgccatggcctgggaagcagtcctgaacctggagattgtcttgatggaaaggaagaggcagccttcccctcccaggaagatagtagagagcctgctctgacttcgctcagggatggaactggtctggctcagttctctctcctgtgtgggacatgaatcactcttggtggtctttgctttttatttgggcttaaaatcagcagactttattaaatgacacctctctctaaccactctctgtctgggcgaagtttaacaagaacagcctccccccatgtggtatgggttgtaactgtggcggtttccctctgctgtttttggttacaagatgaacattatctgaacacacagaaagaaatctgtatttggcatccataatggaaagtcagtttagtaatttaaacttagccagttatcatcatcataattctttttaacactttcaaagtcagcataggagaagtgtattgttgaatattacaaaatatttagggcatagatagatgtgctgtgtagtttgatttgttaatgtgtctaagcaatcaaagcaacagaattcaaatataaaccccatcacttccaaaataggaactctgtttactgacttgattataacatatggaactcaattgttttccattaaaaaatgatactattaggaaactcaccccattttcttttcatatatattctgctatttgcataattgtctggagtccatatgtaatattaaatgtaaaacacaaatgccatgtagctggtctgtttcttcctcaccttttggttcctggcctcctggggaagggttgcacatctgagccgtggtctcagatgactgcctcggaagaagcctcttcccttcaggcaccactgatgtgtgcttggtgtggagctagactttccctggctctccatgtgacgctcacatgtgcgtgtcttgatttcccttaacttcatggcttatctatgaacagcttgatttgggggaaaaaaatgtgtttcccaatgctggagttataattgaatgtgctgcagtcaaaactgaaatgtgtgcagagaaagggggcttttcctgtcatgctcattgggcaccagtgtgtcttcacctgttttgtgtgttaggtccatgcgtcatgctgaaatgaagaacatgggatgtatggggctttggacagtgctgagccaaaagcaagtgctcaaaagcagctgtgtttgtattattagtggttctggaggtggctgattgccttgcattttaagtagagagggattgtagaagactgccaatacttagaactttttccagagaggaagggtcagaaactgcatctgcagggctccttgctctccagaaatgccagtgtgcctgggagggcatcttcagaaatccagtctctcctcctcagtgtgtcctgtaccgactcagtggttctgtcttcagaattcctatcatgtctgtgatctgcaaatagtggtatttaatttgacttcaatttgtataaatgttagcttctatttgttcattcctattttttgttcaattaatacattatttattgagcatctactctgtgtcagccccttgggtgtttaatactgaattagtcacatgtgggacttgcctgccctcagggagctagactataaattcctaatgatcagtggtctccacttttctgtcactcataatgtctggcacaacataggttacttgagttgttacactcacagtactgttgtttgctgccatggtgctttaggaagtgtgagagttcccgggaggcagagtcaataatgcagactacacgtagtgaaaacatggccaggagagctgtagttcaggctctcagctcaactgcactctgtccactgagaagccataatttcttcacttaaagtgactgtgcgctatggctgtttatatatacgcttaaaaagtaaaagctgctaaaccactcaaggattggggccttttgtattgatttaattaaaggaacaatcattgttttaatgagctctagaaacaattacttttgaagagccgaggatcaaattcttgcctcacgttttgccacagtgtgttctgaaaggtgaattaatgcttttggaatcatcaggaatagtgagctttgtcacgatttactttttacaagcgtatctaatatgcatattgaaatgtgagcctccccaccacacttccgctttgataagcatcccccggattgccgtcactgaccattatagatttttaacaaagttggacagtacacactgaatgaaaactttacatcaaggaaggcctggcgtgtttgtaaaatgaattaaaaggctcattaaatgatttatatgacttacgccttctgaaaatatggcctcaaacacagagatccccaaagccacaccgacccctgcgtcccatgttctcgacctcaccgcatcagcaccagcaagaactgtcgctgagacggtgagtgatgagagtcaagaggagtgacttgcatggcctgggaggaaacctcctgtgaatctttagttaagcaggaaaaaaaaaatcctcatgaaggaaacaggatcttgggagcattttgaatgaagaaggagcttagtgagccaaacttgagacatagggtgtaatgtgggagagttttaagatttgcagagatgtacagcttgggagggggtgtaatgcattttcttaaaagagctgaatgaatggttgaggaaatgggtacatctggtttggttaaggatcctaatctctgaagcctgggatgcccccagggcttgtaatttaggaatacttcccctaatagtagctaacccttatatagtgctgtctgtgcaggctacaaaaggagcagattaaggatagaaaaggtttggagtgtatgagaaaccctaggcaggaattgactcctggtgtttgtaaaccttaaagatgtcctaaaaaggtcaaggaataagacaggagaaaaaggaaatgtcaggaagatgatcaatttaatgtttatggaatttagtttgtacttactgcccggcatcttgcctgaggtttttaacctcagcagcacatcagaattactgtgtgtgtgttggaggggctgggggagataaagaaattagcctcatcccaaacattctgattcagtctgttacttgagaaactgaattgtgttttgtccataaagaagatgaaattgtctacagagaacacattgccattcacaaggttgaggggataccacagagaggctcccactgtgatttgcatttgtcaaaagttctagagaattcttcaacagtacacacatggttgttttaaatatatcattgttataaaaattcgttttgagttctgtttcacagaaagtttttttgaatgaatgaatgtcatatatccttgctaaaggagctcagttaaaaaaaaagggaccatccttctcttttgggggttgtacagtaacacattcccaagaaagaggtaacagccacatacatttttcttcccaataaagagtgtgggtttttaatatgaatccatagtatgatttctgttatgttttgtgctgcttcataaccacactcatgcacttttcagaaaattaataccattcattagcataaatcataaactattcccttggtatgggtttgaaattgggggtgccctatcatccttgctttatctcttagtgaattatgaccctgtagtcatcatggctggtgggcgtctctggttaaagaaagggttggattggaaggattcagaggcgattctttgttcttaggctttaatattttaatgagcctgcaggcttggctgcttacgaaacgagctgagatttctaagtgtgttgttagtgttagcacttgtagaaggatgttcattaggaagttcttgtttcagtttttcagagaaactccccattaagaaagatcattcaggaacatggctaccaagaaagaggaaagggaggagggaggctttcagctataagcattaaggggatattgtatcagtagtcttagttctaaagatttgcttctgagaattaattggagcaaatacatctcaagggaagaaaaaaaaagatttatagggcagggacagtagttgtccttgcaagtagaggacacttcattttgcagctgaatcaataccacaactaattatttctggttatcttttacgcatttgtaagacattgcttttgttcagtgtaataaaaaacccattgtttgatcagtgactgactaattatgataagtaatttgaaacattcttgatgaaacttgtctgttaattaacatcaacagcacagggaaactaacaggacaacaaagtattagtggatccactgttccctccaattgacgagctttctctgtggcatgcccaataaactaaagctgccaatggttaaaaaataacaaacatgtgggagatctgactcaccacggaggaagagttatggtaaagttacacaaaggagtactgaaatattacaagcgagggggtggtaaagaaatgtcagcaggtagcctgatcctacagcttagagtaaggaaagtggtttctttctgtctttcctttttcttttaaagcttaattccaaaatacattcatcccatattgatctgaagtaagagacttttgataaattaaagtgtgaatctgaaaatgtgtagtttgggattatgggcattgcctggctatcttgtaactgtcattaatactgttaatttttatcaactcaatggcttttttttcttatgcttttagatttctacctggacaaggactggtactatacccacagataggagacaaattggatattatttgccccaaagtggactctaaaactgttggccagtatgaatattataaagtttatatggttgataaagaccaagcagacagatgcactattaagaaggaaaatacccctctcctcaactgtgccaaaccagaccaagatatcaaattcaccatcaagtttcaagaattcagccctaacctctggggtctagaatttcagaagaacaaagattattacattatatgtaagtataattttattcatttattttatagaaattaagataagctatataggtttgtatcaattttttgtttccttaaaattattgtgacaaataatttgatgaaaatctatgtggaaaaattgtcccccccccctttttttttttcaaagaaaacttcattgaatttgggaccctgtgctaccagtattcattaagtatacatacccaaagagaaaaaaaaaacactagaattcttaatagtattgaaataaatgtattatatgaatatattcagcatctctactgacaaaaccatttttaaggaccattggtggattttgataggtaaatcttgtgcattgccttttctcttcacccatccatccattcattcactcattcatttcgtatttattctgtgccagagactgtgcttaagggctagggattcagcagtgaaaggtggtaaaatagcatgttttcctcaagaagttaacagtctagagaagatggagctcataaattcgaaagatggggatgacaggtcacattaaaaccagattcagaagaaaaagacgaaacttggtttgcttagtacattactcttttttgcatacatatatataatttgacacgctgtttcaagaagagatggtacgtatcccttgggtcatatctgaggctgacttgtgaggatgtgaagtcagctgatgagcacatttggagcccacgcctactatgtgcagatctctcgtcagcgtcattcccagggccccaggtggtgttaaagtctaggtgactcagacagctgttcgcgtcattcaagcaatgaagtcttttttcttaatttctttggtttaaaattatactcataattaattgggttgaattttccagtggcttggttaccatagacttcagtttattagggaactgctatctgccactggtttattatttgccccaaggtggactctaaaactttaggtaggagactcttggtgatcaaactgaaactcttgcatctcaacctatgagccgcactttattgttattttatttttttagagacagggtctagctttgttgccgaggctggcgtgcagtggcatgatcacagctcactgtagccttgaactccagggctcaagtgatcctcccacctcagcctccaagtagctcggactacaggcatgtgccactgcacccagctcaagagctacacttcaaagcacagaatgaaaacctatttttaaagccaacttgatacatagagtagcttaccaagaattagtaacaacaacaacaagaaaaaaaagagagaatgtggtagagtatatacttagtaaggagtaattattataaaataaaagcattctgaaatgaaacaggtagatggggtggccaagtatgcagcatagtagggaaatctttgaaaatgtaaaatagttaccaggtaaaataaatggaaactttaagcttttggaagcctaacaatgtatttatattagtaaagactttatttttttattttattttattttatttttgagacggagtctctctctttcgtcaggctggagtgcagtggcgtgatctcggctcactgcaacctccacctcctgggttcaagtgattctcctgcctcagcctcccaagtagctgggactacaggtgtgcgctaatttttgtatttttagtcaagacggggtttcaccatgttggccaggatcatctggatctcttgaccttgtgatccttccgccttggcctcccaaagtactgggattccaggcgtgagccaccgcgcctggccttagtaaagacttttaaagtaagactttttcagtgaaagctactgttaggcatgacatttacaggcaactgaaactgatcagatgcatttattaagaaggttaatgcccctaggtggggtgggagaaagaaggtcgtggtacgggaagaggggacacactagagatgagatgccctagggcagtgaacgcatgtccctaatgcgtggatgcagcccacgtccaccgataatgccgacacacccagagtctctcttcttactttagcttatgacttcacgaagaatgctttgcaaattctaagttcgcactgggcgcaagtggaattttagtaaacattaagagtttaacctttagtgtgaaataatatgcaagatatgcaaataattgtttaccaacatctctttgcttaatgtggtgagcatttaataattgctttttattaatacatgagagatttgtatttagaagcagtttaatttataattataatattaatctacacaataacgacatctattattttctttttttggaaactcttcataccacactaacaggttcattgcagttactgaactactctggccatcagagctctccttagagttacgatttaccatgcaaaagcatatggtagcctgggataaatgaatctttcttaatacagaattgagggtctcaagtttgaaactacgagaggctatttgaatgttgctttgggggactgtcataagggctgggtggaggactcagggctaagaagtttgccaggaagtccagttgagactttcagcagagttgaaagacttccacgatggcgtaggcagaggaaggcgtttcagatacttgggaaaatatagaagccaatttctcacccaccctacagcaaagctcattgatctacaagtttccctagaaaggaaatgggaaatgcagagaacaaatgttaaaatagttttagaaattaatattgactttgtattgcttctgcataagttccaagacaccaaaacaatgaatggattttaaaaagtcactactttgcatatcagacaaatgcacacacacacacacacacacacacacacacacacacacacacagtcaagctctgtactggcttttttgagaaggaaagtgtttgaagttagtaatttttatatcagtacatttataaatagtgctaggtagcatgacggaaagtattaaaatttacatgtatatttttaacacttcaaatcgttggttcactttgagacagtaaataatattagcatttgagttcagctttaataaattctacatgggtttaaccccaaatctgagtgtctagttggtaagcgccttcagaacgagcagtgttataataaatatgttattgtgtgctggtttctttccatggagaggaaaaagagacctgatgctttggaggagtgcttgacttttccccagtgaggagtagtccagagggactgacttgcattggggagtaccctacatgaacagcatttcagaagaattaaaccaggaacctagagtcctacttgctagtcctgcttcctaagcttaatgagaaagtcaattttatttctttgaactttaatttatttccctaaaaaacgcttttagtattgtcattgttctggctaatgatggcggtctcctccagtttcaagccaccttagggctgggcatacaaatgcaatataggatcacttgttagtgtggtttcaaatggacatgatcctctgtaaattctttaaaaacatttaatttgatttgtggtgttacctgctttaaaatatagtcatcacacttgtgagtttcagacgtgaatatgaatttttaatttgaactgtatttttaaacacactaagtattaactaagtccccttaggagatatgtggcaaactgatatgcatcctcattcattcttctcatagatggttatttgttttttaacttgtggcaaaattatatatgaatggtcaccgacttacaatagttccacttaaatttttcaactttctgatgggtttattggagtattaaatgtattttcaatttaatgatattttcagcttaccttgtgcttatcaagtatcaagacatagccccacctaagtcatggagcatctgtatatgggtttttattcttgtttagaattgactttttcaagtgacctatttcagtaattagccctgggcctgatttgcataatgagatctcctaatcttcaagtaatgcaaagatggagatattatggccatgtggtctgaagagaccttttctttattatgttcagatctttaattgccttaaaaatagagtagctaatttacctaacctctagttattttattattgtctttaaagttttttttaatgttcatgaaataactgttctgaaattgcctattttcaagggaagctgtgtcttagacttactaaatgctccagttgatactgggaaagccttcttgtgttcgtagcctttatccgtagagttttctttgcagcattttctgtgcctggtttagtttcttttcagaggcgacacccagagctgaatgagtcagcaggtttggtgtgtcgaccctttgcaacagctgtccttacgaaggttctgtgggctggttattctaccttcgcataaaaccttgcaaaataacccacaaagaggttttcgtcacactaccaaaatcatgtgagtcagagatggatgaaaaatgaatgccattgtgttcatacttttccagtgaacagtagctacagcagagctgttagacaaagaaaaccgtattaatgaagcgcctcccaatttagcttcatatggcttttgcattattttgctgcaaatccatagctaagacacatcttgtggcatagtccgtaagtcatctttccgaaggactgtttgattaaaggttgttctgtgagatccaccctgtgttgttcatggcatcctcttggaggcctccctcactctccatgccttggcaaagtcttccttaaggaacactgaacaagtctggagaagctgccatttcttagggccctcattggttcagttgtctatagctttttattttttattttttttttaataaagagtatgtaaaattggaaagcttcacaaacagctttgctattttttagacatgtactccacttctaagcaaaatcacaaaataaagtaaaatgcttccacaaatataatgaaacaatattcttaaagaatcaaagcagaagaacttcagagtctgttgcttatgttaagcatatatttgttttcttctctgcttttgatttacttatttctggggtgtaggtttggcaagtagtactgaaacgtactgaatgcactgttctttagcaagatagttacaggagctttcaaatgtcctcttaacatatagatttcttttagaatatagaataatgtgtgggctgtataaagcgattatgtgctttatttgatgaattatttatgtacgataaatgtagcaaaagccacatttccatcattaaatgtaatcccatttggtgatacagcaacatcagcctgtcatttgggtcctctgattgaggggtgaggatttctgtttgataccttgtgcataatggctgcgttcaagcatttaaactcatttttatttctaacctacagctgtcatctttgtaataggatattcatcagaatcttgccagagactgtgcatttgggatcttgggggatacagcaccaccaccaccctccccctgtccaagagaaacagatcaacatcttaggttgagagtctggggtctggaagacccgagttcctgagtgccctttgacaagtaacttaacccctgtctgcctcagtctcttcatctgtaaagtggggataatgacagcacctgcttcacagggttgatgggaatccagatgtggtgggatatagaaaatgcttattacttccacctttgacaccaaatacatataactaagagttaactttggagcaggggaggaagtgtgaggctccaggctggaggcagacctgtgttcggctgcaagctggagaggatggaccccaaaagcttggctgatttgaagtccatccataaaatggaactccagagagtttacacgtttcagtaatgctgcataacttaattataagatcttctctctttgtcttctttcagtgttataaaagctcttttgtccttgagcttcctttaccaagaaacatgcatttatgtatctttttgttcatggaattgcccaagcttgttagcagatcctttgtaagacccaaaagagacagacaggggaggagtcttcagatacatataatcatttttcccaatttccatgttaccagccttgccaggactttttctcagttccctgttacacaatgaaaatagtgtctctttattgataattttagtagcatcctaatgtggtataaatcgtcttccagagaagaaaatgtgtcagggttgcgttatcactgaggctagctgggaaagtagatcagcccattagtctgataattcgaagcgttgtttctgttatttctgaacatcatgtgaactccttttctgggtgtattaaaggttttcccagtgtgtgtcagtgagactcctgattgaatttaatatgaataaagataaattctttacatttaaggattaaagtctcagcttctgcttaacttgagattgcactgagaaactcctggctctcgggtatagcggagtcacgacctggggatgtctgtcccatatggctctgtgtgtaagaagaaaaagctgctgtggacggagactctgttcacattaaatgacatcacctaagccatcatgacagcaagaattatttaggaattgctcagaataaaactgccttcattatttcataaaatgtatcttggtatctttagcaccttatttatggctttttaaaggttcactgggatttataaataattggacaatgctagagacctagtacaagaatgaaagaggacaggcttctttcttaataacctttaaacattcatcaggaagataaaactttaaagcaaaataaaacacatgaaaatagccaagatgcacagaccagacaagcaaatactactttaacttatttgtatagttcttaagagtcacatttgttcctgaagtttcaaaatctcgggctgagtgtttgatcacttagggaagtgttgtggccttcacatactcttgtctcactttgaagtctagaaacacaggtcttagagcaatttttatcactgtgagaaagctgaaacttagtgtgagtagcttagtacaattcagttggccatcaaatgtcagaaacaaaactcaatccagggccgctggacccttaggccggcgttgttagtttacaacagtgcctcctgggtccaaacatctaagtgcacatgtagcaatagtaaagatagtatgtatgcatacataacacatatgtagagacagcagagtatacgtacacacatgttgcatacatagcaacagcagagaagctcatgaactataaaggatggactgtatgcttgtatcagacattttggtactgacgctttgtcatatattgtgtaacatataaccagcttgcaatcatctgcccccaaagttgaactaagaaaatcctacagggtactaggaaaggaaggccattgggaaaaggtggttatagtggcaatttgttagctcttatgaattttctttttctttttagacatactcttaattccattttttcaataaatctatactattttgtgtttttatgttagcaagtactttaagcccctcaatagaaagttgctacatcatatagtgattaaaaataaaaatctctcaaacatacaagtagaggtggtatgagacttcaaattcccttagccaagtacaagtgcagcagttttgttggctggctggctgcatagaaggactgatggattggcagaccctcaagctggagtgtaattgatctcattacagaggagccaggctgggtgacagttgtgctttgcaagtggttttttgcattggtgaagtagcccattttgttgttcctgatgttaaacaggggatgaaggtattcttttattggcacaaacgcgggaaattgctctggattcttagaggatagaacatgtcccctggacggaataaggttcatgtgtagggcaaatttagataggggcaccttattggggttactactggtctctagatggtcaaagcaaacaacatgtccatctaagctgtgatgtccatctaagctgtgtgtgtccatgagagtgacgcattttctcctctgcagtgttgttatattctaaactgtcagcagacattaattcggtcgctggtgaagtcccaccgcctagagatgaactctgcctccgatggatgttttccacttcagtgccactcgtctcgcaattactgggtcattaatatcattgcatgcaattagtgacagtagaaagagctagagggttgtgggatgtgcaccctccccaccatgaactttttactctgaccctttcccagctagaccttttcgtatcttggcaaggatattttaatgattgagactgtcagaatcttcagagcaggcactggattatgtgctggaaataattcactcaaacacctgcttctccatggttcagaatattttcattagatattatcactatcccttccctgggaagtttcatttttaaaaatctgatgcttaagtacagctaatatagacaatagggaattatgttttatctttagaactcttacattattcttttctttaaaaatgtgagctgagtcattgctattgcagtggtcatctggccgcctatttttaaaacacaattcctctatcttagtagattttggcccatattaagcatatcaagaatgactttttttttttcaagacatggggttttattgggggcttatatacaaggaaagagagagtccagtggcagtgggctggacaagatatccacatggccctgtggcagtgagctgggcaggaaaactgcaactgcttgcaaacagcatgtagttcatctatagcattttcacttaacaccacccagctaatgacttccacctggcaaccttcatttaatccagaacttaggacctcgagtccctgtacggcccatgttccacaggatgggccgagggctcagctgttcctcatagacaaggaatgactctccacattggccactcccggattccctagctcaggacacatattcaggtgtgtctaaggctggctcttctatgtgaagttacttattcttttaccattgactctcatgttcccactatattaagtttttctgaattactgtggcaataagaaacggtcccttaaattatactagaagaaaagctttttttttgttttgttttttattttgaaattatgttaaattttttttcttaactgagagattccacctgcataaatcgtcataacttttaacagtaagatcttagacttagaaagtgatgtttttcctcaacagaatttattaaaaatcaagacaccaagctgttccaaacaatagtttgaggggaaataaaataaacaactccataaataatcttatgttgttaaacatgtctctagcaaaacaaacaaacaaaaaagtcgggggttgggggaggtgcagtttattgccagtactgtctggtctttctcagaaaagcgtcagtgtacatcactgagcctggacggtatgttttcttgatctataccccctatgtgtacatgtgcttgcacgcacacacatgtagacacgcacacatgtgcacctgccatcactttctgctcttccgtcttttcactcttgagtgtctgtagccagtagctttccaggtctgtatagtcaaagatacctatggccctgaatgtcttcactgattgctatttgacattcatacggtttttaatggttaaaaggctttatgcgaaagctgtgatagaatttctcctgttctagatgtggtgtttattgctttattttgtgacttttctctcagtagattgaccttctccctcagtgtccaagcctcgcatagcatgatggcacctgtaaactcagttctgtatcctggtatcctttctcttcccaagtagaagcaattaagtaatatatgtcatcaaaaccttttaagtgcacatacaaacaaaatcaacttaccaaactgcttcaaagttgttccatgtttaacactcttctttctgagctctgggtagaatgtcctattattgttcatcatgaatatttgaaattaaagaaataaaactgtaccattttctttaagagcatccatttgtacttgataacatcttcagtcatatttcaatgctggcaaagaggaggggagttctaaactgtgactcaattttagaatctactttttccaaattattctgtttagtgcagaaaactaattaatagtgttgcatagaaaagtcactgaagctaagccagttattacttcttaatgcatgatttactgctttaagttttcaaaacacaaccatagcaatgtggtattaattcaagtgattcttcctatcatattgaacgatattttcacgggtgaaaaactcacacatcctacatcactgatagtttatacagtgttttagctgtggctccctgcatgcaaaataagagttaatcaaatgtcagtgagaaccatctcatcaagtagagggcttgttttgtttaaattaactttgctaagtataaatttcttcttgaaaataaattctgggccgggcgcggtggctcacgcctgtaatcctagcactttgggaggccgaggcgggcggatcacgaggtcaggagatcgagaccaaactggctaacactgtgaaaccccgtctctactaaaaatacaaaaaatgagccgggtgtggtggcgggctcctgtagtcccagctactcgggaggctgaggcaggagaatggcgtgaacctgggaggcagagcttgtggtgagccaagatcacaccactgcactccagcctgggtgacagagcgagactccgtctcaaaaaaaaaaaaaaggaaaataaattcttctgtatttttctttcttcaagtgaggccatttaggggaaagtataccataaaacttgctctaagataaggcaaatttggtattataggatgaagtgctatgtgatttgaagtaatgctgaattttttaaatatattaaactaaacaagaataatgaggccctcggaaagtcatgattatatttctcatttttctcattttaaagccacagtgaaaaacacataaaaggaagaagttagaaaaaaatgaatgaaattctttttttccttttggcaaattaaatagatgtttctgtttcagaagattttattaattaactttaaagaaacagtcatttatttttggcattcagtgaacactatcatttccatgtttagaacttctcttctaagttagcatcttaaaagataactgtgaaactcaaggcattcaactacattaatttgagtttcagaaattgaattcttgtttctagagtacatagtttgaattgatgtcagggtgttaaatagataaatcttagcttcctaggttgtatattcacactaattatttttttatcagccttcttatttttcaacttaccttattctttttgtttttttgacactcagatttgatagccctgtggtagaagaaaacagtaatacagtttggtttgttgttgtgtttgtgtttattttaaagtcacggctttgctttccatgttgttactggattatgctttttttaattcttcagtttgccaagataacagtcttccgatcttcagaagtctgtatcaagcttaaggaaactgatgtgtaggaagactcgcctaagaagtccaaattagcaaggctagcatgtgaggacatgctggaaaagaatagttcccatagatattgacagagaatgttcataaaatgctacttgttttgtggttacatgagagtaacttgtgtccagtgcagctgtatgtaagggcaacgtttttattctgacgactctgtggttttcatgaccctggatgcttatcatgtctctctgttggacttcttcaacggagttgatacaaatacttgcttccaagtgtccatctgccctctcctccatcctggccccatacaaatacgctacatttttaaataatttgaaataccctcaatagtatttatatttcctggtgcttcattctttccataagaactgtgataccattattctgtaggatttttttgtgcttccccgtttcacatctctgtgccagtgagacccatatatcggtgcaaatccagaagtttgattgtccatctgattagcacactgttagcaatgtggtggactaaacacagccaagatgtggggctggagcttagcctcctgggagcagagcggtgaacatcagatgaagacatgtgaaaatggagtactacttcctcttcctggggatgggctaaaaagcacagccagaaatattcttgcccttccagtctgctttacagttactcactggttctcttttttttcctactcagataaccagtatactcttcccagtgactaagaactgcagataagtataggtgcaaatagatggcaaaccgcagatggcagctgtgtggtttcagatgtgctgcagaacttttagacgatgtgaacgcaaggaacttttttgctgagcagtaatctctacccactggaaattaggccctggggggaacaatgtagtgacttctatatacttactacatgcagttagacccctgaagcaaaagcttttaaaaacaggctgtaaaatgcccatgtatctttattaagcctattttccaactggatagagaaattttctggtaatttttaaatttgtaaagtctatttttttcctgagccaagggaaaaaaaatatctgggccctaaaagcttagttataacaatgttattttttctatctctgaatgattaaatgtgatttcatttatgtagcaatactatgattgtggctgcattagatcacgctgatagaaagatacaaagaaaaactaagtataatgaactaacaatttattttcactctttctctaagttaaaaattcccagtacattcaaatgaacaatgaaaataattgcagaattgtctcctgaaatggaaatagattttttttcccaagcattagcaatttcttgttatttttcaaaatcagccactaagcctttcagagcttcttggtgactattgcaggagaaatcagaatattaatcttgtggttttatttcagagttcgctgccaggaaggaggtataattgggataggagactttttttttttagctgtgtcactgttcaaggaggggggtttggaacctcagcataagaattacactctgtgatgaggatgtagcaggggagaagaaaggtgattttcactatgggaagctatacttacatcaagtataaaatagactgaagtcattttgaattacgttatacttgtaaagtttacctcctggagtttcagttagtaccagtgtactaactgggttaaaacagttcatggcaccttagatcatttctaactcatggcaaaaatctttcctggtggaacgtgtaactgtattttaaatgcccctttataagcaaccaagtatttgggatgttattttgatattagtagtgaatttttcagtatcttccagtaccctttgcaagtcacaggttgacttaaaaggaaaagaagcaaaatgctgaatatagcagaaaaactgtctgcattcagactgttcagcccacttttgctccccacgtggcaagcacactcccccaaacaagcaatagcctgtggcttcagaggaacctacaaaggcagcatctgtagatttttccttcttcaactctaagacttgaatgtttccctcttccccacacactttttttttaaaccaagaaataaaaaagttttcactcttaaaggtgcaaagcagtttcattcttatgcaacacagccttcctcctactgtcttatagtctgtggatgttaaattatagattccaattgaattttaatactctagagattttacatttgtggttgtcaagaccccgttttggtaaacctagggagctccgcacaaaagcattgatattcagaaaaggcactgacctacaaattaaaagaaaaaaaaatcaaataatgtgcacctcttgtgcttccagtttgacaaagcagaagtcatcagcagtttctccctctgcagacgcagttctcaattctatttacaagtaactgctctactgtgcctgtttttctcttgctgatactcatttaattgtttttcttttggatctgaatctttgactgtcttttccccctcaagattaaaataaatacatctgtattcctcccctttctttctgtgcactgcccttcagatctcattttgtcatttttcagcttagtgttgaaacttttagcaacaaaaagtcagttacttactttgagtaagtaactcaaagtaagttaactttgagtttgagtgcacttttgcgtgtaggttcatttatgtgcttgtgaatttaaaaacattgggattccacctgaatgaagtaaaccaaacattttaaactatcagccagatagagacatcagcctttcacttctttctatatgcagacatatcctaattttttagaaaaatcaaataggaaaattctcaacaattaattgaagattatagctctgctctgaaatggtccagaaataggatctgctcatagaaactcatagtttgaagcctctgggaggaaaggatactttaaaatttagtcacatatttggaggagggaaaagggaaagagcagaatgaagaactgaaaaaaatcacacaccggggcctgtcgtgaggtgggggactgggggagggatagcattaggagatatacctaatgtaaatgacgagttaacaggcgcagcccaccaacatggcacacgtatacatatgtaacaaacctgcacgttgtgcacatgtaccctagaacttaaagtataataaaaaaaaattttaatagccccattaaataattaaaaagattttttttagattcacagaagtgtacaaaatttttaggttttttttttttttaagctgtctgctgaatagtttcttaatggtctacaatgtttgtatctacaaacagatactgtctgcttcttactacccttccaagacaagtattattatggcaattattgcccagtttcccgggaaaaatttatccacagttacagaagaatgagatgcaattgtgagactgtaaagtttaagcaagcactcagagaagcacagtgatatgtatgcacagaagaggcagtctttgttttgaggaaaacagtgaaagtaaagttaattcaagaccacaaagacaagtaaataagtgccttatttttgtagttaatataatttcagtggaatgcatatttctaccataaatgcatatagaacttgtttgctgacctactgtttggaaaacaaacaatcccattagaagaatgtctttgggatttatttttaccagaaaatcaatccttttttcagtcccttgcaaagtacagtgttacaagccaagactttgataatcaggtagaaaatggatttaaattgcagaaatgtatatgaaacacttttgttccttgccccttgaactttaggggaatgaaaatgtctagcactctccaccttcttttctctcctggaacttgaactgtaattcaaagcctgtttctcattaaagtacctggcagcctatctctttacagcttgagttacaaagctattcagagacctcgctggtctaaagagacagaacaaggatgtgtttaaatagagcataggctgttgaaaaaaaaaatgctgaaaatggtaaaatgattctgtccttccttccactcctcactgctgaggtggagagggaattcagttggtgaacaccagcaagtggctggtaaaagtccccactttctctccagggctgccacaggacccagaatgagtggtgggcatgtgtgtgaaccctctattcagccagagttttcccgcaacaggtagtttggttgaagaggttgactaaggttgacattggcagtaataacacgtatgttcttctgatttacaaaacgatggaggaaaaaggggagattttgaagacctgatttctggtatacttcttaagcatgcataaggctgaaaaaagaagacaagggttgtgggaggctcctggtctagtgtttacagaacttggatgcttgacaaacagagcgtcaagctaattgttcttgaagcaggaaatctgcagtggaggaagcaggtgtggggggatgattaccacgtttggaaatggctgcattaactattttgctcttctgagtttggccccaaaagagtccatagactttttgaaggatgccatcccttttatttatagactaacattaaatcagtcatttgtgaaggaaggagaaagtgcctaaataaatttggagtcagatagcatacgtgcggcagtgtttccgatatccatttctctttatttctttttctttttctttttggctttcagcatccccatactttcagaaaacttgtgactaagagtgaattcttatttttcaaattgttttcagacatttcatgttcatgtaaacttggcttattgatttcctgatttttctttatttttttgttttgtccattttatttttaatcagctacatcaaatgggtctttggagggcctggataaccaggagggaggggtgtgccagacaagagccatgaagatcctcatgaaagttggacaaggtaaagaccatctgctgcttcatgacgccactgtgacctggtgtagcccccagctagtatggtgctaatgttgccgatgcccaccttcattcgctcttctttttagttttcaaagcaaacccttctgcactttgagccactgacagatttcctcaagtcaatgtactaagcttttattggagatctaagagttaagatcagcaaggtagaatgtctattgccatagatagatagatagatagatagataatagatagatagatagatagatagatatttctttttaaaaagcaaaacactttggttcaaaatcaaaatatccagaatgaaaactaaaagcttgtgcagttttgctcatttctgaatcttgactacagaagagttttgttcattgtgacttttccaatatagataacctattgtgcagaaagaaataattattcttctaattaaaaattggtatagtagtcaatcaacttgctcagttaaattgaaatgtcatctgcaatgctttgcctgccaaatgcaagaatccctatagtttccacagatggcctcacgttctaaacctctgaaataactagtataaccattttgttttaaaagaaaaattatattcttgtatttcacagtactttgcataaagactcttatgttcattgctattcatgcctgttgaaatatatatgcagctcctaaagctagatattgtcagatgtctgtgccgtaattaatcatttgtttttcatatagatgcaagttctgctggatcaaccaggaataaagatccaacaagacgtccagaactagaagctggtacaaatggaagaagttcgacaacaagtccctttgtaaaaccaaatccaggtataacagcatgatctgtgtgtatggaggtctgtgggtaccacattcttagtagtatcttaaaaggtagggcagagtctaaagacttctaaccagttaggattagctggaagttacagtgatcaggaatctttgctgtcagtgagtcattattaattacactcaataagaacaaaataactcattccaatgaaagtcatatattcaaaggagtagagttcatgagctgtaagtgccagttattagaactactctgtcaggccaaaggtttcattggctgacattttatcaagctggttgtcaactccagcttaaagctgatgttaatgtatatgtaattaatgtgctaatccctcatctaattatatctaagccacagagggtttaattgatcctcttctaaattttaaatggtaacatttttaaatattgcataatagtattttttcaggtggttatcgttattttgtttcacattttccatgtaaaagaaaatattaaacaggtccctgacaaaagtgtagaataccagataaaattgtccgtcgttgaccttcgttttcttaacagtcttggaacaaatagttctgtatttgttaccatgctaatgaaggttttatagagtagctgttgagcagacatcagcagttttgtattaggattgttgtgtgcttgcttggtcgttgtgcaaatttatcgtctgcagcaatattccatctctttccaagagtcaaggagggaagttgttatttctaactttcaatgacaagatgtgtcaaattcttgtgacaaactgataaatggataatataatgatgccaggcagttttttagtgcttaacatttgggctggcagtctgttcggtgtgagagtttctgctgccttccaaatatattttaagtgtaaatcaaataatacagacgagttacgagctgaacattttcccaggccccctcactccttccgcgttcccgagctgttctgttctgccaggaggcagggctcttctttagaaggcaggccctttgaaggtttgcatgaaactccctttctcaaaggaggcggaagagcaataccacataaacgctcaccgctgacctggagaattggccacttccctttttcttccctgccgctgccccaggctggctgacacgggttagaagatgaagcaagatcaagggctggctgtcaccgacagtctgtgctcttgctggataatgatacaaaggaaaccctgtggcttgggagggtagggaagtccctcctagagatacctctcatttccttttgcgttgagctcttagacgaggtattggcgaggcaaagtccagcttctagttagttaataagcctggcttatttttcacatttttaagggtcataaaagcagtccgtctgcactgggacagcagtaactatctctgaccttttctgtctccgcgtctgcaggttctagcacagacggcaacagcgccggacattcggggaacaacatcctcggttccgaagtggccttatttgcagggattgcttcaggatgcatcatcttcatcgtcatcatcatcacgctggtggtcctcttgctgaagtaccggaggagacacaggaagcactcgccgcagcacacgaccacgctgtcgctcagcacactggccacacccaagcgcagcggcaacaacaacggctcagagcccagtgacattatcatcccgctaaggactgcggacagcgtcttctgccctcactacgagaaggtcagcggggactacgggcacccggtgtacatcgtccaggagatgcccccgcagagcccggcgaacatttactacaaggtctgagagggaccctggtggtacctgtgctttcccagaggacacctaatgtcccgatgcctcccttgagggtttgagagcccgcgtgctggagaattgactgaagcacagcaccgggggagagggacactcctcctcggaagagcccgtcgcgctggacagcttacctagtcttgtagcattcggccttggtgaacacacacgctccctggaagctggaagactgtgcagaagacgcccattcggactgctgtgccgcgtcccacgtctcctcctcgaagccatgtgctgcggtcactcaggcctctgcagaagccaagggaagacagtggtttgtggacgagagggctgtgagcatcctggcaggtgccccaggatgccacgcctggaagggccggcttctgcctggggtgcatttcccccgcagtgcataccggacttgtcacacggacctcgggctagttaaggtgtgcaaagatctctagagtttagtccttactgtctcactcgttctgttacccagggctctgcagcacctcacctgagacctccactccacatctgcatcactcatggaacactcatgtctggagtcccctcctccagccgctggcaacaacagcttcagtccatgggtaatccgttcatagaaattgtgtttgctaacaaggtgccctttagccagatgctaggctgtctgcgaagaaggctaggagttcatagaagggagtggggctggggaaagggctggctgcaattgcagctcactgctgctgcctctgaaacagaaagttggaaaggaaaaaagaaaaaagcaattaggtagcacagcactttggttttgctgagatcgaagaggccagtaggagacacgacagcacacacagtggattccagtgcatggggaggcactcgctgttatcaaatagcgatgtgcaggaagaaaagcccctcttcattccggggaacaaagacgggtattgttgggaaaggaacaggcttggagggaagggagaaagtaggccgctgatgatatattcgggcaggactgttgtggtactggcaataagatatacagctccgagctgtaggagagtcggtctgctttggatgattttttaagcagactcagctgctatacttatcacattttattaaacacagggaaagcatttaggagaatagcagagagccaaatctgacctaaaagttgaaaagccaaaggtcaaacaggctgtaattccatcatcatcgttgttattaaagaatccttatctataaaaggtaggtcagatccccctccccccaggttcctccttcccctcccgattgagccttacgacactttggtttatgcggtgctgtccgggtgccagggctgcagggtcggtactgatggaggctgcagcgcccggtgctctgtgtcaaggtgaagcacatacggcagacctcttagagtccttaagacggaagtaaattatgatgtccagggggagaaggaagataggacgtatttataataggtatatagaacacaagggatataaaatgaaagatttttactaatatatattttaaggttgcacacagtacacaccagaagatgtgaaattcatttgtggcaattaagtggtcccaatgctcagcgcttaaaaaaacaaattggacagctacttctgggaaaaacaacatcattccaaaaagaacaataatgagagcaaatgcaaaaataaccaagtcctccgaaggcatctcacggaaccgtagactaggaagtacgagccccacagagcaggaagccgatgtgactgcatcatatatttaacaatgacaagatgttccggcgtttatttctgcgttgggttttcccttgccttatgggctgaagtgttctctagaatccagcaggtcacactgggggcttcaggtgacgatttagctgtggctccctcctcctgtcctcccccgcaccccctcccttctgggaaacaagaagagtaaacaggaaacctactttttatgtgctatgcaaaatagacatctttaacatagtcctgttactatggtaacactttgctttctgaattggaagggaaaaaaatgtagcgacagcattttaaggttctcagacctccagtgagtacctgcaaaaatgagttgtcacagaaattatgatcctctatttcctgaacctggaaatgatgttggtccaaagtgcgtgtgtgtatgtgtgagtgggtgcgtggtatacatgtgtacatatatgtataatatatatctacaatatatattatatatatctatatcatatttctgtggagggttgccatggtaaccagccacagtacatatgtaattctttccatcaccccaacctctcctttctgtgcattcatgcaagagtttcttgtaagccatcagaagttacttttaggatgggggagaggggcgagaaggggaaaaatgggaaatagtctgattttaatgaaatcaaatgtatgtatcatcagttggctacgttttggttctatgctaaactgtgaaaaatcagatgaattgataaaagagttccctgcaaccaattgaaaagtgttctgtgcgtctgttttgtgtctggtgcagaatatgacaatctaccaactgtccctttgtttgaagttggtttagctttggaaagttactgtaaatgccttgcttgtatgatcgtccctggtcacccgactttggaatttgcaccatcatgtttcagtgaagatgctgtaaataggttcagattttactgtctatggatttggggtgttacagtagccttattcacctttttaataaaaatacacatgaaaacaagaaagaaatggcttttcttacccagattgtgtacatagagcaatgttggttttttataaagtctaagcaagatgttttgtataaaatctgaattttgcaatgtatttagctacagcttgtttaacggcagtgtcattcccctttgcactgtaatgaggaaaaaatggtataaaaggttgccaaattgctgcatatttgtgccgtaattatgtaccatgaatatttatttaaaatttcgttgtccaatttgtaagtaacacagtattatgcctgagttataaatatttttttctttctttgttttattttaatagcctgtcataggttttaaatctgctttagtttcacattgcagttagccccagaaaatgaaatccgtgaagtcacattccacatctgtttcaaactgaatttgttcttaaaaaaataaaatatttttttcctatggaaaaagtgccttcaaagtacttttcttcttttcttttcatttttctttcttttttgtttgttattttaatttgccttcctttactctatttcccccaaaattacagttaatccagagacttctgtctatggacactgtgtgcccacttttcaaatcgggatgtgcacatcacacaaatattaattttgctaagagccgtgagctcgttattccccataaaaccacaaactctcatttcaaaaataatatgcaattgtataaaatcctaataatcctcaacagaaaatctctctagtggcacctgaattgcacagtcagaatagttacctacaaagttagctgtctcaggaaaaagagggaaatgtactcttatcttacacttaattccagatcgatctagtgtccatagaagcaaagcagcggtctatcgcttcatttttcttaacagaataatcctagggagaaggaaaaagtcaaatgtttttgtaaaaacttaacattgatgagagcacattttgagatactggttgaaggcaagccagaggccagctgtgagtttaaaacacactttcagtggtcatcttcctggggaaggtaactatgtaccctgaggggtgtgattgtttttcaggcctcttgtagtcctgggtattaagactgatcactatacttcctgggtagctttttaaacaaccaagagtccccacccatggcagagaacttcacacccttgagatctgagtgctaacatctttacattatctcaggttaatccctgccataagagtgagacattttaggtagggagaataggaaaaggcccctggagtcaggaagcaagccagaagagttcccaggtctgactgacttgcccaggaccacaccccagtcagtggaagaaaccatatgtttcaaaagtccataggtgatgaagaaaggctggtttggacacagggatctacacagcttagcacagtacttgtactagagaaatgtttgttaaataaatgcctcccttcatcagcaacaacaacaatccccggaggcccagggttttcgtggatggtagaatcgtagtttcatctgttccaggattttctcctgctgcacccacctgccttcagttgcagatccaagttgatggatgcaattttatggccaagccactaagctgaaccctcgaccgtgtgcaccaaggtcatttctagttagtttgggcaaaagaaaagaaccaaagtgaaatcatgcattttcaacctttacttt

SEQ ID NO: 15167 - DNA, 5700 bp, Human
tcccaaagtgctgtgatcacaggcacgagccactgcatcctgcctttaaatggttttttggggccccttttggatgctctgggtgtttttgccaagagttacaggatgtcaagtgtggggagctcagcacccttgctgtggaccagtgaaggctgttccagaccaggtgcttccagacatttccaggctccaggagagaggctgggagcccccacagaaagcacaggaaaatgcaaaaaaaaaaaacagtctttttttttttttttttttttgctttttattatgaaaacaaaacaaatgccccaggagaagggtccatgattaccagaaacatcaaagagtactttctaccatttttattctgttgtgttgaggccagcattgcaataaacaagctaaactacttacattggactcattttcagtaactgacatttacaggaatatactagaaacggcactaaaaagtttaagaaaagttacggtaaacttgcatgcacatcatacagaaaagtaacattttaaatataaaaaagaaaaacttcctggaagcattatgccagtattaaggaacagtgctactctggatgtgacaaattctgtatgtgggtgttactctttcccaaaagactgtcagaggcgtgagtgctgcaaaagaacaacaacaaaaacaaacacacaaaaaaatgtgtcttacagtttgtaagcaagatgacactgcccaacacaaagaggggtctggagttcagttcacgcccgaagcctgccccctcggcctccaggggtcattcagagtgttctcaaatccaattccgacacacgacttgtcactactcctctccccttgaaaaaagcatgttagaagctgccctacaggtctcagcagtgggacaatctaattgaatcaccgcagccttctaatacagaagaaacggacgtgactgtcaccctcagcccgccagcaagggcgctgaggaagtcattaatccttcgaaactctgaaaagaaaccagtgttgaagtctggacagaaagccttaaaaaagtgacagcaccaatgcagctgctcagtgtacccgccgtgggctgtcagggtcagtggcttctttctagatgaaaggagcagaggcgagccgacgccaccgtcacagagaaccagccgagaaggaaaggccccacgatgctcctgctgcgctgcccccacagccggccgctcccccgacggctcacacaggcagcacctcactgccctgtggctggaggggcattgcaaggagcgccccccagccccaggcacccccggcttagggtgtacgtatcacccagccctgtgctggcagcacgttaccaaccagcctgcgtgaagacctgtcaactgtcgtgtgtgaattccttaaattcggtttaaatagtccattaaagatctgtttagaaaatacctttgaaaacgagggtaactttaaaaaatggaaactttcaaatccatttatatttttattataaacaaaacttaattaaaagtttaacaaactggctgaaaactcaccaagtgtcagactcaccagcaatttaaaaaatgataatttaccagcatctcctcatcagagttccctctccagtaagggtatacctacatctgtaagggtcagtggactctgaatcaattttatggttgttttaaaatcaccgtgtattaggatactaatgatagtccctatatccatccagaaatgctggcagaaagcactggccaccatacaggacagaccacaccacagctccatacccagcgtctgcctggaggctcccccacgctgaggtccgggagaatgcctggtttcagtcatttccggactaactgtgacaacgcgtgagcagggagcaccgtgcgagtctccgggagggaatcctcctggggcccagagactcctccacccctggggagggcagacaggctcgggagggcctggccaggccactggaggctggcagggagcaggcatgtccacccgcaagcctgggaggctaactctggcattcctggccggagccgccatgctcattggtgggccagtttgggacatccccgtactcaaagaccatatggcagcctctgggaaaacaaaaccaaaacatcaccttctattaaactctgtatattattattttttacaatagaaagttaaaaatcaagacttagatttactatacattttttctctcagattacaaagtttatattatataactggggttccctaaattgatttcttttaaaacagtcttaaagagaccagaagtgaatacaaaagaactaaacaaaataaaaaattagaatgtgctgtagctgaaagctgtctatacctgtaagcctccaagtttcatacaaaaaaaaaaaaaaaaaaaaaccacaaagaaaaaaaccaaaaaacccaacaaacccaggggcgagcgcgcgaacagacgtgggtgagcaccgcgcggtggcaggagttagcacctggagacgacaggccgccgccagacaggacccgcgcccggcacaccactggcaaggcctgcatctctgcgactgtgtgaatgcatttcttctgcggttttttcttattttcttttttttaaaaatgaccaatgatgttaataaataactatttatatacacataagctcgggaagtggttcccaagggtggcgcggcagcagcagcaggggcagcgctagccaggcggggactcacagcgggctggacttccgtagaaaattgccgaaccttacaaaaaaagtctcctttttttttttttttaaatcttttcttctttttttttttttaaagttgaggtaaaagcttcagtgtatggaaacctgcaggctgcatacacagccgctctgttccctccgaggagctcctgacatcaccacgagcggagaacgcacatcccacccgaccaccccccaagggctccacgctccgggctggggctgcgatgacccttcgcttaggcccagcctggtctccacaagcaggcacatctgtcctcagcccctccagaaagaggtggccgcgtcagacacgagggtcagagctcggggcccaaatgacaaggacaatgcgtgttgacaaagctaacagctttcaaatacagtacccatatccgagacatttccttggaaaaaattctttctcgagctatcgaccaggttgggcctaagcaaagggattccacaaggttcttcggtacgaatctcacacggttttctggggtcatcgggttagcatttgaagttgtcatctccaagtgactgaattcagtgatgaagaagagactttctgcagagttcacaccttctcatcaagtctaacgcacacacaagatagatctctgacctatgaaagcaaaaactggaagatatcataacactgaattaagaagcagacctgcacaccatggaacagaagtagtaatatgaaccacagaggggtacggcagagtctcggcgtgtgcgacatccatctgtcctgttctgtccgaagccagttcattctgagtcactgctgtcagagctggacccgctggagctgctgctcccagactcggaggagctgctgctgctgagcctggacgggccccctgagggtgctgagccgggcttctctgtggagacatgggcagggagatgcgctcgcacacccgcttcttgacccgcttggcggcatgtcgtccatgccagcgtgacaccatcacactgggtgccacgacccacccacttcctgacccagtcgtttaataagtatttattgaaattaatcaggtcaacaagactatctgaatatacttgagacaggaaaaaaatgaatgcagactactaacaggaaatgatggatgcgagaaaggctgcccatcaaaaacatccaccagtcacatggccaccagcagcgacaggaacaccagctgctggcgtttctggagcgcttactctgcctggggcgtccaaagagtgactacaggagacagaccccttcagcgggcagggtcatgggccctgtctcgacactgggcaaaccatgtcgcaaggccatggcccccagctagaacatgctccagtccagataggaccctactgtcccccccatatgtgtgtcctggaagccaggaaaagagatgtgtgctctaacagggtccagaaaaaggaggcaagggctcaaatgctggctcccctgagcaaaggacctggcaaagcgcagggcatggggctgggcctcccgcctctgctacctcggcctgccatggaactgatgccactgccagggaacagtcagaaagctcacggtgagcccagctcactggctgggctgcccagtccagccccacaagagccctctcctggggggtcctctgtctgtggtgccctggaatgggctgtgttcacacacacttgacatgtgcacacctccctgcagggttggggtatgacccccagtgacagaccaggaaatggaggtttcaggagctcaagagctcgtctaagaacatggagctcatcaggaggtaagccacactcagacgtgggcctgctcgatgctcaaacccctactgctgacaccccccacccccctaaagaggggtggcacagcggccgccagcggtacctttccgggcgggcttcttgctgctgctcagctgcccgctgacatcctgcagacgcttttccagctccttcttcttttcctgagctagctcctctttcgacttggctgcctgtttcttcccgcttgctgctgtcggggaacaaatgggcactcagactgcagagcagaccgatggggcaggagccagggctgcatccaggtggccaaggccccagccctgcacactggcatccatgccagctgcccagctttcatgagtctgggagctgacagatgcaaagctgtcaccagggcttcgagtggcagaaatgactgggatgagacagacccaccaccacccacatctgctgagccctcagggtgagcaaagcctggatcctaaggtgacagaggccattcctatggcgcaaacaggtgcacggacaggatgcggtttggccaacgtccctcatgtgcagggcagagcctctgattcatggacctgcctcaccagggccgctgctctccatctgcccgagcaggaggcccggtctccactgcctgacactcctgagtcgctccctccaagttgacccggtgacttaccgtgggtcagacgcaccatgaccacacagacattccatccaggaaaaggagcaagtgaggcccatgcacacccgagaggccacatgcaagttcaagtgagccctgcactcacttgacagcctatgggggctgccacaagggctgcctcgggtctgccctccctcctactctgccagacctgcagaccccagcagtgactcgttcctgccactgacttcagggaagcctgggccggtgccccagggtccgtcctgtgaggcttctggacttgtgaccccagtcaaagggagggtgtccttgttataagacaagctggtctgccctgcaagggaccatgagaggtcacctgcagccaaggccccaaatggaggggagcctcaggaaggcatgcagtgaggaccccaactgggccctgaatgaatggggtttggggccggagcccagccccagagtcgcgcactccttgga

SEQ ID NO: 15168 - DNA, 9128 bp, Human
gcacaaggacagaagataaaatgaacctcagtccttgatgacactgcctagccactgagtggcaggctacttatttttttaagccacttgatgtagttgtgtgtttaacttgcaacataaaagatacagtccaccaaccttctttattcccaaaccccaacggctccatttctgttctctacagcatcagccccactgagcactccctccttcctgaaacctcctctctaggacccacactcacttggtcctctttctaccccactggccactgcttcttagtctcctttcctggatcctcctcttcttttctctccaccttctttcacttgcgttctcacccagcaccatgacctttgtattgatggcccccaaatatgtatctcctgccccagcctccgttcgcagcttctgtgtcacataaacctgcctactcaccctctctgcctgcatgttgccccgacatttcaaacttaacttctcaaagccgaacttgatcttccccctcagtccgttcctctttcaggctttattgtcttggtcaaggaatcttttaccctttcatttactcaaggctaaaacctagcgaggagttattgccaatgcctccacatccacccaagtccaatcttccacccttcccttcacctccccaagctaccaccctgtctgagtcagcattggcttttgtctggaaagctgcaaccacctcctaactggtctgcctacacccactcctgagtgctttccaagccatgcggcctgggtggcctttcagaaatcctaatttgctatcctcttcctgatgaaaatggcttccctgactctcaagagaaaagccaaattcagtatgtagctgacctgttttcttctgtgctcacctcaccccaactctgccgcttcccagctccagatctgggacaaatgttctttctgcctagaacatttcccctctcactcttaccctaatcgtcctttgtttctcaacctaaatgccatcttcccaaggaggttccaccctttccctacattagtactccattaatttctcctaacactctctacttcttctcacagcacttcccatgatgtgtaattatgtattgattaaagtcactaatatacagtgattatatgactgtctccccgcctacccgccattagactggcagtgccttgaggtcagggacagacccaggttaccgactctacctgcccttagcactgcgcttgggtacagtaagcgcccaaggaatatgcttaattagctaataaatgactacacggactcattcaagcctcataaaagccctaaggtgggcatttcaacagaagccgggtcggggtgggcgaggggctcgctggcccaaggtacggggcaagtgggggagccgaggcctgacccaaggcagtcccaagttctgagcccggacctttcagctcctgagccttggctgcatgatgaaacgctagggagggggtggactttgagccacgagaaggttttcccggagtccacggaccatccacgcgggcaagaacgaagcgggttcaccaacatgaacacaacccggcccgcccagcgctcacggagtaaggatcacaatctgctgcatatgcatgaggggacccggccgcgcttcggggctgtccacactgcgcctgataaaaattattcgggcttgaagatctcggggctcccagagttttgtaaaagtgcatacaaagtcctcaaaggtggtctgtggctgatatttacgggaaatggggcgaggatgagcccccacttcggaccgtgtgatcaggcgtttgcggtagacagcccgatcccaggatgggtcctcggccggctcgactagaagactaagggggcgtctccccggcttcctgcggcgtcggtggcgagctgaggtggaggcaggctgcggcagacggcgacagtggcggcggcgccatggcagggcttgcaggtaccgtggcgtcaacctgcttggggcgggatgagaggccctccatgcggccgcgccgccatattgtcccttctgggtcaccttaggcgtcgccgggtccccgtcactggggttttccttccgcataccccgggaaggcagggcgcccctgtccggcttcaggtgattgccgtgattggacctagcctgggccttggggggtcccttcccagcccggaggtgggtcatagtactcctgggtgctggctctggccttgtccaaggtcagcgcccttgcaggatgagacaggcagagccgggggcacggggctgggagcgcgaccaccatctctgcagccccgggttccacggcagggtgcccagcttgtgagaggcctgtcattctgtccccatcagtttagttgcgttgctttagttgcttttttgggggggaggtggggggacgtgggggtgaggggagagagggtctcctgaggctccgcttcggtgtctggggtgataggctgacgctctgctaagagtcgcgggcgcttcttactccctccaactttacatcaagggtggacatcccttccctttccttctatagacgtggggagtggccctcaagggcagctgaaggaacggaatgcctggcgcactaatggcctggaaaggaagcatgggggatgggggacagttgttttttccttcccctttccaaatctcctttagtttccttccaggcctccgtgtcccatttcatcgccgaatgttgggagactggggtctgtcctcggaaagaaacagcctttctgtttataggtttggatcgtctatccctttcagggaactggtgtgttggggacggcttctctgccctgcctgacatggtccagtcatcccgtcagccttctggacggcaacaccaaagctgggaccaaaaaaaagttccagcttaagtgctaatgccaagtgttagatcttgtttgcttgtttgttttaaatcagagactaattaatgtcaagcaaatctgttaaaagatttgatcacgggaagcctggtcggtttccagtgaccaggtcaattccatatctgaaattagtcttgttagagttgctgccaaaaacagtttaacctttaatctgtaatatgttgtttcaaagaggaatctgggttagactgtctttttttgttgttgttctcctatctttgaaacacatgcattccatttcaagcctgtccctgtgcgatataccaagaaccacgcgttgcctgcctctctgacttcctgctctggaaatgctcaggaatctggatcctgctggggcatgcatgggccctgtgggagggcaagtcggggaggggaggataaacaggatcactcccagggaagatggtgacaacgtgtctctggggcatatagaggaagtcagaggttaccggggggaaaagagattgttgtttgactagtgttttgtgtatgtgcatgagtgcacacgtttaaatctctgaggcggggtgggggcggtgggggggggaagttaactgcaaattcagaatctccctttggggtgttggctcctgaggagatacacatttcaaaatagatatctagtaaatggctcacagcaaacctgctccccgatccaacagtaatccgttgcccaagctcaaggaacttgcccctgcccttccctgacagcagacatcccttccttcagtgacaattcaaatattccacagataaaggtaacagtgtcacatagcaccctgcacccctaaaagtcatggtacctaaacacctctggacttaacttcagttcgttaggctaagaaactaacatcctggagtattagtctcaagggtctctcacctgttgctggagtcccacagagctattcccaattccttcccaaccgatctgctctgtccttggccttgtgggggcaaagtcttctgggagcaatgatggtttaggcaaaggggacgttcagcactgtgactaagggctgtgcagtaaaacactagtcattttcaattcttcgcattgctctctatcagaataaaatgtttaatggtatagtttgtggaaaaaattttataaacaaggtgtgtttggaccatctaggcattgcatggcattgcactggatggaaagtgaatgcactgtcttctctggtgggttaagtttgctgccagaacatgaagttttgtgggtggaggatgcaaatggggagtggacattgcacattgaagcccacacgtgcaggtgcaggccaccagggcagcccttgcctggaaatctgtcatctcaccttgccacactcacagccctgctgatggacggatggaggaaaagggctttgccaagatgatatggaaagctctggggctaccaggagcctcttgtcctctaagtgggggcacaagaggtgctgtgtccagagcagccagctcttaccatgctgctttggcctacctccctgaaatctgctaccttgtcacttgggctgaggttagagcatcaagaagggcagtggggctatgggcatacccctcaaaagctccgaagggagggtcagccttcatggagaacacatgttggtatgttcatgattctgtgggtttagtgtggaaaaccacagaaactcccagttttgaggcctgccaagatatggggttcagaagggaggaggtgtgggcattgcctgctgatgagtcacactggggcgagaggagacctgcctcaccttcaggctatggtagcagctatagccacccagcctaagaaagatgaagtctcagattgcacatcctcttcaagtcctgatgagtcctgattgccactgctatggcagtttctagcgtgttagggttcactggcatctcaaaggccctcttcgagagggaaactggagatgaagggtacaaggtgacatgtccaggttccctaggctgattgatggcaaagtcaagaccagaaccgggatctgcacctccccacccctataattctctgataccgaatgaagttttagatgcctttagaggtgctggtgattgggctaagaaacttaagggcttgcttaggggagggaaacatgatcaggcttaagggggcaaggtactttgtgcttcagaagtatttgtgacagctgtgactaagggattcgaagaagtggcaggaagagagatttatggccctccaactccctcccttggtgttgacccagcaacaggtgtgtagtgacagggacacataaagccagagacaaggctgaacaggcggcagggccatttggtgagacagtcagctgaccccgtgtagaaagagccctgactcactggggagtgggagaggaagacaagtccgaggccgagcactgcccaccctgacgtgatggcaggggagagcccagggccacggacctggtaagcattcctaagaatacggaggctggtgctgggaaaagcagaaacccagtattggggagagaggtttctggggtgaggtggggccaggagaccctgcagagtagcaaggccaggcagattgtctttgtagtggtcctggtggatgtggggcctgcagcattaagctgggtgaagaaggcgccacgctgcacctcttatcccatactcattgtctaagccactgtccaccctgcccactactcatttctttggggctcctggatggagacctgaagtaaggctttgtgttctgaaatcacccccttggtccctagtacctctttggagggctactcccacctttttcccctcctctcatctttcccaaagtgatacttgctttggccccttatcctaagaccacaagtaaagcacctatccctttggggagggggaagtggtcccttattccaggaccacaagtgaagatgtcagcctttctctttggggagagggggagatggtcctttatcacaggacagcattgagatggggttgggtgtgtgaggggcccagcttattgcaattttgatggccctccttttcctccctcccccaagcagtgtgcctgttccacagtgggcacatcagctgagtcttagaagtgtatgttgatgccgctaaagaaatcacaagagacaaagttttggtgcgcctctactgcaccgcagggtcctgggacactgtgcgagacaggggaggtactttttttattttttgtagaggtggtccctgtcctccaggagcttacaatctagctggggagacacaactaatgcacacttaaacaatcagtacaattagcgattaccacaatattgaccacaactgcatgagaccagggaaaagcaagatcagtgaggggcaaggggggttcagagaaagtgttttagtaaaggtgggattcatttacttttactgcttgaatagttccaaatcaagtgacacattattttggagtagggtgggcttgggaggcagtgaggaggaaaggggaatcgagagagcaaatgcagcgaggctggaatgcaagtgccctgggcaagggacagcgagagggccccactgtatttcttaaccaccctccttcctcaactgtgccctccagtcccgccacacaggcacgcggttggtgctgcaccaagattcagggcgtcggctggcgatgtcagaatgtccattctgctggctggtgcggtgttttgatttccatggtggggcctgctggcatggccctggcttcggggctgggatggtgctgtcccgactttgtccagatcagaatgcggtgcctatgcccagatctcaggggtctgctccccctatcccccctcctctctcgaccctgccccttagtgggaccggtgcaaaggggttgggaagggatctggtatcttcgtcattgtcggtactgcttctccgggggtctactggcccctcactgaccttgccaagtgctcctctggcgagggaacacaggggaccccacattcctgcgcggcactggctcccgtgctggccgagatgcacaggagcacctgatgatacggccgcccagggctgggagctggggcctcagttgggggctcgctgcctgcgctcccccaacacctgccgcccggtccgcgacaccgtgtatgccagcttctgcagggagtacctgaacacctgcgacgagaaacccaggacccacccttagtggagagcacccacagcatgtctgtggtgctgccgtgcccacccccgccccaccccctgccccgcccgcccatccagcgtaggctggagaggcgggcgcgggcgcagcttgtccacgagtcagggcagctggagcttttccaactgtgctgagagctgcatggcggcaagctgattggacccacaacttaggtatacctcacttctcgcaatgggctgtgtccctggaggatttcgaaaagcgaatcctacccagtaaatgcagcattccaggaacaccttgaaggaaatatgcgattcctttggcaaaggattcctttagcagggaattcttcctgcaaagggagcttttagggtaaatgattttatgggcaaagcgctttcttctgatttatctctttttacaccaagcgcttttgcctcttttttatttttttttattattatttttttttttgtaaagcaattgtccttttttggaagtgctttttttccccttctatttttctctcgaggggctttttcctctaatttttttctttaaagcgtttttgcccgatccatttttttccgttagctcccttgtctaatttttttctgcagtgcgtttttaatctaatgcatttttttctgccaagtgcttttctccgatttatttttcctgcaatgcgcgtttttctgttttcctgtgaactactttttctctaattcgttgtagggttttttttttttgcgaagtaatttttattttttctgagaagtgcctttttctaacttattttttgttccacccccgcaagcgctatatgtttttttaaataaaatttctccgcaatgcgcaattttttaaggtggaaaattttcactctgcgagctgtaaagtctttcaacacagtagtgccccgcctccctcctggggtcgagtccgggtgtagcgggtttttcttaccgcgtaggtcgctaaatgcctgggtgatcgtccgcagcggtcgcccgccgcgccccgagtctttgttccctggcaggcgcgggcgcactagggagggtcagcgcgaggaggacggcgcagggaatgggcagggggcgcgcggtgccggcagcggcacttgggcaggcaaggatcgcggcaatcggaataggacgggtccgggaagcggcaatcgcgacgcagtcttgcgggttctaggggcgcgagttgggaaccctctcccacccgaaaccccgtcagacttacctgcagcagcacgcggaagatgtaccagccgatgatgagcagttcagccgaggccgccgccactgccgccatggttccaagaatggtaggtgggtggtcgagaaagagggtttgccgagatccgctggtctcggagtccgctgttgggcgcactgccgcagccgcggtggccgcgccttaagtacccgcccgccacctaagtgcgcatgcgcgccttggggggtgtttatgaggaggggtggctgggggcgctcctcattcgccaggagaggaaaaaaataatccatctgctctttccataccgacccccgcctcctgagttccatcttagcccccttccagaagattccgccgtgcttgcttttggattttgctttaaaatggaggggtaccacgactctgggtagagtacagggcgagaatgggggtgcaggtctcttagtgtggcgcccttctccccagtccctggcctgcaaatttgagctcagtctccggtgccactccaaagcctaccttggggatggatggaaaaccgaaattagggaggggtcatctgccccatagagcaaaaaacgtggtgcccctttcagaagctttggcataataggcccgtgctcggcgctcttttcctaatactgaatgagttttaagcccaggtcctctgcttcatgagggtgcctgagcgcgtaacccgtctgattctttacatctctcttacggtagcgaggagatgagaatctgcggtggaggtcgctactgtagggagct

SEQ ID NO: 15169 - DNA, 7014 bp, Human
tttctccattcggaggtttaaattttagactcaaaacacctaaggaaactcacttcaccgagacggggttgagtaaaactgtgccactccgagtaagtgtatctgcagttgtccacctccgtgtgtcctcccctgcaggagtccagggtatgatgatgcccagccccccggcaggattccaaggtctggtttcctcctttcatcatttcaatggtttcctgccctccatttttcattcctgatcccatagtaccacaaaaaccttggctagagttgttggtagtttgggtcataaatccattggcagagcactgaaataataaaatgaaataattcatgttgagaggaaatggattctaagttgtcatgagaaggcaaaggagagagaatatttgttcaaccttttattcattcattcattcattcattcaacagacatttatcagtttctaattatgtgcccagatactgtcttcattcattttgtgctgctataacagaatacctgagactggttaatttttaaagaacagagatttatttcttacagttatgaagtctgggaagtccaagatcaaggagttcacatttggcgagggcccatcccatggcagaaggtggaagggcaaaagagcacgagtgagagggagagggagagagggagagaggagcaacagggggctgaacttgcttttacaataagctttcatgataataaacccattctcatgataaggacagtaatccattcatgagagcagagccctcatgacctaatcacctactaaaggtctcacctctcaacactgttgcattggggattaagtttccaacatatcagcttttagggacaaatttcaccatagcaaatgcaaaagcctagggatataaagatagacatagtctctcgatggctccaagaagatcttattccagggagagagaaaaacaaatactttgagaatgtgattactctactatgtgggtgagcacaaaatgttacaagagcacagaagtagagcattaaaattcaaatccaaacagggtaggtggaatagaacaggtaactggaaaaactctgagctaagagactagggactagtaggagtgggacaaacaaggcaaccactgtagaagggtctggaggcaaaaggcaaacaatgtccttcaggggtccccaacttcaatcagttgagaacagctaccacataagattagggttggggggagttagaaaggttataaaaggccataagatataaagatctatatgctatgctaaaaaaatagactttattatgaagatcacagggactgtgaagaattttaactcattacagagagaaacacatttcaaaaatatcattctaggcaataatgtggaagacaaataagaagacaaatttaagttcatggagatcagatgggggtcactgcatctgatctgatctgatattccaggtaaaaatgataaggacctaagccaaggaggaagcagtgatgactgaaagaagtagatggactccacagagagcctacaagtatctagatggatgaggcaatcaaggacagagttagaaattattcttttgtgttccatgaaggcaaacaggtagatggtacaactcactgaaacagggaggaaagatgtgcttatgggcaagaggagagtgagcaactaaagtttgaacatggtaaacattagaaacatgtgggatgtccaagatgaatatatgaatatgcggatttggaactcagatgagagatttgagctggagatataattctgggagacactcccaaataggtgatagttgaggccatgggaatagaggacctatccagagaaaattgtcaaccaaaataaaaaagggctaaggatagaaccacaagaaaaatcacattttaaggggagggtaagagaaacacagctgtgacaggccagatctgaatagccactgagataacagagaaaaccaaagtggcaggaccctgaagccatgaagagagaatatggtaaggagtgggagcagccaatgatgttaacaacaacaacagaaaaatcacagcaaggtaagaatgggttcaattaaagtataagcgcccattggatttaagtgaaagaatagccattgatgagctttgccaaaagaatttccagggagtgctgggtaagcaggaaggagtattatagagaaatcaaatataattttttctttcctaaagttcagtttgaaagaaaaagagagatgtggagggaactagaggatgacaaagagtcaaggaaatgctttaaaatgaaaaagtcttcattaaacattaacttaatactggaacttcactccgaccctctgagccataggacagaagtttagttacagtggtaacctcgacatgtcagttttcattacaaacagttacattactttcaggacaagaacctccattacattcaggttcctttgtgccaccttcctatcaatttaaatttttttctacttaaaatgcagtctttaactaaattgaaagatttttcaaatacagatgatttattgaacctgaaatatatctacaaaagtcatacttactgtcgcattgccttagaaaaaaataccagaaaaaaagaattgaaaagtagccatttggtggcagtgctaccctacatttttttatttaagttgccattacaataaaattcaattacaaaaaaggaaaaaaaaaaaccctcctaattattaaatcttcttgatggtataatttcgttgtaataaacacaagttcaaagatcatatttctaagtgaataaaagaggaatttaaaataaactaaaagcaatgctgagcctacagggctagctttcatacttttattctctgctcctttctgtcctcctccatccacatttcccaaagttccttctcacagggtatcaacaactctttatccatgtcaataatttctaggtttacttttccagtcctgattattcacccaactcctaatcccatgtgcatgccttcaagtgaaattcagatccaaagctaaaatgatcacttttactcattgtattaaagcaagtttatagattcaagatgaaattttatgtttttgtataaattaataattccaagccccttttagaagtgttcctaacacagaacaggtacatattgtgaaatggccactcaatatcatcagctctagcattaaatggcaaagaacagatattaagtaaaagtcatccatgccggtcttaaaaataaaataagaacttactatgagtcaaggactgtcaagggattaaacctgctttctcgctggagagatcatcacaggtttctacatgtaggcacgtcaagcatagatgggctatgattttgcatggtggtgtggaggagttgaagagagaaatagtgaataagaaaggcatcttcaccccgagacatagaaaaggctggatatgtagtcgttgtccctggctatagcctctgccactttgactctgctttttactttgttccttaagttcagtcagtcaacaagcttatcctttatacctttgaaatatttcttattcatccctatcttaatataacaattaccatcatcctggtagaattaactcatgcttaaactaagctttcatcttccccaaccctgatgtcttcctattctcactgatccccctactgactcagcttcacgctgcttgattatacctctctcctgtagaaaagccttggctggctctcctttaccatgagaataaatccgaaatccttagtgcagcatttagaagtcctatctcccacttgtttcttaatattctcttctctaacaccgaacttgtttcaagcctcttttccaacacatgatttcttctattctaaatcaatttatttattatttgctaaatagcccctaaactttatcatctcctgtcttgtaggctatgctgttttcctcttctttagctattctcaccgtctcttcactttcaaacccttcttattctttaagttaccaagtaagctgtacctcttgtcaccagcctttctggttgatccaaactacatgagtacatttaggtatcataggtgtttttgaactctgacagtgctttatcatattggtttattgtcatgttcctattttgcttttccataaagtaggatctatttctcataaataagttggcatctttttgaggtaagaacatgccttgtaagtacttttgtgtatatatatatattttgtgtacatatatatatactttgtgtgtatatatatatactttgtgtatatgtgtgtgtatatatatactttgtgtttatatatactttgtgtgtgtgtatatatatatatatatatatatactttacacaaaacaagaagcataaaagcacctcagaagtcctaagaaatatataaggaaagagagtggcagtaatcttccaaacccctctccctttcttttagatatatctcattgatattttcctagctatcttgagaacttttagcaagcttttttccccattataaatggtcaacaagttacataaacaaattatatctggaaatatacattgtagagtgcaggcaaaaaaaactattgttataataaatactcaacatcaaagaacaagtttaaactatgacactagagtggaaaaaagataactaaaataatacatctggattaagaagtttaataaattaccactatataaacatatgaatattgacagacaatatctatgcctatgaaatctgattcaattaaaaatataaattaactcctaaattttgaaatgagtttatgaggatgaattaaattatcggagatacaaatacatatttatttaaaaattacttaccactctatcgtctccaggtgcttctgtgtttgatataattaagttttgctgtgctaaatcttcaggaaaacgtttccctttagttgcaccaaaaactccacatactaaagttagcaatacagctgaatttaaaaataaaaataaaataacttactttagcatacatagaataaaataatcatcatttatttcttacgacctaaggatcaaagtggaaaataaatccactaagcatggtttcccatgaattatcttggctgttctaagttaacatgtcaccagatagcttaggttttagaatcagaagcaatcatctgtattttttcattatatctcactaattgaattctgcccatcaaaataaagtacttagaattatgagttaagcagtacataaagaaaaaaaatcactgacatttaagacaaagactttgaaaaaatttactgattcccctaaaaataattttcctacatgaaatgtaaaaaaagaattgtgtacataaaaacatgagaaaaacagactgctttcctagaaaagatttatctttattgaaactactttgtatcttgcctattaagaattcttattctaaatcataattgtgggagattgaaaatacatgataattaaactaagaagaacaacaacaattcttccagtctaaaagaccctatagtgcattggcaaaatccccaaacccagagcactacatatttttgtatggcctatgagctaagactttgtattttaaaatggttgaaaaaattcagaagaataagagtttataatgtgaaaattacagccgggtgcagtggctcacgcctgtaatcccagcactttgggaggctgaggcgggtggatcacctgagatcaggagttcgagacaagactgaccaacatggagaaaccccgtctctactaaaaatacaaaattagccgggcacagtggcacatgcctgtaatcccagctactcaggaggctgaggcaggagaatcacttgaatctgggaggcagaggttgcagtgagccaagatcttgccattgccctccagcctgggcaacaagagcaaaactctgcctcaaaaaaaaaaaaaaagaaagaaagaaaaaaaaaagaaaattacatgaaattcaaattttacagtccatatataatgttctattggaacacagtaaagcccataattcacatatttttatagcagtgttactgtttgaaggacagatttgattggatacaatggaaaacacatggcctgcaaagcttgacatatatactatctaatcctttacagaaaaagtgtgccaactcttgcctaccctacatggccccacactacctttctggctccatttcctaatcctcttccccttgtccactctcaccacactggtttccctgccactccttggtttctccagacataatcacaaattagggccattccattgacttccctctctgactgaaagttcttcccccaggcgttccgcctggctctttcacctcttccaaaaatcattaaaaataatcttctcagacctaactctctattgaaaattgcaatcactggcaccaataccctcctcaccaacacactccacagcactacagatcctaattatttgcctctcttttttttcctccatagcatttaatttattcattaactgtcacaaggcagaatgattgtttttgcttgtttgtttgtttgtctttccctatttttcctaagcacctagaacagtttcctgcctacagtaggtgtttgatatatgtttattttttgacttgatgaaaaataatgaacacattagaaatttactacgtactgttctaagcacttcacatgcattacctcatttaatcctcagtgctacaccatatggtaggctactacagttattccttttacagtgaggaaatgaagcacagttaagtaatttgccccaggtcacatggcttacaagcaatgaagttggggtacaaacccaggcagtctgattcctgagttctttgctcttaacttctactcttatcacaaaacaaagctaatctaggctggaggaggttaacagaatttaaaattggcaagatatacccaagaagagacattgctgagaacagaaca

SEQ ID NO: 15170 - DNA, 8286 bp, Human
atactaagtaccaaagaggttccgaataaatctgcacactcacattagtgtaattcttatcttggcatacgcttcttcctggttagggctagatccttccaaaagacaatacattcagagtttttgtaattctcaacaataagtactgggatggataattcagttttaggctttattcaaaagttacttgtgactaaaactgtaagtataaaaataattttttaaaggaagggataaatgtacaaactcttagcaagtagagaaataagagttatggacatcttctagtgagttgccttaactcataagtactggtactcttaaccctagttagttacagtgtagccaagcttttaaaaaagaaaaggagaaaaagaaaaaaacagctattttcacaagcttcttaccagctatgattgttgttgcttgtcgcctcacattatttttatccatgtattcaccatagtctattttcccttccaaataaattcgagacctgatataaataaaatgtacagtttttagttgagatcttaatatgctttataagagtcaggtcagggtggtactgagtatatgacaaggatgaaatatataatcatatataagctaatttttgctaccacttctcaaggttcaggattaggagtactgaaacagagtgtccaaacagacttggtaacatctaggtaaaacagacaatgttttcatctgtcagctatttctcttacggaagttaaaaaataaaacaaaacagttcaaagggaaatttagtggcaacatttaaatctctaggaataatttccaatgtatcattttccttgacctttgattttggagtccctaacagacttgattttcacttatttatcaattattttctatgaccttagaaacttagatgattaaaattcaaaatatggatttgtagttagtttagtataatattaccctgagttaattactaagactatttctacactgtatcagcttagtataccacttagaggtaattactaagactatttctacactatctagaggctaaactagataacaaacctaatcgtgattttcaagagtggaaagatgacaatagtaccagttttgagagtctaccaccaccaaaaaagtacaacacagaaagattagtgaaacatcaggtgctccccaccccacacacacacccatcaatcagtaagtgggagtgcagacacttcccttgaaataccttatatgtgtttgtgtgtgtatgtgcacatattcataaacatacataaagggcaatgaagatacataggaagaaaagctatacagttattgaaaagaaaaattttagtgattgctaaattatttttcataaaatatgttttctttctacaaaacaagtacatttctaaacatattaactatcaatacaactgctgttacacacaccgttttgtccttctatgagtttggaaaacatactttttatacatactcaatccaagccttccaaaagggaactattaagcctacagaaaatcatcaaatataaaataactgccacgaagatgaagttggcatgtcaggcttcagacattccagatcctctgctggaaataccatgtggcagccaacaggcaagaagccaccctcagcatccccggccacagaggcacaggaattcctcaaagcagatgtttgacttgctcaaatgccacttgatacactttgccttctctcctgcctcatctatttctatttatgtacacaccctgtttgccctaaactgtaagttcttagaaagctaaaactatgttttatatatcttcaaattagtcacacatggcaacatgccatgcatatagtatcaaggacttagtaaatacctcttaaattaatacagtcattagtagtactcagggatttaagagactacacactccttgccatgagaacacttcttatcggttctttaaatcattcaattcataagatccttccctcttcaacttacccctttttcacatattgatatgccacgtctctgaggcctggccggaatactgatattctgtgccatgttgtcttttgactgacatcacctaaatcataaaaataggaaattggttacaaatgccaacagacaacatgcccaggaaaaccaatgtcacgatttctaagagaacaaacagaatgaaagacagatcttgtttaaagtggtttatctctaaattagataactggcaataaataatatctatttattgctgataaaattaaaaccccagtcttttgtactcacccagttggtaaacttcactatcccctgatcgccacatctcattagttgctagagaaaatattgtgactggattttttccttccacctgtctcaagacagggtcctgacccactcgcccaagtaagtgcacacgattcagggctgaaacacaacatcaagaccaaatgagacaacctgctatagactgaatagttgtgccccttcccccaaaatttgtatgttgaagctctaaccctcaatgtaatggtatttggaagtgggatccttaaaaggtaattaggcttagatgacgtcatgagggtgaggtgtccctataggaacaggaagagttcagaactttctgtctctaccatatgaagacacggtgagaaggcaaccatctgcaagccaggaagacagccctcgccaagagctcaatcatactggcacacgaatcttggatttttagcctctagaactgtgagaaataaatgctgttggtgaagccacctggtctatggtatttttttatagcagcctctaagctgaccattaaagaaatccacacctggctgggcgcggtggctcacgcctgtaatcccagcactttgggaggccaaggcgggcggatcacaaggtcaggagagagagaccatgctggctaacacggtgaaaccccatctctactaaaatacaaaaaattagctgggcgtggtggcgggcgcctgtagtcccagctacttggaaggctgaggcaggagaatggcatgaacccgggaggcagagtttgcagtgagcggagaccgcgccactgcactccagcctgggcgacagagcaagactcagtctcaaaaaaaaagaaatccacactcaagactgagagaaatgtccagaagaaatgctataaatatgacttcaacttcaatctctgcattaagtaaaacccaagttctggaagatcagaaaataagttaaggaatgaataaggagaggttgcgagagaagagagttggcaagaaagaagaaaatagtcatagagaaagcagccccacaaaacaaactgtaagctctagatcttaaattctttaagatatcttttttaactgactgtggagctaaaagaacaaatctgagatctgaaaatctttataaacacaagggaatatttctgtgaagaaacaatatcttttacaatctcagcctaatacaacataacccgggaagactcagataaccaaatatgactcaaggaaattcttatgcaggacagtgttgacaagaatgagtagtaactggctgataaggagaataggggctcagtttatactatgtctccacagcctgatgtgtcaaggctaagatctgaagagcaaacatgagctaaaagcacaatggcaacatggttaacccaagcagcatacctcttctacaacacatttgagattggcaaattactaaaaataacattttaaacttggaaattagctacttacatctttcaagaaccaaactggtagttgtttcggactcatgtcttacaaactgacgaagtacctaaagaagaacaaatgaataacatggctttaattttttaggaaaggcaaatgcaaacagaagaattactcacgttcattcaccatatagtcagtagttcctgaaaattccagaagagaagagaagctcttctcatgttctcccaacagagtgccagaaggccccggcaaacacttcaagagcagcctaatgcagaagcccaaaggtagaaggaaggtactagaaggcatgctcaaagttaagttatagtactcccatttattttgcgacatctccttgattatggcacttctgtgtttgcacacaaaaggaaaaatcaaaatagtatcactttaacattacagagtatgataatatttgtaaatccaacctgtacctaagagttgctgccaagtattttcaaaatccagctttcattagctggaaagacaaaaagagacaaaaagtactacatatattcaatatatacatcctctaatttttttttttagtataaacaactggtatattactactgtattttggttacagtagactttagaaattaagaaatttagatccaacatgggtactgatttaatccatcattagaccaaaggagagttaaaagagatgctttataattaataatttaataagtagattcattaataacatatgcaatgatcaaacaagtgtcaggaggtgtggaataaatgcaaagccttactctcaggcataacgaacagccagttagaggagagtccccaacctccagggctgaggactagtagagttctgtggcctgttaggaacctggctgcacagcaggaggtgagcagcaagcagcgagcaagcattactgaccaagatccgcctcctgtcagatcagcagtggcattagattctcacaggagcagaaccccattataaaccgctcatgcgagggatctagggtgtgcactccttatgagaatctaactaatgcctgatgatctgaggtggaacagtttcatcttgaaaccatccccacggcacccccctcctccatggaaaaattgtcttccatgaaaccagttatcagtgccaaaaaggttggggtctgctggtttagagaacgagagataggttacattccaacaaaacaatacattctaaaactaatcacatgaatgactttctgacacagcaacaggaacatattccaaagtcagattccctgtgtctatgaaactgccttcccctggttgctccttcagaccttaaaaggaattaggatacctaatatgactaatctaaagtgtttcattttaaaataagcaaaaattatgatacataatacctacttcacaaggctattgcaaaaattaaacagcttcagtagtgagcttagcctaatacagtttttataaatatttcataggaaatttcctgtttttagtgcatcaaaaaaggtctaataaatttggttctttgattaaacacaaagactcgactgtccaagtcaaagtcacatcactgtcagcaaaggtagtcactaccacataatagcagcaatcattactgaatatcagctaagggatttatctattatcaattctaaaactaaatctacaagttatgtaaaattattcccatttagggctgagaaaacacctcagagagactgcatcacctgcccaagctcctgcaggaagtatgtggcaagtgatctcaaggacccagggcccttgacaccaatgctactgctttcccgaagccctctgctgcctccttaatttcaagagctcctgtaaagatgggagtacacatcactgaattcagagctcagagagctagccattctatcagagaaacatttttgaagtggcagtactgttaatataaaaagcagaagtccaccaatcaaataaacaccaatccccagggtgctgttggctatctaatcctatcactaaacttaggagcagagggcagataagaaaataaagatatgagtacaacatactatagaatcaaactgctaatgagaacctgtgtcatgattctggaaatgtcatttgagtgctcagacaagctagacctcataaatcttacacagagatttataataacaatgtctcatttggggcacacaaaaatctactggagaagattaggaaaggattatttaacttggataattttttaaattaaacttttaactcttatttaaagacattttaatactgtaacgttagtgttaagaagcaataactttttcatgtttcacatttcaatacagaaaaaaatagattaaagatacatacaggttaaagtggggatccaagaatataggattaaggtggggaaaatgacagagtcatggaggaactggttcttcattggtcttcacaggaggatggggagtaggagagccaaagaagaatctacaggagctggtgcccgaatgtggtaagtgaggaaaaatggtagtctaagctggctcaaggtgggctagtgtctggaaaagtgaggacccatactaagtggaatgagaaggcattttctacatagtgaaatctctggtgaccactgagacttgagatgctctcttcagtgtggaaagatgggggaagaggaacgtttagcaacacaggaggtagatggtcaaaaaagcaactacatgccttaagaaaaaagttggaacaatgattcctacagtctttaggtcactaaagacctttaatgtcctctcactggttaaattcaagcaacacacacacattttaaaaattaatgattcctattacgtgtgaataaacctgaactttttttttgttttagtgaacataatttacactggcaaaatcgtccccaatcctccatatcaaatgagtatagaggtgggtgggtgagctcaaaggtcttttgcccctgtagttaaaagcctaaagaagtcttctgatcactgtggctgatagtaatacatctcagtattaatacagacaagtgactacctgtaatacaggtcttcgaaacatggcttctattttcttttcttacagtctaatctttaggcttttcctgaaggaaaaaaacaaaataagaaaaaaacattacctcttatggcaaaagtacaactcaccagtcctaaattcctaactatattcataatttttatgcactccaattttgtgaccacaacgtaccaacattcctgcacatctgatgaggattccttcctccctcccaaataaactcacacctgtatgtctttttggtcccaaataacttcctcttcctccaacccatcgacaaaattttgattctgagttaatcccacttccaatccactgtcttctcaaatttcattactatgcaagctcccttagagcagagatttgtatctgctttattcactgccattttctaaacttctaaaaaagttcttaatgcatagtaaggcctccataaatattagcatcaccaagggacttatatctgaaacctgttactgaaaaattactgccttcatctccgttaacaaagaccaagcagcgtagagacccccgggctagccagccacaccatagggagaggtggacaccctttaccgaagatggcgccaccacctgaaaaccgaggagaactggaaggaaatcacgcggtcctccgcacgactgatgaaagggccagacacctacacagaaacacctcccgacccacgcaggatcacgcgcagccaaaacacacgactccagcacttccttcgcgctggctatcccttcctccctcacctgacgatctaacccgagcagcccagccacgcaggggatcacttccggcgcacagggaacgcaaagctcgccagaggaaaaaggaaacagaaactccgcaacttgcgccttggaaatactgccggctagcgctgcgggaaacggctccccttaactctgaagttccgcgatcttctctttgtgcgcgggcggatggatcaacgccgccaagtggtgagtttggaaggtttcaagtttagaaggtttcaagtttagaaggtttcaagtttggtaaagaaatgaaattatgtgatgaggtttctaactgggcccaggagggggcgaggtaggcaaaacagagactagctctgcctggagggaaaaaaaagcaacatttgtgaccagcctaggcgacatagtgagacctgtctctacaaaaaatatataattagctgggcgtggtggcgcgcgcctgtggtccaagcttctccggaggctgaggtcgggggatcgcctgagccctggaggtcgttgctgcattgagccgtgaacgcaccactgcattccagcctgggcaacagagcgaactctatctcaaaacaaaacaaaacaaaacaagaaaaagaaaaaaagaagaaaattaaaaaaaaaaagaaagaaaaagaacgtcccaggtctgttgaagcactaagaaaagcagaaaaagaaaggggagccagggaaggg

SEQ ID NO: 15171 - DNA, 14126 bp, Human
gcaagagagcgtgtgcagggaatctgccctttataaaccatcagatgtcatgagacttattcactatcatgagaacaacacaggaaaaaaccacccccatcatttaattacctctgaccgtagggattatgggagctacaattcaagatgagatttgggtgtggacacagccaaattatatcacttatcaaagttaagctaattttatcaaatgattggctagtattcccttttttctataatctggaaggatctgtgtaagaagtctgttttaagtgatgaagaaagtaaagttccataaagcaacaaatagcattttaataattttctgataaaagaagatctcttttttttcagaattaaattttatttcacattgatagaaaccatgaaaaacatttacattttcccatgttacagcacaatatttcaacggaatatttcttgccataaataatatcttgctgatttgtagaagtgaaataacagtttatgttctccaaggtaaagaaaaatgacatagtaaatggttgtttaaaatttttaaatccagacataaacatatggcttcattattaacatcctataaggtccattactaaattatttccattatcaattagcacccatttataaagatgcattcttaatattgttttggtcagctggaatacagcagaaaaattaacacagttcagaaatatcaagcatacatttttgctacatattaatctgtatggtaactacattttatgtgtagggttctgactagcctttattacccataagtttgttttcaaataatttttaccagtaatctggaaattttgacaatttaaaatgattgctatttttatgtttgcatgaaaaactaatacaaaaaataatttgactaaagtgaaaatttcaaataagtccactggcagatgaaagtaaagcaaaaaattacaataaattcctcatctcctacagtagttggtttcaaacatgtatacaaagtaaactctatgctatgggaaagtgaaatcatcttagaagttagtttttaagatcagtcttaaagatatttcagaacatactagaatatgatctaattattctttcagctgtttacagaaaaataaaaccacagaattattcctgttacctgggttgaagatcctaatagctaggtgtaaatttggataaggtacagtaattcgaaataagtagtgcatgaagttttaatgtctggtttctctataaagcataaatagattttaaataccttatatctgtgacccagaatgtcaaattacagcatgtattgacagtagctgtctattgcagagaggcaatacttggcctgctatgaaggacaataaagaaaaaacatactttttttttttcttgagagaaaagagtattaaatagaaataatatcagggaaaataaaagcctggtcccaaaataaaagggccattaattgaagagaacgattttactttttcttgacaataaacagcattatccctattattaggaataatgtaataccacctcattcttattatgtattataatcattatgtatatatgaacacatatataaaaatacagacactgcatggtgactaagcaattttggaataaatccatagactaagtcacagcatgcataaattgtttatatcttaactgctcatttatacctgaacaaattttcattaagcatactgctaattttcaaatgatgtaataaaaaatctggtggcagtactgtattattttgctgaattacatttgagaaaaaagaagctacctgcttcatctattctaatatagtagatcctgggtcgtcttataagaatacatgtatagaaacttaaaagatcataaatttctcatgaggagacattatttgatctgtgttattggcatgtatttgcaaaacattttaacactgcaaaacattagaaatttgaagactgggcatgggaaaaggtttatactctactacaatgatgctggtgtacttctacacaaggcctcttagtgacgtcaatcaattggaggtaggagtttatcaatgaattgcttgacattcatcatttcctgttgacacgaactgtgcatcataccttcataggttttaaaggtcacattggctggattcaccaatgttttttagtttttcaaccgtaagagaaccaaacatcaggggaaccaaagggtcacaatccccgtggcactggagaatagaaatatctctattagcaccaccgataggaccctgtggaaaggaagcccaaagtggaagccagcaattgagtgcagtgacacctgccagtttctggtgcgtggtaagggcagtatataaagataaagctcctccctgagaaaaccctcccaaaataattctgttagaaggaatgccattcttcacttcttgatcaatcaaagcttttatattttgtgctgcctgtttaatcccagattcatcctcctgtgaatctggtgaaagcccaataatatcaaaccatgaaggcatagctatgttcatatttaatgttaacaggcctaacaggcgcatgcgggcagatatatttgatatgtgaacttctgatacctgcaaaggcttctgcccatccgtgcccagtatctcccaatccatgcaggaaaatcacctcagtggtggccttccgggcggcgggcacgatggtgggcagcggggttgacatgttattgccgcacatacaccgcctcagctcacagcgcaagcggaaggaagagcaggcgccccgccgctgcccaagggcgtgcgagcggcgagtcccagccggccccaccggcgagaagatctctttctaactcacatttattctgatattaattaagaattacaaattgtacctctattctagtttgactactataagacttttttaggcacagggaaattacaagataattatctgggaatttcaatgaaaagagctaagctgtaagaacagagttttccagcacttctaaccatcatccaattttaggtaattggatacgcacacatatacataaaaatgcaacaaaaattatataatacatactcttgctatttgcaatgcccagtgatattttggattctagtttggtctatatctttgtagaaacattctggttgtggctgacatagttgatttcatgacccattaatgtgtcaccaaatatagctttaacactctaagggtcttgggatttgtttcagaccatgacattaattctctgtatgacccaagttgttaatttctctgtgtctcaatttcctataaaattccactaagcttatatttttgctgaaagtataatatgatacatatgtcttaagattattttgaaggaggcaaaaaaacttttaaaagtaaaaaggttgaattcagggattattatcagagtcatagctcctccagcaaccaaactttatgtcataatacagaagtgtggagttgggaagcaattttaaatagtgagttttaaggattatgtaaaatgtgcaactaccatatgacccagcaattgaagtcttgggcatttatttcggagaaataaaaacttctgttcacatacaaacctgtatgtgaatgttcataaaagctttatttgtcatagcctaaaactggaatcagctcagatatccttcaacaggtgaatggttaaacaaattgatacatctataccatgggatacttacttagcaataaaaaggaactaactagtggtacatgcagccactaagatgaatctccagagagtaatgttgaggttttttttttaaagccaatctccaaaagttacatactataggcttccatttatgtaatatttttgaaaagacaaaaatttagaaatggaggagagatgagctgttgccaatggttaggatcaggacagggctggaggaatggagtgagtatggttataaatgggagacaggacaggtacttttggtgatggagctgttgtgtgttgtgactctgatggttagtacaagagccttcacatttgataaacttgaatagaactaaacacacatgtgcatcaacatgagtacacaaaaaactggggaaacttgaataagacaggtggattgattcaatgtcaataacctgcttgtgttattggactatagcactgcaagatgctaccagtggtggaaactgcataaaggatatatgggagctgcatgtattattgcttacaactagatgtgaatctataattatctcaataaaaactcaattaaaaatagattattcagaagttgtagtactcccctctgtaaatactctcctctgcatgtgtgctcacacacacacacacacacagacacacaaacacacacacacatacctcttcagatcagggatacactcccaaacaatctctctaaagacccaaggttaagaattcctgtctctctttatgccacctccacctcagcccttgtagacatggtggcctgctccctgtgtcacccttcccttgactgggaacattccatggtttttgcccaccaaatccacaagttactcattaattaaaataagccatccatttaaaaaagaagacaattagagagcagtttgtatttcaatatgttattggcaatcagcaaatctagaaatcaatgcagccaggtgtgagggacaaaggttctttctggttgggtactcaggaattgcttttcaggaaagagaaagaatgatagagaaggctaagatgtgtggctaggacacaggtagagtgtggccagattttgcagcgtcttaggtcctggcatggtgagcagggatttcattgtaggaagcggaagtattttaggaagatatctggaatggcaagggagagtgttaaagatagtgatatagtttggatgctgtccccacccaaatctcaagttgaactgtagtcccagtattggaggtggggcctggtgagaggtgattggatcttgggagcagatttctcataactggtttagtagtatcctcttggtactgtggtcaagatagtgagtgacttcttgggagatctggtcattgaaaagtatatgccctgccccgcctgcacctgtctttgtcatgtgacacatctgcttctgctttgccttctgccatgaggcccctccagaagcagatgcctgcaccatgctttctgtacagtctgcagagctgtaaacaaagtggccaatctgccagctgcttgttttcagtctgtgagatgagtacaagaattgagagtgtgaatttggaaacttgttccttcattatggatagtttgagattcattactttaccatggacatctagaggttaggtggtgtgggcctgggaagtggttaatctaacagagaaaagtgtaatctgataaaagtttagacatgagctttgaacaagtgctaaaaatttgaagtgggatatggcgtcataagctattatcagaatactgaaagaaaaaaaaagataaaccttattaataggaaaacatttcccccacaactactgtagaaatttctgagaagaaaaccataagaattcaattcttttcattccagacaaggctgcttttatttttcaagagaacattaacggaacaagaagtttttcaaataaacactcagtaagggcgggaacaggcataactgatttttttcagtgttttatatttcaaaaaagctattaaaagatttggatgcttgaggtattacataaattatcctattattgtagcaatgaaaggatttcacacccatacatttattcctgatttgatttccctccatgaaaatcctttgttttttaaaaatatttgtcacactgcaaacataattcacaataatcaagcaatatacttaaaaggtaagattttaagtgcctcattaggagggggaaaaaagctgaactcacatagctacttaacaatccacttcttttcacattgtatttgccaaccacctaaaattaattgtccttagaaacttgtaacagaaaggtaatttcacttcacaatttttgtctcttataccaaatagcctatttgttagggagaatggatgaacacttgttggtttcacgtcacttgcagactctgcaacttgaaggaaaggccagcagcacagtgttctggaatgtcctgacacaaagaaatatacatgattaaatcctaggatatgtacagagatgatactttgaggtgttatccttctattcaaaaaagtattttctgtatctgcctcttcccactgtcccctccccatttaggtccatggtcagtacctcaggggagggcagaaatgagctctccagtagaaaacccagctttagtacccaaaagcctaaaaggagaggactgagcaagcatacatatgaaggaagatggacttctctaagaccaggagaggattcctcaaggttggaaggagtaaaaaaaaagagagcaggattcccaagaaccaaagatatggtcagatggtcatatcccagaggtcaactgcattgtatgcctgggaaggcgggaccatagacaggccagggaaggatttctatgccctaaaaatgacaccacacagcaaaaagtgggacctgagggaccatgggcaccaggactctaaacacctcaatggcaatatgggggccagcaaccatcctccctacccctacttcaattcagtgaaacagagtagggtcttggaattattgaaccacaccaagatggtcatgtgggggtggaacttcaggaaagggctaatattctgcccactcttaacaaactaggagctcaaaatcaaaaaactaagttgagttatagaatagaaagtcacagtacttacccacctgagctgatggactgaaattcatcctgccacaaatacacacacacacatgcacataaacacacacagagcatgtgtatagacaccgtttaagattggtgccacttgatagactattatttttcaccttgaactatatgacaactacaatattctatgtcattagaaatttccaaattcatactgtcttaaaatgatttgcattaaaggcaaagcattgtgtgtattgtatgtatataggaaaacaggtacaaaggagagaagcatttcttcattatggtggcctagtaaattcttgtttgcaaatatcactggaaccagaatagcttgatgtgacctaccagatttgcctgagtctcacatttaccaatggtaggctttctctactatcacattttagtcctaaagaaatgtctttccaagttgatctaggatgggagtagcaaattttttcatttacttcatacctgtccaaataagcctgcaaaagcgttatcttcctctacaatattatactatccccagcacaaagacacatttagatatcctaaatggacaagtcaaagtgtagataataaaaattaacaaaagaagaatggaaaactattaaagacctaacttgctttcttctagacttttgacttcattatctggggaatattcttaatccaagagacaaaaccaggggataaacaaaaattgtacataaaatcttccattttaaatgaagctatccaactcaaaacagttctaatgggaatcagcaagcccattcaattcctgttagcaaatatgctaaaagaaactaaatcagtcagtgcctgtgaggtgagaaacaagagcaaattgaaaagcacctcaagtttaaacatgaagcaattaagagaaagagacatggctaaatctatcacagtaagcctccagtctattagcttgtttcttaaaacttgaaagcaaagtcagaaacaaaaaaatcctacttaaattcttaagtgccataatcagaatggggcaaatggtctccgtaaaactgttcacgtaaatggatcaggtgtctgtcaagagttgggattcagggatgcaaggagaaatctctacagacacacatacacacatacacatgcacatacacacacacacacacacacacacacacaccaccccactcccatttccatgctaaaacacaccccctctaatcctacaaagtgtagcatttcctcctgaggagtacttcctttgagcaaaaggattacattcagaaaaccctgcataaggcagaaaacacctctggagggattaacatgactagcctttgctgcaacctgcaggaatatgattgccgagcaagtaacaggcagtgctctgactggggaaaacaacatggtgttcaggaagggaaccctgttgggagcaccttcatgagcatcactggactttcaaaagtaaggtgcctgattaaggagagttaaaaggagaggtgagagccaccaaggccctcactattcaagaaattcactttggggaaaaggttatgcagtattaagggcacaggttttggaatcaaaagatctaggttataaccctagtccttttctttacaaatagtgttaatcttctcaaatgcaaattagaatataaataatcatatggttttaagaactcaaagggtaatggctagtatctattaaacactttctatgcaccagttactccatctggattacatcaatgtttctcaaattttaatgtacacacaagtcactgagacatcttattaaaatgcagatgaggtcgggcgtggtagcacatgcgtatcatcccagcaattcaagaggccatggcagatggatcacttgaggccaggagcttaagaccagtctggccaacatggtgaaatgaaaaattagctgagtgtggtggtgcacgcttataatcccagcgatcccagtggctgaggcaggagaatcgcttgaacccacgaggcggaggttgcagtgagccgagattgcaccactgcactccagcctgggcgacagagcgagaccctgtctcagaaaacaaaaacaaaaaaacaaacaacaacaacaacaaaaacaaatgcagatgaatcagcaggttttgggtggggccggagcttctgcatttctaataagctcccaggtggctgctgttgctggtggtggtttacagatcatagtttgagtagcaagggtttatatcactgaatcctcacaccacacctaggaaggcagactattattatctatgcaaagccccctttagatgggctgggggaaaagcacaaatgctgtcatagtgctggaattttttaaaaagacagaagggaagaaagaaagaaagaaagaaagaaagtaaggcattaggctggcttgtgtatggcttctccttattattcaaggtatagacccgaaggccagcagcctcagcatcacctgggagcttgttagaatgcgtactctcaggcttcaggctggacccactgactccacatctgcattttagcaagatcccaggggattcatgggcataataaagtgtaagaagcactagattaaagggttagactcaatttttaaatcgatatgcctattactactgagaaatttccttgtataaaattaaattttacataaaaattataattttaaataacaaaggaaaactatgaaataaatcccctccccctacatacacacacagtaacaagtagaaatagtcttcctagtcacaccgtttgtcagaatggctccaccacactcttgctaagatctaacaattttgatttaaaaaaaatcctaaccaaaagtaaaaactaaacaacactttcaagataactgcccctatattctataagttgtcaagtgcataaaaagttgtaaacaaattctactccatttagggctcttgaaattcaacgctaggcattacatatattctattccacagatctgcaaggctatatgtgcttctcccataaaggatgttagggaaacattaggaagctcagattccatattcaagatgtctattttatctaagaggtggtacaattctagaggaattctatcaaagttaaagaactactgcagaggaaaagaaaagggactaatcaaacatcattcgaggaaagacatctttactgcatatttgtgaggtttagaaactaccataggaagagcgatttcttagcaaaatgacagtggactgtcccctgcacatggtcttgggattggttgggcctaactgaggaggcccttgcagaactctgtccaaagtgctctgtagggaaggagaaagggaatgccagtcagagacaaaagctacagaacagggagctgtgttgtcctgtctctctcacacagagaagagcctatggctattaatcccactgttattcttaacagatgggactcagtcagtacatttacatttcctaaagacaggaagggctgagattcagaccagactagagaagagacttttcagtaattacacatgagcaaagcatcctcccgaatcttggctcaccacttacttgctgatgattgccagcaagttacttaacctgcatgtacctcagtttcctcatctgaaaaatacaggtgataatgggagctacttcatagacattttatacagactgagttaatatttctaaagcacccgggtcaggtggtttggagagaaaggctggagtctgcttgtggcagctcttgaatgacttgctttggggtggatcttaaaaacaacaaacctgcatgttctgcacatgtatcccagatcttaaagtataaaaaaaacaaacaaacaaacaaacaaaaaaaaacaagaggaagacattcaaggctttggatggcataaaagtcaaagtaacacagaatatctttccagatataacaacgcaagacttttcttctttgtccttgcatataaattcactcatatatatcttgaaaaaatgctcaatgtcctcatttattgtattttttcatttcagtttttattcatcttttgatttttacaattgttttaaaatttctggagggcttacattcatattgctttaataattgtattgctatcatcactaagccaaactataagtatagtttgtagtatgaaaatgtagaccatgacaaaggacattctttttcccatcttaattgctatcaagaaaaataactgtttaaagcaagcaagacttaatgtattatatacccattatcagcaaaatattagactcattgatttcataatttataaatgtaagaataaagagccccaggggtatgctccaaatgaggctaggttcaggaatacagaattaatcatcccacctagtgttaaaacatcagatttattatatttaattaagtaactcaatgatctctccaactctaagttgtctttataccaagtatggaaatacagatattagcagtcaaggaaagcatacaatcttcaaataggatcattttccttatgaataatttttgtcctatttgatctaatttttttttcaacaaagtactggtcgcctggttcccgcctcacagtctcatctctgagtccagtgatggtggggaggggacattttcttagagcctccacccactccatcaacagggcctctccttctgtatgcagcccatatttggtgtgagcgcccactcagtccccacacatgctcaagggagactgagataaatacatgcttcttctattcctccctcaggtggacaattctgataagcatcctattaaacatgctgacaaaaaggtactggtggcatcaagcctcagccacccacagcaggcctgggtggtcccttctttgccttttcacttccaacctcacctcccacataaactacctgatcacaagtctttttctcaggctctacttttgggggctctctggccacaagagcctgaaagcacaaatctaacactgtacagggaaatagtcattttggcaaattaaagtgatgtcaaatatttatactagtccgtatctatggtctgtctatattatagaagggatattcattgaagaaaatgagtagtgttatataaatattcccaacagcagtttgactttatttcattcttttattattttaaagactatttgggaaagctttgaatgtatacaacagtcattttgtcactgccattgacatttccccagatcctggttgacaatcctacattaaatccaggaatgtgctaaattgggtgataaggcagaaggttgagcttatgccagatataatgactattgtagcctttgttttaaattgggacatgtcaaagattactttttaatgaagattcactgattattaagcagtaccttattatcttggcaaagtgattttatacaaaaatatctttattaataaagagaatgtgttcaacacagctttttgaaagcatcactgccacagatagaaataatacagaaggcataggaataaagtccaaggtaacagaacaatgatctttgtgtgagaaaaatattaaataggaaggcatataatcttaaatatactcaaaatataaaatgcatctggaaactcagaaaaccctatctgaaaaatacaaagaagcatctggaaactctggatccaaggcagagaaaggaaggaattgtgcaaaattcagggccttctgtgctgttctatattgaggaaaagcaggggataaagggacataaaaagctctgtctttagtagtttggggaaatgtgtgtggggagaactaggcacaactagctgcaggccataccatgattttccccatactgtagatgaggaaactgaggctcaaaataactttctcatgcttccaaagctccaagtggcagagcagccgagcccttgactcatatgctgtgtcatttttcttgttttaaccagggctgtctccacagtgcctacatggcacctgctacatatgatgatcaataagtgtttgtttggaataaatgattaaatgaaggaatgattaagaaaaggacaacgtgagcacctttccagtctcccttggggcatcaggaggctacccacacaaaaacagtttcactgctgataacccagcagagtgaacctcaaagttggctctgctaatattgtagtaccagagcatccactgtagtgtgagcaggacaagaaatatcttacaggtgcctaaaatgtctttaatgagtataggatattgatcccaaattagaaattaaatgcttcaaaagaaaatgcctagtggagataaccatgcattgaaagtcattgctatatcattagtctaaatgactaatgacaatgttttccattattgtgttaatttgctggggtgcaagttgtcagcaagtcagcctccatgggagtcagagcagttaccaaatggggaaaagggagcagaaggaagaggtacaacatgaagaaactgaaaaattgcaaaacatgaagaaactgcaaaactctgcttccatggaacaagtttaccttaaactgggctagagtaaaaagaatctgctcctagaggaattctcaaacaagtatgacttagaagacccacagctctgtttgccaaacttacaaaaaaatattctgttttcctaacacagtcaacctcattataaccaagccccttaactaaaagtctcagactgaatacgctagtttccagctaggaaaacagaacactttctggttatttccaactgagtgactggtaacaaaagcattgaaatacagttttaacagggaattggttgcaaacatgttgaaagggctaaaggaagaaaacaggatggtggctgtacccacggcccaggaattcttcctctttctgaatctgccagagtccccatggcagaattggcactgaggtggagcagggacctaatgcttgccacactctgactttgctgggctcgagagtccacaggcttactgatctgagggagccaccatcaatgctgcacggtgcagggggctgcacacgcactcgcactgctgcagaagcaaaggggctgctgccttcctttcgccttctgttctcaggcgcgccttcttctagcagctcataatcaaaacccagtgggcagatgagtcttaaaaatgaagttttcaaacttgcctccctgggaggacaggaaaaaggtaaaataaataaatgaataaataaataaataaataaataaaaagcagatatagggcttactagtaac

SEQ ID NO: 15172 - DNA, 33392 bp, Human
  misc_feature (1)...(33392): n = A,T,C or G
tgactaccaagttcaggtttaatttagctgaatatttaaatatgttgacatctcatcatgtaataaaataataatatcccttggcctggtaaatggttacctatggtgggtgagaggatgtgtggttattttaaaagcctatcaagcctagttgagggcccaaggaagggggaagtggggggaggccaaggccaggcagtagcataaatggtgagcagggtgaggttatggagatcgctcttgtcagaattcatatccttctgagtggtgtttgcattcttgagcctggggtgggtggtggagggcccaacaagtgtggtacagcccaagacgtctacctccccttacacacacacagcccctagctacatgaagctgatttatctcttgttgctgtagatatttttggcaacaatcgatccctttaaaatttttattttccactttacagaaaaaatgcagcaaacgccaaaccctagtgactgacattgcctggtgttcatgtctaatccttgctcatgtttatagccatagtcattcttgtgaagctactattttgtgtcctgatttttcacttactatgtttttgtcttcacatgtgtaggtagctaagttgcagtcaccaaaaaccccaaataggtaggagacatccatgcgccatttctattagccagttcctagccatcctcctaactgttggatctggagggttagcctcagatcattgcagttataaacagtccatccctggctatcttttctagaagggtccagtgtcatctcagctaggcagaaacgtatttcaactcccaaactgtttcaagagtttgaaaagctcaggcccagaagaaacagagtgagcagttgaacagtcttacaactgctgcttacaactttataacaggccataggtttaaagtccaaaagggctcaaatttctaccccacgtttgacgactcagacctcaagccagagctgagctgacttccctgcgcccaggccacggcggtgaaatgaaggcacagcagccccggccaggccctcccagtggaggcacagggggacggcgaaaccaaccaccccagcatcagtaacctgcacactcttctccctaggtctcctggaggcaaggcgaccttgcttgccctctattgcagaataacaaggggcttagccacaggagttgctggcaagtggaaagaagaacaaatggtgagcagcagtgccgtttaaggaccagtcgggcttgcaaatgcataatgggaacgcagaaaggccatgtgcagatagactggacacagccggaggcagctcaaatctgccccaaccttcctaggggctaaaagacgagtgacagaatctgtagctgatgagctggggtgcctcacgaagggtggcctttttacctctgtcctttgcttttttccttttaaaatcatagctgtagttgatataaaatataactttgggtgtgcagcttaaatgatggtgaggactgtcctgcctgctgaaaggcagaaacgcctttgcttgtcattgtttccccaacatagcatccaagacaaagggggtgctctgtgacgctttggagcctctctcacattcttctgagctgctggcaaaccacaagatgagagtccagtggctcaaagggaagcgagtgctttgctctccagtccagcctgtgcaaaccttggtgatttgctgtctatttgtgttggttttattgtttccttttgaaattacttgattgtcatttgatgccctgtataggttgagaaatttagttgaatttatggactgccatgtagcaaataggatgtctcacatttaacagatgcatttgtaatcccgttaactaatgtagtttaagatgtatgatgagttaataccaaagatgagtaaaatgtctaacttttttctccttcctctgtgtgtctttccaacagagtcaatcccgacgtgtcaatcccgacgatagagagctcggaggtgatccacaaatccaagcacccagagatcaattgggatccttggcagatggacatcagtgtcatttactaaccagcaggatggagacgacgcccttgaattctcagaagcagctatcagcgtgtgaagatggagaagattgtcaggaaaacggagttctacagaaggttgttcccaccccaggggacaaagtggagtccgggcaaatatccaatgggtactcagcagttccaagtcctggtgcgggagatgacacacggcactctatcccagcgaccaccaccaccctagtggctgagcttcatcaaggggaacgggagacctggggcaagaaggtggatttccttctctcagtgattggctatgctgtggacctgggcaatgtctggcgcttcccctacatatgttaccagaatggagggggtcagtatcacaggctgcgagtagaggctgtgacccagggtgggctgtgacccggagtgggctgtgacccggggtgggctgtgacccgggtgggctgcgacctggggtgggctgtgacctgggatgggctgtgacccgggtgggctgtgacctggggtgggctgtgacccgggtgggctgtgacctggggtgggctgtgacccgggtgggctgtgacctgggatgggctgtaggtcctcttgagaggccagaagacagattatgtcttttcagtcttcactggcgtaagactaggaacatgatgacttagactttcgagctggtagaaaagtcaaatctcgccaggcgtggtggctcacacctgtaatcccagcactttgggaggctgaggcaggtggatcacctgaggtcaggagttcaagaccagcctgaccaacatggcaaaaccccgtctccactaaaaatataaaaattagctgggtatggtggtgggcgcctgtagtcccagctacttgggaggctgaggcaggagaatcacttgaacctgggaggtggaggttgcagtgagccgagatggcaccactgcactccagcctaggcgacagagcgagactctgtctcaaaaaaaaaaaaaaaaaaaaaaagtcaaatctccagcaagccaaaagctgaagacagcgtgtctgaggctctccgggttgtgaagctgggtgaagccctcccaaacctgacctcacagatctccagcatcattagcgctccatttattgaagggcctccttctcatcctgcattctccaggctctgtcctcccccagccagaagtgagggaatggccgtcagccctgtgctgagtcccttcactcctgctggcaagttctgctgggaagagtccacgagggtaggcctgcgtaagggaaaatttggaggtggcttcagagtcccagatgcttctgatcctttggacctgtgtgaggtcagagaagggcatcagcgttaagtcctaaatcttaattaccagtctgggcagaatttaagctggattagatccacagcatgacattaataccaacctcaaaccacgcatggctggccctcctatctcctcctgggatgttagatttttgaggccagaggccctatcttgttccttgtacccctaaagcctctcaagtagttaacttgtagattataaaaaatagtagctgactgtaggcatgaagatgggaacctgggggagagcagagcagtggggaaaagtgaatgggtttggggcctctggacttgttatcagcacaggaaaataacaagaagtgggtgtcagatgcgtcaagcttgattttcatgggaactctgacaacagatttgggagggcagctacaaagaggtttggggatcatccatttgtgtcaccctcacttcttccgtgacctaacacagagtggcctggatttactctcttttaaagatttctgtccatgtagttgcaaaggtagttccagggggcccctgggaagctcagcgcttcctgcctaggaggagcaaaagtcataatcaccttatctcctgctccagaggactcacctttagcctgggcattatgtaaggggctgggtcactggtgacatttccccgacactcattccccagcgtaaagctgatcaagcaaactctttggaggaaggccatcacgagaacacatggttttattctcgagccgggtttacccagtgtgactgtaaattacatggacctttctgatttgcacagacctcaggtttctgggttcagagcattttacagcagggaaaattagggaaaatcacagctgatccaccctttaggctaaaaactcaggctgcaggttagcattccccaacttggtatttttaaattcagcctcagccacaagatccaggagacaccagcatctccagttaggtagcagctctgtgcttgcttgttctgtgaaaaactaccctgtccagccactcctgcaaacggcgcttgtcagggagcattctggctcaatggaattatggaagtgtagccaaatatcaataatcatgtgtctggagccatagataatactgatgaacaaagatactgatttggtgactcacagagagttgcagctgttgctacagattgtcacaggtgatctgttccaagggtcccaggtactggctgcatcggaatcacctagggagcttgaacacaatttttgtgttgtgcccatgcttggagattccgcttcaggaggtctggggtagacccaggaatctagatgactatgatgtgtggctacatttgggaaactcagctctcctcaactgtgttcttttatagggaggaaattggggctcagagaggggaagtggcccagcgttctccaggtagtcataagtggatgtgatcctgcctgttctgtcgactcccaaaccaggctttcttcccaattgctctcttggcctcctctgaaacctcattttagtcatggtgctccccctacgactgcttctagcaaagcactgagaccagaggagcacagcatgaggccactcagcccagggtggctcctgacactcacatcatccggcgactgtgattctcagtcacagattggttgggctatcctgggacagacgtgggcagggagtgaaattgtctttcatctgcctcaggggcattcctcctcccctacaccatcatggccatttttgggggaatcccgctcttttacatggagctcgcactgggacagtaccaccgaaatggatgcatttcaatatggaggaaaatctgcccgattttcaaaggtaactgaagggctcggtggggtgggtaagtggagcctctcaggaagggatttccatcagtgggtgggagctggggaccttcttctggaatcagtcaggccttaggcatccctgggagactgcttgagtaattaaggttttgactgcgtaagtggtgtgaaattgtcaaagagaaacagaataaacggcaatgagaagtaaactaatgtaaacattttaaagcattaacaggacatgtacacattttctaaaacatgttaccttgcaaatacatatgagtgactaacggcagggccacttttcccacggtggcctggagtccttggaatggaatggagggcagcacccacgtgtacccctctgctgggctgcggggctctccagtgccccgtttcagccttttgccgttgggccacccttaaactcggcctctgtctctccatctcacccactgcccagggattggttatgccatctgcatcattgccttttacattgcttcctactacaacaccatcatggcctgggcgctatactacctcatctcctccttcacggaccagctgccctggaccagctgcaagaactcctggaacactggcaactgcaccaattacttctccgaggacaacatcacctggaccctccattccacgtcccctgctgaagaattttacacgtaagtgcacgtaagtgaggggttggcctgttaggggcaggccacacccctggggtttggcttcttaaaaagaaggccagggccaagggctcctcacccctttctgagagatgaagctatcaggggtgggagtagcagaatttggagctgggaaactctacctcaagtgctccacggcctggccctgctgtgcctccttgcactttctcatgcgccaagtcagtttgctccaatgcgcccaagcccgtccctcccttcacattccaaaattactccccttcttccggggtcctcctctcagccaaatgtcatggaggcgaagcatcctagtactttgatagttcaaaactattcaaatggtttaatgtgtcaacttcgtaagtgggatctaccctttggaagaagatgcttgaggaaggtagttttctttaatgctggaatttcaggcaatggcagcccaaagagagagctactttggggtagggaagggagccaactccccacacttacacatccctcatgttcccaaaagccagtcacattggtcaaaggagttcaggtcccatccagcaaaggagaatccaggaagtctgcctttaggttgaacactcttcccagggtgttggccaaatgtgctttgtggtccttcaggacaggcagggccaatcccagctcttcctgggcctcagtgaccacttggtcctagcagcaccgtgtccatttgtcccgggcaccctcaaaggagcagcacagatgtgtgcccaggtcactctacagagcctctcaggggcctttctttctccttcaccccaggcgccacgtcctgcagatccaccggtctaaggggctccaggacctggggggcatcagctggcagctggccctctgcatcatgctgatcttcactgttatctacttcagcatctggaaaggcgtcaagacctctggcaaggtgaggaaggctctggctgctgacccaggcctgcccaggggcccacaggctctcaaactcaaaacccagtagcctggacagacagcactgtttccttccacaccaaacacattccatgatgcaccctctctctcttcaccgcatttgttagaaaattctagaagtgggttgggcatggtggctcacgtctctaatcccagcactttgggaggctgaggtgggtggatcatttgaggccaggagttcaagaccagcctggccaacacatcgaaacctcatctctacttaaacaaacaaacaaacaaacaaacaaacaaacaaaaaaaaacaatagccaggtgtggtggcaggtgcctgtaatcccagctactcgggaggctgaggcaagagaatcacttgaacctgggaggtggagatttctgtgagccaagatcatgccattacactcctgggcagcagagtgaaattctgtctcactaaaaaaaaaaaggaaaagaaaaaagaatattttctagaaatgggccaatgccaagaaccattacatgatttttttttttcaagattccttcaacccactggtagtaccacaattaataatcgtggcaatgacttactggaaacccatcatggaccatgttcagtgctttttatacactggccagtgctattgtttcctgctagatactccctcaaccttacagatgcatagtgggctcagaggtagttctcctggccaacctgaatccgatccctgtgtgactccaagggttgtgatctttctgccacaccacctcgccctcctttctcaaggtcttcaagaataaaagacactgacatccattcacccacctccctcccctcccctcccctcccccgctcccttctccttctcccctcccctcccctcccctccctggaacagcatggtgataacccttcttccttacaggtggtgtgggtgacagccaccttcccttatatcatcctttctgtcctgctggtgaggggtgccaccctccctggagcctggaggggtgttctcttctacttgaaacccaattggcagaaactcctggagacaggggtaagatgatgagggaaatatgtgtacctgtctgtcattttactaaacgaagctggtcctcctccaaataggacagtagggacaactgaaatgtggcttcagtgtgcaagtctgcaatgatactttaaccaagaaatacaagcattaaagtacagttgaggccactggatgggtttatgcctgaatcataggaagagaaatcacatttgttggcacttggtttatggctatgcctggaatgagccttaaaagctgtttttctgcctctgcacttagccacatggaggcaggagtggcgaccctgttggtgccagggtaagcctgtgtctccccctcaccccatgcccttacccctgctgtgttccaggtgtggatagatgcagccgctcagatcttcttctctcttggtccgggctttggggtcctgctggcttttgctagctacaacaagttcaacaacaactgctaccagtgagtatctggggtccccaagcaaagcttgaaagtggcgtgagtgaaagtcagctagtgtggaggaaggtgattggaccgacggcctcgaatctggccaggcttaggccttgataccactgcccctcaggggtgctgcaggcccctgaccagctcacccatggccagagcactcatccaggccgtggcttcacctgggccactcaggctgagaggggccccatgcccttcggttttgtctgcgctcctgtatataaaaataataagaggctggacatggtggctcacgcctgtaatcccagcactttgggaggccaaggcaggtggatcacctgaggtcaggagttccaggctaacctggccaacatggcgaaaccctgtctgtactaaaaatacaaagattagccaggcatggtggtgcacacctgtaagcacagccacttgggaggctgaggcacgagaagttgcagtgagctgagatcttgccactacactccagcctgagtgacagagcaagattccagaaagaaagaaagagagagagagaaagagagagagagaaataaagaaagaaagaaagaaagaaaaaagaaagaaagaaagaaagaaaggaaggaaggaaagaaaaagaaagaaagaagaaagaaggaaggaaagaaagaaagaaagaaagagagagacggggtgcggtggctcccacctgtaatctcaacactttgggaggccgaggcgggtggatcacgaggtcaggagatcgataccatcctggctaacacggtgaaaccccatctctactaaaaatacaaacaaattagccgggcgtggtggcgggcgcctgtagtcccagctactcaggaggctgagacaggagaatggcgtgaacccaggaggtggagtttgcggtgagccgagattgtgccactgcactccagcctgggcgacagagtgagattccgtcaaaaaaaaaaaaaaaaaagaaagaaagaaagagaaattgcaaagcaagtttacaaaaagctgcaacatacaattaagtagttaggtttaactagtcaatgtgtttaacaataaaaattgtaatgtgattatttgtattatgtataaacaaaaagtatgatgatcacattattttgactaacacaaaataccataatttttcttttcttttctttttttttttttttttttgagacggagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttgtatttttagtagaagcatggggtttctccatgttggtcaggctggtctccaactcccgacctcaggtgatccacctgcctcagcctcccaaagtgctgggattacaggcgtgagccactgtgcccagccaaaatgccataatttttgcaacaaaatcctatttcagaaattttaacagaacaggaaatgttacaccaattatggttttaaatatcacccactgggccaggtgcagttgctcaaacctgtaatcttagccctttgggaggctgaggcaggaggatcacttgagcctaagagtttgagtccagcctgggcaacatggtgagatcccatctctacaaaaaatttaaaaattagctgagtgtggtggtgcatgcctatggtcccagctcttcaggaggctgaagcaggaggattgcttgagcccgggaggttaaggctgcagtgagctgtgttcatgccactgcacttcagcctgtgcaacagagggagaccctatctcaaaaataaataaataaataaataaatgtcacccatcatctttagacttaattttaattgatcacagatggcagcatccatcaatctctttgtgctatgcataagataattgtaaaactgatttttttaaaggtgggagggagattcacatgtaccctaagcaatgtggccttgcactgggacaccaccctgcagttgtatgatgaggctgtcatttaaaagtgtgagatcaggagtttgagaccagcctggccaacatggggaaaccccatctctactaaaaatacaaaaattagccaggcgtggtcgtgggcgcctgtaatcccagctacttgggaggcggaagcaggagaatcacctgaacccgggaggcagagggtacagtgagctgagatcaagccactgcactccagcctgggcaatagagcaaggctctgtctcaaaaaaaaaaaaaaaaaagaaaaaaaaatgagggtatctctctggctggcagtctgtgacttagtttgaagataaagcctaaatctgaggatctcacaaatgtgaggctcaggccctgtcctggcccccactccaacctgggccctgctccagaacaaggctggtttgaaatggagaggtctgtgctagcaggattgccttttaaagcacccctgactgctcttctccctccaccatgtgtggtggtcatggcagtcagagcttcaggcctcggcagctgggttctgggagaaggcgaagggactccgggacaggcttgaggttccttgagttcagcctgcttgtccttgctgtggccgccctgtctaaggcagggcaggcacacggacagatgctccttagacccctgatcttggaactgtctcaggcggccccttgggttttcccctccagagatgccctggtgaccagcgtggtgaactgcatgacgagcttcgtttcgggatttgtcatcttcacagtgctcggttacatggctgagatgaggaatgaagatgtgtctgaggtggccaaagacgcaggtaggacctcgggttctatgcaggtcccttgctcctactgagttgctttgctttgaatctttgtaaagatctaacttttgatttatttctaaatgttcctgaaattttccaaagaaggctgggcatggtggagttcaagaccagcctgggcaacatagtgagaccctgcctctataaaaaaataaatgagctgggcatggtagtgcacacctatagtcccagctactcaggaggctgaggtgggaagattgcttgagcctgggaggtcaaggctacagtgagccatgatcacaccactgtacttcagcctgggtgacagaataagaccctgtttccaaaacattttttattcaaagatttgagagaagctcgatgccttagagatctttccatgtgttcaggccatgcagggacagggcaactcccttggcacccagttctggggcctccaaaatctatgggcttgaaatgatgactctgatgatggctttaaaaccagtgggtttgcttcctgtgatggtcttgtgatggctcaaagtctagtaagcaaatatcatttatccttagaactgccccttgcagaaaaagaaaatctagccaatatgaccactctattttaccgtgaagtttttgtggaaaaagaaaagagcaacagagggagaaaaaacagatgatggcatctagtgggcgaggtcccagggccttcttgttacaagcatgttagcatgcttgtatctttggcctgattcggtgctttgaccaaccccataccccaaacgagggcacccctagctaacccatgagaggctgaagacatgtccctcacactttcaaaagggactttaaaatagaaagaggtctttattccaaagcctctgtgactctacggaaatcaatttaacatttcctactgttctgaagctgaagacatcagagggggctaactgtcatggactttagaaatatcaatcctggtcctgagaaatcccatggaattgttatatggtggaaactcttattctcatgtgcagctttgccagtctctgggtcttggatctgttacccacccccagggttaatggagggcacacagttttcaagatggaagccccacccttcctgcctcccaggaactggggtggccacgtcagacggagtagagtgtgaggacgcacttggtgtgtgtcaaaacctgattcacacataaggtcttgtgatgagaattgtaactgttgttgtggctgagttttcctctgtgacatctttgtaggacaggtcttgtcaaccacctcctcctctctcccctctgtctcaggtcccagcctcctcttcatcacgtatgcagaagcgatagccaacatgccagcgtccactttctttgccatcatcttctttctgatgttaatcacgctgggcttggacagcacggtgaggaaatgggaaggggaaatgggctgtgggaggatgaagaggaaaggaggaggactcagctggactcaattccctcccatccctggccatcccaggcagctttggctactcccttctggtgctccagacccccggctgactcctcggcatttaccaccctctggtacattcgagtcattaatgggataaagtgggtcaagcgccaggcgcttatgaggcccaaggctcacatatgtgaactgttattaagcactgtcccttggcccaattatggcgcctacaggccggggcgaggtctctcctgggtctctgctttgccaagggttcagttcagggcctggaattattagtgtggagtgagtctcagctttgagttggcctttctggtgcaaacggagtctccccgagagacctcatatattgaagttctgtccacgtgtgctattttgtttcctggctctccttagtgatgggctttaaatgacagtgtaaaacagggaaatactctttgagatgcttacatggtccagcgagccggggaactggtgatgatcagcttgaccagtcacttagcaaccttacccctccctcctgttcactgtcctgaaggccacagccttgtcccaaagcctccaccgtgactgcttgcctgtacctctcagtttgcaggcttggagggggtgatcacggctgtgctggatgagttcccacacgtctgggccaagcgccgggagcggttcgtgctcgccgtggtcatcacctgcttctttggatccctggtcaccctgacttttgtgagtatcatgcccctcagctttgagttggcctcccctagggcagcagaacgctacaggaagctgttcgtctccttccatctcacacagtgccctggctttgggaccaaaggaggggaggttgttactcccattaaaaggtttgtcatcaaggagaagaaaagttgtttcttgtgcatctacttgcagattccgtgcatagtatccaggggctgtcagcattttaccgcagatcccactagatttcaggcttcaaaaactatctggagaaaattaggatttgcttttccagcctatttccactctttagagctgctttcttgaggatactgccctgacgttcttcacgtcatgtgtgtaatgccgcttggtctcctccagaatttgcaatggtaaagaagtcacaccctctctagagatcctttttttttttttttggtagctgaagtaaatactctaaggcagattttgcaaatgtgcatctttaagccgtgaccccgatggccctggagtgggggtcaaggggactgagtggaaccccagtgagtcatgatttaggacagaaaggcaaaactgtgaccaaggcccttaatgtgtctggtatcctgggcccttctggattcagtctttagaggcagggattctccagggtcgtgtccacagcaggtgttcaataagttgaagaaagtttaaaatagatcccaaggccctttggagtttgtctcttaaaatttagtggggtgaagaaatgagaagaatgaactacataggatgggaagaggcgtctgagtgggtaaaacctgcccacactgccactgcaaaggccagtccaagaacagtccaagaaacagtttcttttttttttttttttggacagagtcttgctctgtcccccaggctggagtgcaatggtgctatctcagctcactgcaacctctgcctctcgttcaagcaattctcccgcctcagcctcctgagtagctgggattaaaggcgtgtgccaccacgcctggctaattttcaccatattggccaggctggtctcaaactcctgacctcaggtgatacgcccgcctcagcctcccaaagtgctgggatgacaggcatgagccaccgcacctggcctaagaggcagtttctggggtactcacgttcggtcccaggtgggatttttccagaatgattctaagtgaggaagcccctgcaggtctctgtagttgggaggggtggctccttggagggccctcacccaggctctgctctcccctccagggaggggcctacgtggtgaagctgctggaggagtatgccacggggcccgcagtgctcactgtcgcgctgatcgaagcagtcgctgtgtcttggttctatggtaagacgcttccttcagccagctgggtcccttctacaccatcagccagcacagtagcaaagggctgatttcaccaaaaaaggctgtgaggggcagtttacaagatgtgacctcccgatgatgggtctgtaaaagagtctcggccaggcgcggtggctcacgcctgtaatcccagcattttgggaggctgacacaggtggatcacctgagatcaggagttcgagaccagcctggccaacatggtgaaactccatctctactaaaaatacaaaaaaaaaaaaaaattagccgggcatgatggcgcaagcctgtaatctcagctactcaggaggctgaggcaggagaattgcttgaatctgggaggcagaggttgcagtgagccaagatcgcgccactgcactccagtctggacaacagagtgagagtctgtctcgaaacaaacaaaaaacccaaaaacaaacaaaaataaaccacttttgcatgttatttgttacacatattatcaaggagggggcacattttgggttgcacacagggctgcttttgttttgttttgttttgttttttaaagaagaaatcttcccacctccttggcaattcagacgaccaagttcaagtgtgtgaatctccatagacctgccctaggaactgctgggacctctcggggaagcaaccacagagcaccttccccttctcaatttctcactcttctttgggagttctcagttctcacttccttaccagttactttttatagaagaaccttgatcttgatctggcatatgaatgggcaatattgtggttaaaaatttcccttgaaagtttccagtgtcatggtcaaagtcagtgtctgtcaggcgggttcaccattcctggacaaaattcaactgttttataataacaatgaaatcagatacacactcagctctcaggaaggcggtgtggcaccaagaagggggtgtgtgtctcttcccagatgcccatccatcctcccaaatgtccatccatccttccagatgcccatccgtcctcccaccctatgtagaaagagtcttgcttgctataaaaatgcagttttgtgacaagtcccccagccccactttcggaccagattgttgtcgctgtactcctcctagagagaaattccagagctaccctgtgtgtccggggtaggaattccggcttgtcatttccccttgtcattcccagtgctgatcctgtgactctgactctcccagagaatcagggcacagcagcacagcccatgtcctttcttagtctctgcctctcttccccttgggcggttccaggcatcactcagttctgcagggacgtgaaggaaatgctcggcttcagcccggggtggttctggaggatctgctgggtggccatcagccctctgtttctcctggtgagttgccatttcccttctcctccttgccctggcgaaagacttcccccagacacataaaaaatgaattgtaatggctgggcacggtggctcatccttgtaatcccaacactttgggagtctgaggcaggcggccaacatggcaaaaccccgtctctacttaaaaaaatacaaaaattagccgggtgtggtgatgggcacctgtaatcccagctactcaggaagctgaggcaggagaatggcttgaacccaggaggcggaggttgcagtgagctgaaattgcgccactgcactccagcctgggtgacaaagtgagactctatttcagaaaagaaataaatagtattgaagaataacatatacagaaaagtattaatatacagctcgtaagtgtacatctcaaagaaatgttataaattgagcacacctatgtagccaaaaccataccaggagacaaaaacatgaccagcacttcagaagcccctcttgtgccccctcccagccactatgcccaccatggttccccacccttctgactcctaacaccatggagtagtctgggcttcagtcactctggcagtgatagtgatgcataacatttatggagcgctaaatgccaggccagacttcaggctcaacttacactcacttttctataaatcctcacaatagttctatgaagtggttatagttctggcactcccattttacatttaaggagattgaggctgggtgcagtggctcatgcctgttatcccagcactttgggaggctgaggtggttggatcacctgaggtcaggagttcaagaccagcctggccaacatggtgaaaccccgtctctactaaaaatataaaaattagctgggcatggtactaggtgctactcaggaggctgaggcaggagaattgcttgaacctgggaggcggaggttgcagtgagctgagatcgcgccattgcactccagcctgggcgatagagcaagactctgtctcaaaaaaaaaaaaaaaaaaaaaaaagaaaagaaaagaaaaaaggagattgaggcttagcaatgtaaagtgaagggtccaaagtcacataacaaaaagaactgttcaagaccagggaaggatctgctatgctcttcatgggggccctggatggggtactagtacttctgtgtttacaattttgtatgcatcttcttcaagatgatacaaagctctctaagcaaaaatccacgtcaaaagtagaatccatttattaccaaaggacctgggtgagaaagttgagtcccaagggttgtccacgtgttgagatgtgttcaatattcactttgtccttggttcacgtgcccctgtccaagatggataacagcctgctggcctgccaagtgtgtgctgaagtagcctggggtaaactgatgtcatgcacaccagcaggcactattcttcagttctttcatttatctgtaactttgttttttttgtgtttttttttttttttttgtcttttagagccagaaatgttgttagattcttccttcagtccacctccagcctattaggagtatatgggctatcccattttgttttaggacatctctttggcatccagctgttctgtgtcccctttcaaaacagctgggtgcagtggttcacacctgtaatcccagcattttgggaggccgaggcaggtggatcccttgaggtcaggagttcaagaccagcctgggcaacatggcgaaaccctgtctttactaaaaatacaaaaattagcaggacgtgaacaagactcagtctaaacaaacaaacaaacaaacaaaaaacaaacatgaaaacagccctttttgtattctgtgttttgactttcttggggtaaccctttattttttgtacttcttttgtacccacacatcttgacattaacttatctatgatggacaacatgcttgttcttgtctctgtgacactgcatgtgtctctctgtaccccagaattcctctttgacttcctttcccccagaccctggaggtttccaaaatcaaagccagtgtttgcaccaagcagcacatgttcccaggctgcagtgactctggtgcaagctctgggctcctgagatgttggcctcggagctccttatgaccttatcagcttgctgatgcatttaggcacatttaaaatgcgtgtgtttttaaatccagaagttttagttgttttcagtgagagggttgttggaaatcgcctagcccatcctaccagaagcagaagccctgacataaatgggttattaatttatattattaccagtacttctcaataatctacttaaatatttttatttgtttttcaaaggaagaagagtcattggattaattccttgagggcagaaagatgtttgtttgtttgtttgtttacttccatatttattccccacgcagtgaggaaatgatgtctaggggagacttgaaggcaagtgaaacattcactgtgggtataaaatttaagaaggcaccaaagagctcaggactcaggataaatattattttcacacaatattttttaaaaataaaaattaattcaaaaagatccatgattaacaaagtatcaacattttcaataaacacaggagccagccctgtacttgtacatcgtacttcactcgctttaccctcatctggccctgttagatcctgtcttttaaaaaattgtaataaaatattatttattttgattttggctcctgctgaaatgtcgtgcctgaggtgagtgcctccatgtgccctggggcttggggctgttcgtttctgtcaatttcctgctgtcagactgggtacactcttgatgcacagtcattgagtttctttgcccaggaaaacccacgtgcagctttggatgtgggcgcactactcataattcccatgatgtttgccatactcacccctctacagccaagtgccctagtgcctgagagaggcaaatctgtcttccacttctacgttcacttaacagatcccctgctctgggcttcttaaggctgctttaggtaaacaacaagtagcttactaaaaatattctttttcactgcagccaagttaaaaaaaagaaaatattgtgtacgagtagaggccaggatgtgtgagggggtttctgaagtagcacttgccccaaccggaggttgagtcccccaatgactgagtgggatttcacacacctgacattaagagacaagcagccgggatggctcctaaccagatcttctttccctgttcccaaaccatctttcttcatagccggctctggggatgaggagcctgggttaggaggaaggtttgcaattgaccaggttcctgttttgaaggcttccacctagacttaagatagcaccgctcagaagatggatgtgtgtttagcaatttcccattttattacctgcagacaaagaaaaaaaaagatataaatagatgtttaaccacacaaataattcacattactgtcttctttatgactgtgaaataataaaataaaattaaatcaacagcaataacaatttcggcacagtggttactaggcaaaatctggaaaccaaattgaaataagaaaactcataaactgggtgttgggagcacactgtggaatttttcttggtcaaaattctcacagagtgttcaagtgaaaggtgtattaagctgctatttttccttccataattcctttcatgatgaggacctgtggcaggcagtcattcattgttgagatgcctagtggcagagccatccttgttgaaactccaggcgatgcagcttaatgcagaaggcagagagctcaggaaaatgggagaaggacacacccccaggagcctgagtcctctctgggtcttgagaaccttcttatctttcctggacatcaggcaccttccgtctgaccaaaaacaaccacagccagaaacgcaaggcaatgaaaacaaagcagagagaaatatgaagcctggggcctggcggggggctgcggagaggtcacccagtttattcctctgccttctggcaagacaaggcccaaattactctcaaggttgccagtctctttgcctgggcagaggcctgtgctgaagtgggagctgcaggcttcagccccgactgtaggggcagctgtagggctgctgcaacatccccctataggaagtgagggctggggaggaaaatcagggaaagcacctggctggtgtagtcttgcagcttgggtacagaagttggtaattctgtgtgtcagagttcaatccaggatatatcacatcttgggaatttcctgaaagtatcttagctttagcatttggtgtttgtggtatcggaaacatctctatctgagtggatattgttaaggtttttaatgtttcttggaatttctgttttagttcatcatttgcagttttctgatgagcccgccacaactacgacttttccaatataattatccttactggagtatcatcttgggttactgcataggaacctcatctttcatttgcatccccacatatatagcttatcggttgatcatcactccagggacatttaaagaggtacgtgctagttagtgtgtatatgtgtgtgttcagactactaattgttttgggagaaaaggattatcttgttatgctctattcaaaatgagattcaccaggaggcatgcaaccctatatatgtatgtacctgtgccatggcgaagacctctaatggctgtcactgttatcttaaggcatctcccaaagcctcaaatgcaagggcaaaagagtgagctgatcatttgggtgcaccagagcattcagcttgggctgtgcataggttttcaaacttatcagacaactaccctgcctcctgcttgccactgggcatggatatcagacctgtgatgtctggagcaatacacaaattttaagtggcaattatggtgggaaatgtccatggtcacttttctaacagcaatgtgaaaagtattattttgaaaatcatcacaaaataaggatgttgcaacagtatcatagttttagatcaaaattattagctatctaacaatagcatgattttagctcaagccattggagtaaaaatgttttgccaggatagcaagattcatttcggtaatgaatgcgctgtagaaatgttaataacagtaccttacaatttgtatgaatgccattttcaaagcatctgcatgtcgattatcctattctgttatcaaagtaccttgggaggtaaatgggcaggcattattaccagacaaggacactgaggtggggaataatcctgctcgaagtttccttatttccggctgggcacagtggctcacacctgtaatctctgcattttaggaggccaaggcatgtggatcacctgaggtcaggagttcaagaccagcctggccaacatggtgaaatcctgtctctactaaaattacaaaaattagctgcgcatggtggcacgtgcctgtagtcccagctactcagcataatctataatagcctgagaacggaggtgggctaatttgagatcttacgcaaaatttagacatgagtccatcacaatagtcatcctaagacatttcataagaaatgagaagcaagagaacataggcagttaaacatcagctctttcttttttttcagacaaggtctcactctgtaccccaggctggagtgcagtggtataatcatggctcactgcagcctcaaactcctgggctcaggtgatcctttcacctcagcctcctgactagctgggactacaagcgcctggctaaatttttaaatttttaatagaaacaagatctcactatgttgcccaggctggtctcaaactcctgagctcaatcctcctgcctcagcttcccaaagtgctgggattgccggcatgagccactgcacccggccaaatatcagccctttctgagaacaactgcgttcatttcttttttgaaacaggaaaactgtattctgggtgaacagaactctgagctccgtagttactaatttcctacagccaaaccagccctctcatgaccgcactccccctaaagagccttgggtcccgtgctgcttcccgcacactctcctacccagagtcattgaacgcattccttccggtcatctgtcttggcagttgtgatgatccatgagctctgttgcttcaaatccagaggccaaggttggaggtgggaactgtgttaggttaataaatgtcattctttagtcacaggctacacctcagatcctggccatctttctcacaaattcccccagttggccacaagggaatgccacccaaaagtgtgtcactaacagagctcaggtctgttagcaatagaggtaagactaattgtaggtagggcgtcttcacgaggggccaccagatggggagcagcgggttacccggaagcagtgtgatacacccctgtcggtgaggaccatggaaaaggccctagtcggctctggcaggtactcatcttatctgggcctcggtttcctcctctttcaaatgtgctcatttgaccatgttaacatttcccaaagtgtgttccaggggctgtcacaggtattactgctggagaaaaagtttatgtagtcaggtaatttttggagactgctggactaaggcaagttaaacaggtttcttggccgggcacagtgggtcacacctgtaatcccagcactttggcaggccgaggtggatgggtcacctgaggtcaggagttcgagactagcctagccaacatggtgaaacccccgtctctactaaaaatgcaaaaattagccgggtgtggtggcgggcacctgtagttccagcttctcaggaggccgaggcatggaaattgcttgagcctgggaggcagagattgcagtgagctgagatcatcgagccactgcactccaccctgggcaacagagcgagactctgtctcaaaaaaattaaataagtaaataaacaggtttgtttacctgaggacttctcaaaaaaactttaatatgcccatgtgcatgtttaatctctgagaagaataaagcatgctgtgttttttgccaaaggtctagaattcttcacaattctttatgaataccagacttgctagtctgtaactttctatgtgtgagggagggaagcctcatataaaatccttttgggccctggccatatgcaaggttggagtttgtggagtgagccaccgcttactggtgtaatttgaagggtaccatacacacccacggtctggaagtcttgcggttggagtcatccactggcttaggtcatttttgcagaaactactaataatccacccaaagatactggaaaatggtccctaatgagtacacgtttatgaagatatgaagaggaatccatttcttagattaacttgttatcatcttgcagaaggccaggcagggcctggcaaatttccagcacaacggtagcctggcaactagaatgctggcaaagcacggaaaacagacgtgggcctggcatcctgggtggtcagtcaccaacagggcagcagcccatgtgggtaggtaagggcacaaaaaccaagtgtttgactttatgacgtcgttcattgcgggccttgccccaccaaacacctcggtgatctcttctctctctgagctatggtgatagctccacttaagacaagttctaatagttgagcatcgtaccatgcacctgtaggtccagctacttgggaggctgaggcaggaggatcccttgagcccaggggttcaagactgcagtgaggcatgattgtgccactgcactccagcctgggcaacagagcaagaccctgactcttaaaaaaaaaaaaaaaggactcgttatagtgatctctgtctagttctcaactaacaagccataattctgtttaatcaggtatagttcacatgttagtctgtgggaatgcatggtttctgacaagttgctttccgtgactcggcatgctctggtagctgatgactcctttttaaacggatgactcctttttaaactccctgcaatgactcctttttaaacggatttctagtgtgaaagttcagtacacagatactaaggtcatgaggagcacaaaatgtgcaattttgtgcattttgccctatagtgcatttcattaactgtaggactggaactttttgaattatagaggccctatttcttaaagaacaaactcccagaatgagaaaatagaaaagcttgaaggcaactccagacattttcagtccaaaataaaaatgacaggggcagaacttcacctaaagatcagtaaatcaaaggatgctttcagatccaaattgtctgcttatgatacatacagacttttggccaacaaagattttattaagcaacttaataaagatttttcaaagcctctgcagtgtggctgtttttttttttttctcctctatatccctgagctgctttttgccactctgatgctgagttttacaaggccagttgtatatttcacacctaagcccaagtatatttcagatccatcttaaagcttctgtgtacctcagctgtttctatagtagaccttctcagccacttctctgtgatgagtactacatcaacacaatgttgcattagaagtgatgatttcaataatcgcatcttttacagtttaactatgtgataatttatactctcatatgaactaaccagtattgctttacaggtgaattcattaaattagtaacatcctggctgttacagtggctgatagcactgggcagtatggctgcagtgtgtctgcaggagacaaggagcctgggtgaggggatgggggccaaaacccagcaattactctgctccccaagccctttgtggccgcagaagtctcctctgtccagagaaaagggtaccctttcccaagtccttcaaaagcatgttattggccagcagagattctgttgaaggctcatcattttcttccattagtgttataatgattttcttagtttacagatgtgtatagtttctgaatataccattttaattcatatttgagaatacataaattgggaattcttttcctaaggaatgtcagtgagactattccaactcgctcttagatgttattaaagtgttatttaagctttgttttaatattaatgttgactatttttgcaagttttaaaaattacaaggatgtttataacattgtattttcttcccaatagcgtattattaaaagtattaccccagaaacaccaacagaaattccttgtggggacatccgcttgaatgctgtgtaacacactcaccgagaggaaaaaggcttctccacaacctcctcctccagttctgatgaggcacgcctgccttctcccctccaagtgaatgagtttccagctaagcctgatgatggaagggccttctccacagggacacagtctggtgcccagactcaaggcctccagccacttatttccatggattcccctggacatattcccatggtagactgtgacacagctgagctggcctattttggacgtgtgaggatgtggatggaggtgatgaaaaccaccctatcatcagttaggattaggtttagaatcaagtctgtgaaagtctcctgtatcatttcttggtatgatcattggtatctgatatctgtttgcttctaaaggtttcactgttcatgaatacgtaaactgcgtaggagagaacagggatgctatctcgctagccatatattttctgagtagcatatataattttattgctggaatctactagaaccttctaatccatgtgctgctgtggcatcaggaaaggaagatgtaagaagctaaaatgaaaaatagtgtgtccatgcaagcttgtgagtctgtgtatattgttgtttcagtgtattcttatctctagtccaatattttgggcccattacaaatatatgaattccccaaatttttcttacattaacaaattctaccaactcaattgtgtatggaggttattatttgaagggtacaatcactacaacatgctctgccacccactccttttccagtgacactacttgagccacacactttcctttacaggccagcctctggcgtttgctgcacctcattgccaccttcctgtctctctgtgctaaacattcaggacagtgttccacaggcagatctggcctatttcattagtcaccatggcttggctgtgaagtacgttgaaggtggatcttgtcacatgccccttcagtgttcacctggccctctggtttaagttctgtctgccttacgtgactgagtttgactgtccaggttgctttgctcggtgaagagaggagggtaaatcggattctcgtttagcactgggttatacagatctggcaccctaacctaaaccaaggcatcttcactccaagagcagttggagagtctgggttagccttacgtggacctcgccgctcgctggcggtcacgattgtgagccctccagataatttttaaggttgagtctaagtaaggctgcttgggaaatggtcagctaagtaaatcacctttcatttcacataaggcccttaatatagataagtaaatttggcctttggtgtctcgtgactctcagaggcgtaggtagaggagcaaattaatatttgcagcatgggaattccttatcagaattttgaggggaataaatcctcatcagagacaaaaggacttaatcatctggccacctatcacttcagttctctgtataaatgaaatttaattctaacaaccttataaaaagaaggtccagacagcagaggaaacatcctgtccaattctaggttttcctcccttggcctcctttccccagcattgtctaccctggcccacttcctgcattctccccatgccctgctatttctgattctttgcttctcctagcgagatactttccttatatgatagctgctgagaagtttcccagaactgctagaggaaaagaagtggggaatttaggaaatatccctcactgacctaactccattatcttcactctttccttcttcctgccacctcatgcccattctctttactgtctagcatgctgaaagaaggaagtgatctaaatgccagcgtgttcagtggtaaatattagttggtgcaaaagaaaaaccatgattacttttgcactaacctaatagctttgcaaattttaagaacttgctttatgaagatattcggatatggattctccccaccccacatacttagacattgttcaaatatactacttttaaaaaaacaccttttcaaacagaattagcgttttgccaagtctggtattaatggaattgtacaggagctttgaaagttttcaaactttattaaactaaaaaaaaaaaatcgaaaatctctgtctgttccgcatagtatgcatttatttgacccctatttatcaatactatgatggggttttttttttttaaagaaaatttaagagtaggtaggtggattttaaaataatattttaaagaccttttatatctatatgtagcatttatagaaaaataaaaactaaaaatagaattgaattgtaacattatttaaggactgaagttttttttcttgtatcagtaagaaatacccaagaggctgggtgcagtgactcacacctgtaatcccagcactttgggaggctgcagtgggaggatcacatgacatcaggagtttgagaccagcttggccaacatagtgaaacgccgtctctattaaaaatacagaaaattagctgaatgtggtggcaggcgcctataattcctgctacttgggaggctgaggcaggagaattgcttgaacccaggaggcagaggttgcagtgagccaaacgttccactgcattccagcctggatgacaagagcgaaactccgtctcaaaaaaaaaaaaaaaaattgttatgcttagttccatggaaagactattctgaagctttaagtcttctttttctattttccatagtattgccccttccccacttcattgcttaactgtctctaaattttaatgataataatattttaaaggtcagataatgccattagaggcagagacaaacctggggaccaagctaatttctctgttattgagagcgctaaagacaggtgaactggagttttatttcctctgctagagtgaaataataccctctccaccaggcacaatggctcacacctgtaattccagcactttgggaggccaaggtgggcggatcacttgaggtcaggagttcgagaccagcctggccaacatggtgaaaccccatctctactaaaaatacaaaaattagccagccatggtggcatgctcctgtaatcccagctacttgggagactgaggtgggataatcacttgaacctgggaggcggaggttgcagtgagctgagattgtgccactgcactccagcctgggtgacagagcaagactccatctaaaaaacaaaaacaaaaacaaaaaaaccctctcaattggtttaataccacgatagaaaagataaatattttaggatggaatcttaaatatgtctgtccttttgtttcatatagttgaaatcaattcagtattgtttctacattaggtgtttcaaaaacagtcacctttgcaacagaagagctcttttgttgaaaatgattcacaatatatttcagttggaatgtcaggtggtatttctcttaccaacacctcacagaatctatgccaagctgctctaccaccaatgcaagtatttttttaaagctactaaaataaactttcttcaccagccaactctaatttggagacagtgtgcattggtgaaggacctcgtcagaataagtttgaatgtctactgaactaagaagaattttgtcgtttgggggagagaatagatggcatcagtccttcaattctgtaactgaagactccaattatagtagataagaattgtgtctagcaatttttaaacactgacagtccaaacaaaaatatttggtgaggaaggatgtcccatatttttgcttaaatatcataaacaaatatgagcatttactaattttttaaatggcattttgaaagattattcttatttacactctaaaattaaaggtgtactttatcttaagaaaatgatatattaaaaattcatattttaaaagataaaattggggaatttacagttattttgtgaatggcctttaaactatgatttgatctatatacaacttttcagaatacttttgattgtgtgttggacatatctaaaattaattttatctggcagaattaaacctaaatttatttgtataaaagagtcccctttctaaaattcatacagtgcccttgtattcatttatgcagtgtttataaatatttcaagttagattgtgagatattaataaatgatttatgctgtgaactgttactgtaataactcttaatatcatgatttgttgtatcattaaaaaaacacaaaattctaaactcttaaggttaaaaatcttaaccttatagtcaaaatatttaaacatctccctaaacatcactgcatagcacttacaaaaactacattgaattagatgtattcaatttccataaagttaaataagttaatataattctttgtaatttgtgaagagctttagtttataatgttcttccccatatatttcatgggatcaccagaagtctaggtgacagctgtattttcccaggtgaggatggggctgggatgaagagcctgaagctcaaagaggctgattgatttgcccaagttcacacacctggaacgttccaggacaggctttatgcctataggttttctaattccagcccaaaggttatttacatgtttagctttaaaattagcatccatagaggcttgagaaatccaaagagtattcaactgcagaatgggtttttttctaaactgcaaggatgttctatctcattttaaagtgtgatagggaagaataattaacataggggaagaacctgttactgatatatcattacatgtgtgctgtccccagccagagacagcagcagtccccagcctttttggcaccgggaccggtttcatggaagaaaatttttctacggatagtggggagcagaggggtatttcaggatgaaactatcctacctcagttcatcagacattagattctcataagaagcacacaacctagatccctcgcatgcataattcacgacagggttcacactcttgtgagaatctaatgctgccgctgatgggacaggaggtgaagttcaggtggtaatgagctgtgtggtccagttcctaacagacctcctgccctacagttaaagactctccagttaccatcaccacactaaatctaatccttgtactagattcaaattatctgatttacattgacttgtttaaagaggtattaaggtagggattcccaaaataaaggataacataagcaaaagacgggtgacaaaaagaaagaaaaacaagagcgagaaaataaaatgggaccagaaatgaggctacatgtcacaccagaatgactttcacatgtgctgttggtatgccacaaatctgatcctaggcttcattagagataactgttgcatccagttatgagatgccatttattatcactaaggcttagtggtcactctgggtcctgctgcttttccagggatattgctattatttaaaataaatgctaatgttgtcagtgctttatagagagggcaactccagtattaaagtgtaatatttcaattacaggaatctctttggagtctcagctccagttttggaacatatcactaagtaataactaaagatctcaaaatgattaccagtatttttttttacacacttttttttttctttcttttttttagacaaagtgtcctgtcacccaggctggagtgcagtggcgtgatcttggctcactgtagccttgacttcctggactcaagtgatcctcccacctcagcctgctgagtagctgggactacaggcatgcaccaccatgactggctaattctttgcatctttaatagagaccgagttttgccatgttgctcaggctggtctcatactcctgggctcaagcaatctgcccaccatggcctcccaaagtactgggattacaggcataagccactgcacccagtgacatggtttttataaactaaaaaattcaatatgtaaaatggtggagaggatagttaatgctgagatctgaataaatggacttgaataaaaagtagaatatatcttatagattctaactacaaaaatgaaaatgagacatgtatctctgacaaatgaagacattctcctacataaccacaattaaaccatcatagttaggaaagtaacactgctgcatgactgtcaactcatctttagaccctgttcaatgatctttaggaaaaaggatctagtccagaatcattttcatttaatttcacgtctcttttgttttcttcagtctagaaccgttttccagtctttccttgactttcacaaccttgaagcctttgatgttaataggcaagttattctgtagaatgtccctcaatttgatttgtttgaagatcaattcctgctgattaaatccaagctatgtatttctggcaggactatcactggaatggtgctgtgttgttttccctgcatcctaccaggtggagaatgattttgatttgtcccctcactggtgatgttaacttcaatcacttggttaaggtggtgtctaccgggctttccactataaagttccttttctttttgtcattaatattttgggggatggagttattctgacactgtgcaaatatcctgtcctcatcaatccatttatttttaaaaatagattcctgttttatccaatggattataatcaattttattcatttattcattcattcatttttttgagacagggtctcgctgtgtcgcccagcctggagtacagtggtgtgatcacagctcactacagcctcgaccaggctcaactgattctcctgcctcagcctcctgagtatctgggaccacaggcacataccaccatgcctggctaactttcgtattttgtgtagagacagggtgtcaccatgttgcccaggcggttctcctgtgctcaagcaatcctcccaccctggcctcccaaagtgctgggactacaggcatgaaccacagcacctgcccccattattaattttgatgctcaatttttcctatatttagccagtgagagtcccttcaagctggtttctgtgtgcttttgacatgtccccatcattcttggaacagttccttgttttccagagtgagatgtttcgggaccagcttgtactttctctgccacagctctgaaatcagctatatctccaagaagccctggttccttttagtcaagagcatatttagaaaccacgatctgggtgttaggtattctcatggctactgagttgtcactgatcctcagccctctcactggatagaagtgtatacataatttgcatttaatagttatttctctatcttaaaaaccatgaggtcacaccaatatctccaattccaacccaacactacaaagttcattctaattttcttcctttccatatttataaccccttttaccacctacccatgtatttttaatatagttttgccttttttcccctatatatatatatattacttcttctcacaagactgaaattcatccaagttgggtatagctctagtgtattcatttaactgttgtattgcctatgtgtgtgtgtgtgaatatatatatatatatattttgacagtcttgctctgtcgcccaggctggagtgcaatggcgtgatctcagctcactgcaacctccgcctcctgggttcaagtgattctcatgcctcagcctcctagtagctgggattacaggcacgcaccaccatgcctggctaatttctatttcttgtatttttagtagagacagggtttcgccatgttg

SEQ ID NO: 15173 - DNA, 11581 bp, Human
gcccaggctgctctagaactcctgagctcaagcagcccgcctgccttggcctcccaaagtgctgggattacagccatgagtgagccactgtgcctggcagttttgttttttaattgtaagatttacataaaatgtaccattgtaaccattttaaaatgtatagttctgtggcattaagtataaccactttattgtgcaaccttcaccccacccagctccagaactgctttcatcttgcaaaacttaagctcagtacccacaaaacactaactccccctcctcctcgcctcctagccctagcaaccagcattctgctttctgtatctattggtttgacagccctagggacctcctataagtgcaattatagtttttgtccttttgtgactgccattgttagttttcagtgatttttaaaagtatagaattaaggaaagagtcacaaacggtttttcaattttttttttttttttttttttttttttgagatgggagtctcactctgctcccaggctggagtgcaatggcatgtgttggctcactgcaacctccggctccgggttcaagtgattctcctgcctcagcctcccaagtagctgggattacaggtgcataacaccatgcctggctaatttttgtatttatagtagacggggtctctccatgttgaccaggctggtctcgaactccttgcctcaagtgatctaccagccttggcctcccaaagtgctaggattacaggcgggagctaccgtgcccagcttgtttttgttttgttttttttttttaacttaatagatatttctaaaagtgagagacagaagtctttgaaatttgaccaggttcatcctgaaatgggtagaaccgtcctaaatttgaacagcactgctttatgccaagacatcaagcaaccaattccgcaggttttctgtactttgtgggttttctctggccttccatcagcaggatcgccccactcgcgtgtaaggacagaaaaccatggttgacttttccccttgcaggcctgcccaggtgactttcagaagcctggcctcgaggggctggagattcaccagcattaggtgagaaatggatcatggcacccgtgtggaggaactggggaattctgaaaaatgcagctcttggggcacaggggcccggggtctgggtgggcttcccctgttccctggggtggccaggcatgtgaccaggcaggaagcagactgggcaatgggcctgccctgggctttgcagcctcattgctcttggcgtgaggagctgggggtcggggggcgaggtcacaccttcctcacactgaacatgtgcaaatctgatcatatgtatggtcctagggaagggcggggagggaagagacaagggagggaaagaacaaggggatttgttcttgtttcccacccacccacttttatgccccagagtggagggaaaacaggaatttactcttctcccacgtggtctcagatcctgtgtgtctcaaacagagcaagcacctcatggcaaagaggatgatcgtagagtttacatctgtccctcttttttatataattaaaaaacctgaaagttggtttgcatgacactggacattactggatatactgtgcacatattactacacagggaatttacacagaccccacattctgtcttactgggtgattcaaggactcttcaagggctttttgatttgacccagctgtgtcatatgcagtgattttagaacgaagcccagcgtgagctctgttgcttttagatttttcctcaatctgaagaaaagcgtttggactgtggtgtttgaaaacaagcctgtgtgttctgcagtgaagccgcacactcacccctttggttcttttctaggctttcttatcttcacaggcagaaatggcttaaacgggagtttctacaatcgactaagcttccgacacagcagaatcccacgatcccacaacccatttgttttttacgtgaaacaggcctcgggggagagatttgagggggttttattcttaaaacggcacatttgtagagaatgccctttatatatgttctaaagaaaagtgtacaaatactcaatgattaaagtgtctctgagaaagtggcttcggaccacaccagcatctggtccttttgctgtgacccaccccatcccggagctggtcgggtctggctggatgtgctgcccagtgagtgcctcgctcggtaactgcttggtcctgaacattctctcgtttcaggaactgatgaggttctcttcttttgactgatggagattacaaaactcttggattcctggaaaacaagacgacaggcatagagtgctaatggcttgtctaccccttgacagccctgtcctgtgctggggagggctgtgttttgacaggggtggaatcctctggctagttccataaaaagacctgtgtctgtgatgccctgagtctttgaaagtgaccggaatacctcacactacccatcttgctcataaccagtggctgcggccttcctcggaccatctatagatggaggattctgggaatgctgtttccttacccttgacatcattcttctaggcaagtaaaacccagccacaaactcagagaccacagctttaacaaacactgacacctctgccctaactctggggcctctgatggctgccactggctgaatgtggcctgcacgtgggtttggtctggctcaacaaagtttttatttttattttttatttttttgagacacggtctcacgctgttgcccaggctggagtgcagtggcgcgatctcgccttactgcagcctccgcctcccaggttcaagcgattctcctgcctcagcctcctgagtagctgggactacaggcatgcgccaccacacccggctaattttcatatttttagtagagacagtgtttctccatgttagccaggctggtcttgaactcctgaccagcctcaagtgatctgcctgcctccttcacccaaagtgctgggattccaggtgtgagccactgcacctggccttttttttttttatcagttacttttaaaaatgaattactttatccctttattgggatgtatttcctaagccataaatttcaccctcaccatgttttttaaactatgaattaattcacaatactcacacattgagagatttctcatggactcctggcttcctcggctatgggggccactctgtggtcatcacagaccccaccacccacctgtccttccacacccctggctcctttatgttgcttcctgccccacaggcatctgcatttagtactcatggaaatacttactctgaattatacttctgtaggctaacgtggctggggaatctggggcgtcaatgaaaaaagactggcctttgtcacaattcttaccttaaaaaagaaacaaacggaagacaattcagtccaagaggaaaacagaatggccacaagatcttggggctctttccgtgctggtgacaatgggaagatcttgagcccgcttcactcgtaatgaagaacaaagtagaaaagaccagtggggtctcagggaccttccttccagcagggtccccagccagcatttcagcgtggctaaataatcaggtggtgtacagaaaatgcaggttccagggccctacagagaactgattcagcagcttccacatgggcccaggagtctgcattttaagagattagcttttgagtgaaaggatcatgaatgcacatggttaaaaaaagtacagaatgcaaaaggatatggcataaaaggccaagtccgaaaagggctactagtgttctaggtgtctttccagaaagattatgcgcatataaatgtgcacacttgcatgtgtgcgcacacacatacacacactctcatatacctaaaatacgaatgggagcacatgacacacacattctgcctgctgctttgtctgtgtataattttatcttccaggtcatctgtgctggtgtctatcagtctgctagtctttccccgccatgtggccattgttccagtcccctcctatgcacacccaggtttctctaggaccatgttatcccagagccaggtggacaggacacaaagggctaggggtcaatgggggtgttctcgcctccagtctgccctgccagcccccagtcgtgggtggacctgccatcagcttgctctgcccactccccaggcctgagctgctggcgaaacaggcaagtgactgcactgcccatggccggtcaccagcctcaggtgaaccccaggaggggttcctacctagcactcatcatttcctcaacttcactactgtgtcgccctgtgggacagggaagtccaagtcggggaagaagcctgtggggaggggttggtgggagatggggagcccatatggcccagtgagtcaggaaaatagggtccagaggcagggaacataaggccaattcgcacttgagccataacaggaaatgtcctctccataggacgtatgccgtaaatgactttgtaactttacttcatccttttcgtttatatagggcatacctcaagtagagggtatttaaacacaaaaactctgtaatggggcctttgagcccctattctcaggcccgttctcctcccacaccgtggagttgactttcattttcaataaatcccttccttccttcctttctttgtgcgttttgtccaattttttgttccagacaccaagaacctggacatcctccgccgttaacgctgggcccatgagaccatgtggaactcgctagggaggcccctgagtgcacgttcgctgggccagacctgggaggttggggatcccagaatagtcatgctggggctactttctgtccctgactttcacccaggtctcccttccccagagggctccccagcccccaacacacatatatgctctagtgttttcccttcctaactgcatttccccctgggctcccacctctccaagaacgggcagcattatcagaacagctggtgtgagcacagccctgttccaagagatcccaggcatcctctcaccccaccctggcagatccctctcactaggcaccactgtcacctgcattttacacacggggccatcgaggctgagagcggaaatgactagcccaagtcccacagctagtggtggcggagcagggctctgaggccagcccttcctgtgatcctcagcacaccgggaccaggacccatagcaccagagcgctggcatctgtaactctttgccaccatgtccccagaggagactgaagtgctgtcctcatgccttcctgtctgttcctaggaaggtgggttttcccccactctgtccccagtgaccttgccagatgcgtgtctgtcacttggccctcatgctccaccctcttgggtgggtgacagtgttaaccaccccttcctttctggcactccctggccttgctatctgtggcttcccctcaaggtgagcttctgcaatgtgccatttgacacacaggaccatgcccactagaaggcacttaatgttctcagctcagaatgagcctcgcagctgtcactggtggctcctctgctttgaaattagctcttgtgaaccacctggaactttgtttctttgtgaaaagtggccctgaaaggaaagaccagggccaatgccagggcttggtgtgagggaggtgggaagatggaggttgctggctctttggaagaaaagccgtatcaggatctaatagccccaaggtcacttcctgatctgtcagacaatggcaagggcaggcctgtggctgggcccgtggacatatttgggtgggtcagcaagcatgccatttttaaattttttttggagacaggttcttgctctgtcgcccaggctggagtgcagtggtgtgatcatggctcactgcaacctcaacctccctgggctcaagtgatcctgctaactcagcctcctgagtagctgggaccacaggcacatgccaccacactgggtgaattttttcctttttttttttttttttttttttaagagatgaggtatcttcctgtgttacccaggctagagcatggttgtgtgtgtgtgtgtgtgtgtatttaatggagttagttgctatcatttagtatcaggagactttgggtaaggatatagatttctagctcttcattaaaccttggaaaatgtggcaattgtgatggccataaggacacacctcttggatctctggcagcagctgccatgctccaaaatccaccaccacgtttgtgttgaggcaatgccactcccaggctgctcctagctagtgactgagacgagcatggcactcgggcaggcacgcttctgggagatgcagcccctctgatgggtaagtgggctcaggaatgccctggtggctgtgcccagctttcctcgacagcagccaagacactccagcagacagatgctccaacagactgacatactccagcagactgagatgctccaacagactgacatactccagcagacagatgctccaacagactgacatactccagcagactgagatgctccaacagactgacatactccagcagactgagatgctccaacagactgacatactccagcagactgagatgctccaacagactgacatactccagcagactgagatgctccaatagacctactccagcagactgagatgctccaatagactgacatactccagcagactgagatgctccaatagactgacatactccagcagactgagatgctccaatagactgacatactccagcagactgagatgctccaatagacaaatactccagcagaatgagatgctccaatagacaaatactccagcagactgagatgctccaatagactgacatactccagcagactgagatgctccaacacactggcatactccagcagactgagattctccaatagacaaatactccagcagactgagatgctccaacagactggcatactccagcagactgagatgctccaatagactgccacactccagcagactgagatgctccaatagacaaatactccagcagactgagatgccaaaaagcaaagtacactgaggtgctccagcaggctaagatgctcccatgggctgagatgctccagtgggctgagacgctccttcgggctgggatgctcccgtgggctgagatactcctgtgggctgagatgctcctttgagttgggatgctcccgtgggctgagatactcctgtgggctgagatactcccttgggctgggatgctccagtgggctgagatgctcctttgggctgggatgctcccatgggctgaggtactcctgtgggctgagatgctcctttgagttgggatgctcccgtggcctgagatactcctgtgggctgagatactcccttgggctgggatgctcccatgggctgagatgctcttgagggctgggatgctcccttgggctgagatgcttccaggggctgagatactcctatgggccgtgatgctctttcgggctgatatgttccttcccccactccttcatcgtgggctaacgctctcccttgtcattttctcccacagatgtttcccctgacaaacgtcctgcccaccaatcccatctcggcagagctgaactgtggcagaggtgcaggctggcaggaatggatgtgccctgggctgctgcaagctcctgtccccaatcacatccattcatgcagcccaactgcctccaggggcctcagagggcagctctcatcaccacttccggccactgcaaaagctgcctggtgagtgttttatgatgctggggaaggttgagaaagcagctgtacttttctgcatgttgttggggaaatcacatgccagagaagtattgtgggatgtgggaataagggaaaaaggatttggggacacagcctcctgggcacatggggtctctggcgttctcccgggctgttcccatcttcagagtggccctcgcaccctacccccctaccacttcctcgaggcagccatcccccaacactgtcctcctggctcccgctttctgcacggccccttggcaatcctgtccatgtcctgtggcttcaaaactcaactgcacggacatgaaccaccttctcctgacggaccccagaacctgctgacaacctgagcccccgagccccttagccgcagcaccccagagggcccggcctccctctaccacccctgcttcactgtctctgagggacggaccctcctccaggtgacttgtactggcagcagggacaaccttgaccctcagatgccgtcactttctctcttgtgtgtgtcccttcctttctacaccaacgccagaacccagggcctcatcctgaacccctatcccagggcagccactcctgagcctcctgttcccaggcacatgacactgacagtcgtttcccacaggctcccattctccccatgcagcccttccccaaggctccccacgtggcctccgccctccccgcctccaggctctccacgggccccgccctctccccaagcacgcggcccccaccctctcctggccaggccatacttcacccgcccggcccctctctcctgtcccggcacagacacctcacactggccttggttccctgacaaatggagtggaagttccgaggcatgggtgcagccggcactcctggatcccggcctcccctccagccttctctctctgttctcccctcagacctaaaggcgagtgctggacgccccgcaggagccccactaaagggccccagtaacggaggcccgcccggctccgcggtcctgggggacagcagcctcctgggggagcagcttcgagtgtaggccctgcccagcgccccgcggcgagtgggcgcccggcgggcgtgtgggtggagacgtgaaaccccgtccctccttcagcctcagggccactcagggagtgggcatctcttgggatcctgggagacccacgtacttaagaagagcattttttgggaacttggcccctgctcgcaggccagtgatccgcgttccggtctgtcccggtgctggagacaaaggggcctcatctgtgccgtgctggcttctccgggcacaggaggcccggccccttcctaagggattttcacctcaggccgccttcctctgtaacctggacgccatgtgcatcccctggagccgcccctctatcgggtgccctcctcagtcccctgccaccaccaccctcaccaacctctaccccattcttccaggcctcacccctctgcctgaggcctgcttgctcccgctacctgcccgcaggggtctcggcctctctcccggtggcctcttggggtgccagctggagggtgggtctggctccagcgccccattgaccctcctccttccattgcccctctctgtagccgccccctgttgtgcccgacccgtgcctgtggggctgaccgaggagtgaggtgccgccccacactggggtcacccacctatgagcggatccaggggcactctgccgaggagagggacctccaagtcctggcacatgagctccgcgcccccggttgtgggagggaatatctgagattctttctgcaaggcaaattcaaaggggaggaaacataatttttttgcagaatcacaaggatggaccacattttaaagaaacttaaaaaaaaaaaaaaggcttagtttgaatgtggaacccttaacacctaaagaactttcctttagtcagcagaaagggattttaattgtgattccacttcccaaaatgacagggaaagcagaaatagtttgcagagcagccttccgatcgtttcctcatccatgagagcaagatcttgctcgcctggcagccccacgcgccctcaccttgcacttaggacagatgaagccactcatgttctccaccaccccgatgatgggcagcttcaccttgcggcagaagttgatttctttccggacatcctggagtgacacctcctacgaaggtgaaaagaccagtgattccagcatcaaagtgcgagaaagggaatgtctgtgcaaccgaggggatggctgcaatgcagtggatctgcgatcataaagccttagaggtttctgccctgatagggtttggctctgtgtccccatccaaatctcagctcgaactgtaatccccatcatccctacatccctacaggaacaggcagttcctggtgggaggtgattggatcatgggggcagtttcccccatgctggtctcgatagtgagttttcacgagatctgatggttttgtaagtgtttgacagttcctcctacacactctctctctcactgctgccactgtgtaacatgtgcctgctttgccttccaccatgattgttaagtttcctggggccttcccagccatgcagaactgtgaatcaatgaaacctctttcccttataggttacccagtctcaggcagttctttacagcagtgtgaaaatgaactaatgtatgccctctgccaaatccatatttatttagtacctactagtgctaagccctgtttgttcgaggtgctatttacttcccacacagccaaatagcaagaaatcaacctaaaagaaaatgacttttttttttagagacaggatctcactgctgcccagtctggagtgcagtggcataatcattgctcactgcagccttgacctcctgggctcaggcaatcctcctgcctcagcctccagagtagctgggactacaggcatgtgctactccgcctggctaactttttaattttttatagagatggttgttgcccagactggtcttaagcttctggtgtgaagtgatcctcctgcctcggcctcccagagtgttagggttagaggcgtgagccactgtgcctatctgaaaatgaccttttaacgcatctacatgctccatgtccctatactatactatattaagccagtgtgtgcactgttttctagaccagagcttggcaaaccccagcctgggggctgaatctggctggttttataaataaagttcctccggaaccagccatgcccgtccctctaggcaccgtctgtggctgcttcatgccacagtggcacggctaaggggctgggacagggaccgtggggtccgcaacgcctacttcctatctggccctttacagaaaagtttgccaatccctgctctagataattataaacacaaacaactgactaaaaggaaataaggaatactgcccaatgtggacaactttgcatttccttctcaactctgagtttttccaatgtgattactgtgtataaacaccgctcagtagctccctattttcctcagttaatgttatcacagatccctgtacccaagtcctgctgtggcttgtcactgtcaggtgtagtgactccttagcacctggagcttcaccactcacgtgagcccgaaaggctcgcagctttgggcctgttcttttcctgagatgcctgtttggctcttgacactgaggctgggatgcggaggaaggggcgctcagctagaaagtcaatgggctgcgactcagtctctcatttctttctttctttttttga
